United States Patent 10,407,724 (METHODS AND COMPOSITIONS FOR SCREENING AND TREATING DEVELOPMENTAL DISORDERS) - sequence listing, part 22

SEQ ID NO: 589 - DNA, 142980 bp, Homo sapiens
aaaacagtattgatcagtgctcaactgttaatgactacactataaatatctcagcctgtattcaaggcagtaacccaccccttcagcttctctaactgccagattctggagtacacagggcacagcctctccaagccaaggtatatcactcactgtccacaggcaaaaccatttgaggttttgccaactctaagctcacagtttctttaacctagaatactcttagtccaaccctatattcaaatccttttcatcattcaaggcccattcaaaaattacttgttccatgaagtcttctctaatacccaagctcaaaaaagtctctttaccatttgggtgaacattatctgttcttttatggccctatggattctcatatatacattttcttcttccataatattaagattaacctgtacattctacagtcttgaaagctagaagtttggtgattaaaggtatgttgtttttttcagaatttaggaaagggaatagttgtccacagcaatgttttctttaacagtaaacaatcaggaaacaatgcaaatttccaatttcagaataataagtaaactgtatcatatcctattgataagattacacgcagaggttaaaatgaaaattatgaattctaagtagccaaatgaaagcatgcctataaaataaataataaacctaaaaagcaaaatattacattatttctatcataaggttacagttatgcaaaatgtactattatggacaagggttgtaaaagaaaatgggaaataaagttggattccaaggagaaagagcattctttcaccttgtgatttgttattgttggtaacacttatgcactaactttaattaaaaacacacatacaaataaattggtaggtacttattcttatacaccaggtcacactaacctcttccttttgtcacagagctataagactgctgaatcaggccaacgtggttgacaggatacagatgggcttcaatcaaataggagataaagcatgctgcagacacagtggggaacgtaggctggttgctactatatagatagatcagctacaagtttatagataattgatgttaacaggtcaaacccactgtggaaagttgtccttagtgagtctgctagcacctcttactattataatcagtgacttaaaaaagaaggcacaatgatcaaatccaaagttgacatgaagttggctggaaacaaacactgtgacacagtcaagataactgggcaaggaccccagttttttttattttttagatagagggtcttgttatgttcccacagctagatttgaattcctgggctcaagcgatctcctgcctcagccatgcagctgggactataggcatacgctcgcacgcctggctaggacttgaaatgcaaattgtgttaaaccaaccaagtgtccaggatttgagaggtcaagctgttggagaccaacctgggcaacatggtgagactccgtctccacaaacattaaaaagttagcagggaatggtggcatgcctgtgcttcctggaggctgaggtgggaggagcgctttgagcctaggaggttgaggctgtggcagtgagtcatgtttgcgccactgtactccagcctgggtgacagagtgagaccctgtctccaaaacaaaaaaaaaaaaggaaggtcatgctgaacagcagttcctataaaaccaactagaaatgagtttactttaggcttaatagtagtcttcaatgtgctatggtacaaagaaagccaacttaatactaagttgctgaatacaaaattattccatcaatcaaagcccatttcaaagtaccatgactttcaagagacctactgtttcaaattttgctaatcccaatttctcataaagcttccctagaaaaccatgtttgtgcactaaataatattgtattttactttctaattactttatataattaagctttgtcaccttaagttatgtctcaaagcaggaatcacgtttaacacagtattggcacatgcagctcattaaatctttgttgaattgaattacaaaatgctgaggaaatgtaaaaagaaccctaagtatagaataagaaaaggtttaaaggctaggcgggtggctcatgcctgtaatcacagcactttgggaggccaaggagggaggatcatgaggtcaggagatggagaccatcctggccaacagggtgaaaccctgtctctactaaaaatacaaaaattagctgggcgtggtggtgcgcacctgtagtcccagctactctggaagttaaggcaggagaattgcttgaacctgggaagcagaggttgcagtgagccaggatcgtgccactgtactccagctgggcaacagagcaagactccaactcaaaaaagaaaaaaaaaaaaggaaacagcgaggccaggcacggtggctcacgtctgtaataccagcactttgggaggccgaggcgggttgataacttgaggtcgggagtttgaaaccagcctgaccaacatggagaaaccccatctctactaaaaatataaaattagccgggcgtggtggcacatgcctgtaatcccagctactaggaagggtgaggcaggagaatagcttgaaccgggaaggtggaggttgtggtgagctgagattgcaccgttgcactccagcctgggcaacaagagcgaaactctgtctcaaaaaaaaaaaaaaaaaagtaaacagggacacttataaagaatgtttctgatacgttaaagtacatgtgttccaacaatattggcatttattcctatgtgtaaaaataaaagattaaaactatctcatatactccataaatatacctactacatacctataaaaattaaaattattttaaaataaaaatttaataaataaaaggaagaactacaataatcacagctgtaattaaaactcttaacgaggctgggcacggtggctcatgcctgtaatcccagcactttgggaggccgagctgggtggattacctgaggtcaggagttcaagaccagcctggccaacaaggtgaaacccccatctctactaaaaatacaaaaaaatagccgggagtggtggcgggttcctgtaatcccagctacttgggaggctgagccaggagaattgcttgaaccccaggggagcggaggttgcagtgagccaagatcgtgccattgctctccagcctgggcaacgagagcgaaactccatctcaaaaaaccaaaaaaaaaaaaaataccccaaaaaactcttaactagtactgtctaacaaaaagaaatatttttaaaatgtggttattaccaaagattttttaaaaatgaagagcaaaaaaaaaagattaacagattagaaggaaaaaatacaaaaagaattcaatgacaagcaggtaaaacctcagcaataatcaagctcattagagggaaatttcatgagtaaaaaatgataataaaccacatctttagaaaagtggattttaaaagtatagaaagacattttcctgaaattatttccccagataaaatgattttgagattattttcctacaaaatttcccattttgaccatatgcaagtctatccatttataggatttcttgttttaataatctatgtagaaaaaactaacttttaaaaaaagactaaggaaattcattttgctaaataaaaaagacctgaaatcaacttgtgccgattcttggagaatcaaaacaacagtcagcaaagtctgaagtcttctcagaagatctctaaatatccagacaggaagcaaaaggccttaggaacacagaagttcttttcatttctttccaattgaaggtgttgatttagaaagaaaaaggaaaacacaagtgaacagctgactgcattgatagaccctggacactagaaattggttatcaatataaaagagtccctcaaaagcaaagagaaaacaggcttcagaggacattctccagtctaagcaagaggacttcaaatcaattcgagaaaaaaaaaaaaaaaaagccagactgactctaaatgtaacttcttttaaggcagtggatgtggtagttggttggtctcaggggcaaagtattaagaaagttgaccagtgacaatggtagagactgcataccaacccacatacacacagttgccgcacgcagggtaaataaatggggcttcatagaaggcagtgaggcccaatacagtgacatttgtacctgggtgaggaaagtcaaaatgatcctttgctccagagagaggtgacaaagaaccctgagggttaaaatatatatttcttcctggaaagtggcagaactgactgatggccaagtggggagtgccaggataaaaatataaggataggatgacaaatgatattttgaggtattatcctagggtggcctggtcacatgccgtgtccaggtggtgattttctaatagaaatgagaaaatgaacacagaggggtgactcaacaggggtgactcaacactatgctaggaattcagtctgataaacaccaacagctgattctggcttcacgtgttgtgctgaaaattcatcttcccagaaaacaaaggacaaatgccactccaaatgaataatgtagaagagatggcaatctggggagaaaacaggtgctcccattattttgggaggaaatacatgttcccattatcttgagagcacggataggcacagacctatgcgggccctggacttcagaaaggatcattttggccagatgtggtgactcacgcctgtaatcccagcattttgggaggccgaggcgggcggatcacttgaggccaggagtttgagagcagccttgctaaaatagcaaaaccccatctctactaaaaataacaacaacaaaaaaaaaattagctgggcgtggtggtgcacgtgtgtaatcccagctacttgggaggctgagtcaggagaattgtttgaacctgggagaagaaggctgcagtgagctgagattgtgccactgcagtccagctggggcaatagtgaaaaaaaaaaaaaaaaaaggaaagatatcgtttcaaacacatagagggacaggaaaaaaaatacaactaacacacaccataggttctaggataacagaccctaaaataaaattcctttgcagagtaatgagagtctaaaagaaatcaatcatgaatgatctcaatgacagaagaaggaagaaagcccctcctcaacccctattttaagaggacatgcacagtagaaggaagaagaggataccaactcaggtggatcagtagcatgtccaagatgctcaaaatcaaaacaagctgagtgtatgtaccaaagtaaaagagctaaagacagtgcaaagagctttttccaatactggttgaatatctcttctccaaaatgagtgggaccagaagtgttttacattttttatttttttagattttggcatatttgtattatatactgtttgagcatcccaaattaaaaaataaaggctgggcagggtgggattacgcctgtaatcccagcactttgggaggctgaggcggatggatcatgaggtcaggggttcgagaccaacctggccaacatagtgaaatgccgtctctactaaaaatataaaaattagccaggtgtggtggcatgcgcctgtagtcccagctattcggaaggctgaggtgggagaattgcttgaacccaggaggtggaggttgcagtgagctgagaccatgccattgcactccagcctaggtgacagagtgagaatccatctcaaaaaaaaaaaaaaaaaagtttcaaattttagatgatttgggattttggattttcagatttgggatactcaacctatactttcaaaataaggagacatgtcttgtctacaacttatagaaactagtatcatgttacagaggatagcaagaaaataggggttcgcaatacctatgttacctatctttctcttcagtgaggagaatggtgaacaaactatagcaagtggaacaagttgaagtgggagaacactgaagttcacggtagctcagcagttgatgactaagtgcttggccttcttaaatgagttcaagtctccaggaccagaattatatctcaccataataagagaatttgcccttttgagaaattatgaatagtaaggtaggtgccagactataggaaaaaggtaaataatgactaaactttttgaggatataaacactgcgttccataaattgcagactagaaagccatatgctaattttctgtagaattttaaggaaacactatagacatttgtacatgtttatacaagtatgaggtaaatcttgggagacaacatggactttctaatacaaaatactaacctaagctttttttttttctaacatgattggtaagctgataattgggggactgttatagatgtaaaggaccgtaacttcatcgaaacatttgattttctacctgttgagttttatttctcatcagacaaggacacatgaaaaaaatgaataagaaatcaatgtgttaagatggtggtgatgtgacttctttttcttgccattaaaatttttctcctgtttactgttgtaatgctaattatgttatataacttaagaaaaaaattaagtgtatagactcagtactcataagaaaaaaattaagtgtatagactcagtactcatacacaaataaatataggagttcatacaactacatgatttctacagtctagtcaattaccaaaaatttggattctgctttttggggaacagagtgggaaaacataactttgttttgaaaaaaaagaaatagggttgatcttgacttctcatatgaattaatgagaagacgtaattgttaaatttcattaaaagaagaatgttgtatttcatgtaggaggtaacagtgtagacacagacatgttctctactggttggagggtatgtgaggtgctgtgttcaaatatagttgctttaagagggatgctgaccaaataaattatgtccaaaagacagcaactgaaatggtgaaaggatacagaaatcctaacagaaaaacaggtgaaggatttggagtttttctcctggatataaaactagaaaactaatgatttatttcaaatacataaaagagttgttgcatggaagagagatgaatggtggtacagatgattggaaactagcaggtgacagacattttgctcaatatagaaaaaaacaccattaaatcacgaagctggctgtgcactggccatcaatagaagtattcaaatagtggtggtataagcatttgtcggggtaggagaggctggagaaaagctcttaggtcttcttcaaagatttgagggattaagatttgattttaactcttacttccgccttaagaaagttctcaatgaaaatgaaaaatagcatctgagaatagtctagattggtgtttcccaaacaaatctacaaattccatggctgttaataggcatgctatattcaaataaggttgaaaagcactgtatatgacatgctgtatttggagatttgattcacaatgcatactggccttaacccagctatttttcaaatgctgctaatgacgctcagtctcacaaaaaccttaatgtgatggaagcctaaatttcttttgggaaaaaaaacaaacaaacttagatttctgctttcaggaattaatcagcaaaagaaccttcctaaaaagaatgtaattaaccacatattgactcaaagggcctcagggttagaggaaacttaataatttggccgattctctcatccagggctcaatcctcctttatattctcttcactactgaaacagttccatgatcttgagagaataagagaactactgtgtgccaggtgctgttctgggcactgtatttaaaaaaattgtgttattttaatcttcacaatctgtatgaattattatcccctttctttacctatgtaaagaaactaagtctcagtgaactaataccagtgaaaagtccaaagagctactaagtgccagggcttcatgtctcctgggatcttaaaggttgcttctcccaaagagagaaaaatcaggaataggatttgatataatggttagcagtgaataaagccccaaataattttctttctcagaaagaacccagaattcacaaaagcccttttgtgttatgagtacaagaatgttgccttattctttgatcattttcagaacaactttggttacccagactgatatggttatttgcttgagataaaatatggcacaggtttggatggtaacacatatgagcagtttaaacctcatttagcagacctctcattacggaaaggattctatttgttgcaaaagaaaagatctttagtagtcatgtttttcccctctcaagattttaatacttaagatatctggctttcaaagatcttagtttgttagtaaatcagaagatggtacagcttctgcaaaacatactaaacgagtttaagatttttgggtctgccaggtgcagtggctcacgcctgtaatcccagaactttgggaggccaaagtgggtggatcacttgaactcaggagttcgagaccaacctgggcaacgttgcgaaactcagtctctacaaaaaacacaaaaaaacttagctgcacatggtggtgtgtgcctgtagtcacaactacttgagaggctgaggtgagaggattgcttgagcctggtaggcagaggttgcagtgagccgagattgtgccactgcactccagctggggcgacagaatgagaccctgtctcaaaaacaagattttgagtctaggagacttcactgttattcagggcatttctcactatctttaccttttcttccttaccgagaacatcaccagtggccatgatgtcacatgtgtacatagctgccatcaggcgctgaggtttcacttgcagtgcatagcgacatgcttctttcatggtggcaattagctgtcctgagaaaggtccatagcagtcagtgagtggagattctcctttctgtgatgtcctcttctcaaaggcctcagagcagccatcttgtagctcttggttttcatttccaccagaacaggtttcattttcctcctgtccctcttttgccagatcacttgctccttgttcctcaaatttacttaggtcccatttttccagaacaaaacagacacccatgagaggctcctcacacatggggccagagagggttgctagttggaagccactcacaatgctattgcccaaatctcggtatctactggcttcttttgaagctttgtcagctggacctgtccatactgagttctgaaaatcttcacttttattgactagtatgttgggcccacattttcttgggccaaatgaccagatttggtcaacaatgttcctccatcttctccctgttaggtgttgctccagttttcctttgaattcccaaattttctcttgggtcttctgatgaatcatgtgagtattttcaccctcattcaaagaggatgtcaactgctccatagaacgaatcaaatcactattttcttccagaatctgggtgacttcttctggaaggggcatggctcgaacactgagcgtggcaagtttattgggagttgttatggtgattagcccgtcagagtcaacttggattccttcagggattttgctttgatcttctttcatttggtgtatgactgcaactttttgctgtttgcctatttcttcattgaccatgtcaacttttgggggttttgtgattgtttctctgaatggaataataggttcagatacactgatatgaatctttgcaaacctacagacaaattcaagagaaataacagaaggttaaaatcaaaatagcatcaaagctcctgtgtagaaattactacacagtggagattctgtaaaaacataggaacataaaaattatcttactatgaaagatctgcaatttacattatataacattcaaaaactgctttctttctgattgaaaagactacttctaatgggaatatacctccagggaaatccttgcatgtactggaatttcacttttttttttttcattttcaagatatataaaccacccatttagataagaatgttttgagcagaaaataaatgttttaatatatgaaatatgaatgctttaaaacagtatttgcccatctaagagtgtggagaagaaaagctcaatgattaaaactctaaatagacatagaatcacagaacctcaggatagctagtcaaatcttcacaatgtatttggctttgataatgaggcttatagcaaggctagcatgatccatgagtttgtctagagcagcactttccaaaagaactttctgcaatggtggaaatgttctatatgtttattgtgattgctgagcccttgaaatgtggctagtacagctgaataaatttttaattttatttaaatttaaatagacacatatagctactaagcatttgaaatgcggctagtatgactgaggaactaaatttttaattgtatttgattttaaacagctgcatgtgggtagaagctactcttctggacatcataggtcttgagccccagtctgccaccaagttcagaaagccccttttcccacataatatcaaatttgatattgttgtatattgtatatttacaatctttttgtatattcacaggatatacaacaagatggacccgacattgtatgtttttaaaactactttgatattcaaacctgacaaagacagtatatatacacaaaactgcagttcaatcttacctaagaattcagatataaaatctaagataaaataacaaaaactatggatatgcaggtgtgtgcattaaaaaaaaacttattatgtatgaggcactgtgttaagtgttttacatgtagtatttctttagtaggcactagtactatctaattttgtagaagagaaaaccagataagaaagattaagtaatttctccaaatagtctgtaagtgaagaagctaggattcaaatttaggtctgacttcagaattcacactctcagtcattatgctatactgaaaaatgaagttactcagtacattaaaggaataatttactacaacactacgaagtttgtattataggttatatgaaaattaatttgtattagatctgttaataccacattaaaaatatcaaataatctatgtagccacttttaaatatgctaaattggcattcaataagattcaatacctattcttgattttaagaaaaaagccacttaaaaatcttaggaataggaaaatatttctaaaattatcattacatagagaaaaatatgctcatatacttagaacactcaagaaaaccaacggcaaagcttctgaaactacgagagagaacacatctacaacactgccctcttattcctgtaacatagtcaaaagagctatgagccactttagtccttctaattcctgaggctcccaagaagtctcctgtagtaatcatttatatgattaattaaaaccactccaagctgtggaaggaagtgtgtgatggttgccacactcacaaagcacctcaggaccaaaggttctttaagtcctagcaatgcagagcctgtgatgacactaaaaaaagtgcggtaggctcaggctacatcatggcaatttcctgtggcttcctgctctgattattactaccttgagatctggatgctaagaattctgacagtttctctggcctggagacaatatagtctccttgtctcccattcctggacataatccattcctgaagatgtgtgtagaagttgaaaaagattatatactaccaaaaggtaggctctgtcctatgagaactaaacaaattctataacattatacacattcttaatgtaagcataattgtgaaatgtaatagtcatatagaacagtgcacaaaacaaaaatctactgatctatgataacttacctcaaagtgaacacccatgtaaactacatggtatagtcaagaaacagaacagtcttagccctcagagggccccaatgccattaagtatgaaggtaactgttatcctgatttttattgtaatagcctccattttttttaaatcacctaaccatgtaaccccttatactccacagttcagtttggactgcacttctttttgttcttttttaaaaacagggtcttgctctgtcacccagcctgaagtgcagtggtgtgattacagttcactgcagcctcgagctcctgggctcaagcaaccctcttgcctcagcttcctgagtatctggtattacaggcatgcaccacctgcccgattaatttatttttatttttttagagatgaggtcttgctatgttacccaacctggtgcactatgttttgaacttcatataaatacaaacaaacactttttgggggaagtgaagtggcttcttctgttcaacattatattgtgagattcacctatgttttatatagctgtagttttgttcactgagatcattctatagaattccattgtatgaatacgccattatttatttatttatttatccatttaaatgtttgagttgtttccaacttttggctactaaaattttgttgccatgaggccaggtatggtggctcacgtctgtaatcccagcactttgggaggccgaggaggttggatcacttgaggtcaagagtttgagaacagcctggccaagatggtgaaacaccatctctactaaaaatataaaagttagctgggcgtggtggcgtgcacctgtagtcccagctactcaggaggccgaggcaggagaattgcctgagcccaggaagcggaggttgtagtaagctgagagtggaccactgcattccagcctgagcaatgggagtgccttttctcaaaaaaataaaaataaataaataaataaactgttgctatgcgtattcttgatgcacatttgcctagctttgtgttgtgtatatacaggtacaaatgggagtagatttgccaagccacaggaagtgcctatctcccatcttagcagatcataccaaatcatattccaaaatagttgtaccaattgatatccccactagttgtgtgggtgaattcttgttgttccacatctttgccaccacttgataatatcacttaaaaatatttaaccactctagtgggtatgcagaagtatctcactttgattttaatttgcattccatcaattagtaataagttgaatagtctttcatgtttattggcctttggaagcctcttttatgaagtacctcttcaagtctttgtacagtttttctattggattgctgctcttctcatttatttgtaggaattccttccatattggggatataagtctgttgtctgttacaagtggtataaaggtcttctctaaccctgcggtcagcctccttattatcttaatagtgtcttttgatgatcaaggttttcctttgtcattagtgctcttaacatgctattaagaagctttttgccaccctgaggtcttgaagatattctcttatactatcttctaaacacttcatggttttgccttttacattttaaccaacaactcacctgaaataaatttctgaatacatcatgaggtagcggtctagtttctggaatctggtagaagcttctacaaaatcccacataaatgcagcagcagttattctattttttttgagacagagtcttgctctgttgccaggctacagtgcagtggtgtgatctcagctcaccacagtctctgcctcctgggtcaagcaattctcctgcctcagcctcctgagtagctggattacaggtgcacgccaccacatccagctaatttttgtatttttagtagagagggagtttcaccatgttggccaggatggtctcgatctcctgacctcgtgatctgcccgccctggcctcccaaagtgctgggattagaggcgtgagccaccgtgcctggccagcagcagttattcttattctattattagtaccaggtgttgttgtatagttactactaccaccgattttactgtggtataaagattgagataaatagtgcttaacacagtgactgttatttaatatatgactatatcaatcatttataattattatttttgttatgattatgattatagtcccagaaattttaaaaacaaaaagaaggaaggccattacagggcagtttataattttttctactagtaagcacagaaatgtatattaaccatgaatatctttcatttgtcttcaagattggtgaaatttttagaaaatgataaactatgcaaagttggcaaaagtttgagaagaggcaagttcaaatatttattgctagttataatgtaaattagaacagtctttcttgaggaaaatatggatcataatccttaaaaatatgcatactttttgagctagctataatacttccagaagtttatcttaaccaaataatcagaactgtgtatatagatatttgtgtatatttgaatatgcatagaacagtgcagatttatgaatctgaatgtaatggtggttatttctgcatgataactgaatgattctttttcttcttctgcattttcctaatttctgcaataaacatacattatctttggaacaaagaagaaaaatgcccgttataaaaatttgggatgcccattttataatacatatcatctttatagaaaaacataaagatttccagaaggtttacattgtaaagaccacatcaataagagaagaagtctatcctaattacatagccaacatttacaaaataatatcttgttttgttgtcctggtattttgtgtgttttgtgtacatgcttaaagtaaaatacatacacagaaaaacattttatgacttaagctaaaaatgcaaaattattcaagtgtaggcagtgaatgccatttttcagttattaaaaaataagtctacaatcgaataactgttcatgtctgaattgagggcatttcatttttctccaaaaataagccgcagtctaagttcaactggtttaggaaacactaaaacatcccattgattgagagctatcatttctccatcgctatcattttcacctaacctttcttttaagtcatccaggcatcgctgaaggtggacttctcctgctgtgactaaaacgtgctctcccgtttcctgaattaaaatctggacacagggatcagcctggtttaacagtttcattccttttacgagctgaggcatttcacctaggttaacaaaacgaaatagattaaatatgatataagaactaacacaattcaaagacaatggctctggctactgaagggaaaattacattgaaataaactcttaaaacaacaatttatttttcttccagatagtgtagtgatgtgaagaaaactaccttctagtaatttttttgtacagatagcaaacatgacacatccgcaagcttaccatcaagactcccaaagctgatctatattacttcttcaaatactctgcagatacaagctaccatctttttacttgtgaattcacctaaatcttataacgaatgtatacattatatacctagaaatgaaacagagcatttcctcaaacatcgcctataaaatcaacaaataagcaaaagaaacatttaatgtgatattcaagaaactgtaccagagcctcatattaaaaataattatttgtgaaactgcttgctagaacttgggttttagaataccctaactagctactttatctggtgagctaaaggcatcttctgcattgtgttctgcatgtatttttcatatataattgctttttcctgggagttgagagtagggatagggactgtgacctacatcttgggtttagctgctttttcaccccctttccacatactcaactgctactgctccctcaaggcaggtccaaggaagtctcttgcagctgccttagcagaaaccttggtcttaaagacgtttttatgcagtcttgtttcaattctacatttgaagaaaagacttagcaattcctcaatgcttggttttcagcatgtcaaacaaacaaaatcacaggaactttctgcaatgcaatgattttcaacatgccttataaaagtcgattaactgggagcaggaatattagaacttctatacctatttatttttgaaataaagttctaataataactaacatttcatagcactaacaatgtgccagacaagcactttacatatatgagctcattaacgatgaggcggtatgatgattgttctcattttatagatgaggaaacaggtatagagaaactaataaacttgtgttcaaggtcccagactaactaagtggcagaacctggtttagaagctgggcagccagccagagagcccatgctctgcggatggatgtcagcacacttgtaggtcaggtgatcaaaagccacatatggaatgcaaagaatcccaagggaagacggaaagtgggatttcactgtgtccagggttgacagaggcaccttcatttgttcctttttggcatactgtaattttttttttgtctaattaagtggattttcagatattatctagtgttaactaagccttcacagaattttaaacctggcttaaaaggattcctgcaaagatatcactgataatactataatactaataacataagcacatgggaataataaaaaaagaaatggcaaagctttttgtcagctctccatcaaacaaattataaagtaaaaacaatggttatcaccaagatgagatcccaacaaatatttctgaaaaaatatatacacacttaaatctgtctcttcaaggtaaaataaaggtaacagtttaacaataagaaaagtttttttttttttttcaaaagaaatttgaaacatggagacaacattttgaaattaggtgtttgaaaatgttgccgctgacagctatttggttgccaaagataacataaatacttcatgtataatgtataaaaacctcttacaatttggaaggtgattttcttaacctgttcttaaaatcaccaaatggatagttcaataaagatataagaattaacaaaccttctaattagtgtaagaaaaatggactgccatcaggaaaactagatgttcactatatacattttaccaaaaccttttaataattgggaaaatggaatactaaaatggataacgtgacttagtaaaggaagccaacgaatcattcttccctttggactatgcaattttgtgaggtgccttttccagtgataatggtcattaaaatcaagtgttttaacaaatggaacctagaagccgaccttggaatggctatatcacaaagtgttcaggcaagaccttcaaaaagaaggaagcattattgtggtagccagcctccaagatggctccaatcatccttgcctcctgatattcacattcctgtgcagctctctccaacagtgagtcatggctggcctgtgtgaccaacagaacactgtggaaaggatgatgtgtgattcccaaggctagttcacaaaaggcattatagcttctgccttagtgttttggaatgctggctgcagccaatcaccatgcaggacactcaaacagtcatgtagagaggaactgagattccccagccagcaccaacttgtgagcccatgtttggaagtacagttaaaccttcagatggctaccgcccaaggtgatgtatgactaccactacttgagagacacgatgctgaacgcttccaaattccagaccaagggaactatgaaaaataagtgttgtttcaagccactaaattttgaagcaatatgttacatagtattaggtaactaaaataattataagccacaatcacaaatcaatattatctataattatatgtacatactgtatgtatcttcatcaaatacaaataaaattaggtatttgattttcatcttaatttttaaataacttctattttgtgcttcataatgtatataaaacagcacaaaaattcatatatctatataagcataggtatcaaaaattttttttaactaatatggataaaggataaaacaattctagaaacaaattactctgctcagataaacaggatttcttggattcccacaagtgaagatccagcattgtctctgaggcagtgatctgaattctgacctcactgcttcctaactgtatggccttgggcaaattaattaacttctctaagcttcagtttccctcatgtgaagatgagaataaaaagagtatcctaataaacagggcttttgggaggattaaatgagataatcaatgtaaaatccttagtacagtgtgtggcatacagcaaggttcaattataatgaagaaaataataattgctttggaacatttgtagttctctgtgttgagtttgtagttgacctgtgggcatgaagtagagggtggctgccatgagattttgacccccacttgggaaattagagaaagaaaagtggaagaacaaatgctcacgatttgcttctccctgaaagaaaagaagcaaactgttgtcttctggattaatctagttgtcacaataaaaaaaaaagagaggacatggggatacgtggtctattcaagaaaaacaatgaatgtgtccagtgcctctcagaggcagtattactgcaaagtcttttaagagagtgaaatatcccaatagtcgtcagacatgtaatctacgaataagggggtcactgccccaaaataaggatgagcataagttactagggcaaagagtaaacagaaaataaatatcctctgaaagctcataggaacaaggaagggaagtttccccagacattctgaatgtaaaataacatgtggacaatgtaaaaacaccaagaaggcaaaacaaagagtacaaaattcagacactgaaaaatcaaatggggtgcttcagtaacacagtcaataaatgcaaggtaaatccagtaaaaacaatatacttaaagggaagaaaatagcaatactccttttaaaattatgaagaaaattatgtgccccttctaaccattttagtttactttttacaaagttcagataaatttaatgtaaacacatgaggaagtacactttggcctacaaattgataatcctgaataattccatttattagactatctcatttatggaaaggaaaggaacttaatcttactatgaatcagctatagtacaggaaatacactaggtactagaatccttcatctcatgtagccagtccttcaaagaagctggttctttagggttgggcttttacttagcttccataacagagaccacagactagcacataaccataacagagccttttaaaaattataaatttctattattaaaatatcacatcttaggccaggcacagtggctcacacctgtaatcccagcactctaagaggctgaggtgagaggactgcttaagctcaggagtttaggaccagtctgggtgacatggggagaacccatctacaaataatgaaaaaaattagctgggtatggtgacatatgtctgtggtcccagctacttgggaggctgaggcaggaggatctcgtgagcccaggaggtcaaggctgcagtgaatcgtgattgtgactgagccactgcactccggcctgggtgacagtgagatcttgtctcaaaccaaataaataaacaagtaaaattatggcttaaattattttttcctatttttaaaatgtatgtgcaaatgcaataaactaagtaagaaagaggatacaaataaatagtagaaacatctacgaataagctatggttgccagactcaaatatcacaacttaaataaaactgagctttcttgtatgtatttcttaggattgaacacggtagacaggggttagagccagcctagtgagtagaataaaagaacaaaatcacgaaaggccaggatctgaacaagcctaaaagaggaagcatgttttacacagaatgggataaatccgtgtagcaaccaaggcactgtgtcagtccacagtgacagcccacaaaaaattcctatctcgaggctgaaggcagatggctatttactagggctggccccaaaggtcagaggtccagtcctccaagtatctgctctggggatccagggatccttaatggctaggggtatgtcttagaacttgagacagcaatgagttcagaaggcttagctccagggagaggagggatacatatgttcaggagcaatgaggccattgtacacctcaacagaaaactaccattttaccatttgtcctttggtttccctaaggcatggtctggagattcttcactgacaatcactagcactggaatagcaaagtcacagtgattcaggattagcaatagtcatgggacgtgaaatacaaaagtaaaaaaggattgactaggcaaataccataagccaaagactaaggagttgttattatatggtcaggtatatgtgaatgtcaggtggccagcaggaaaggtgcagaaagtggtttctaaacagacgggaaattctcagtgtgcagataatctgtcaaacctagagggaagaggcaaatgatgaattctgaactaaggagcttgagataagattccaactaagaagaagtcacataaaacatgaaatttggccgggcactttagttcacgcctgtaatcctagcagtttgggagcccgaggcaggcagatgacctgcggtcaggagttcaagaccagcctggccaactggcgaaaccccgtatctactaaaaatacaaaaattagccaggtgtggtggtggatgcctgcaatcccagctattcaggaggctgaggcaggagaatcgcttgaacccaggcagcagaggttgagtcaagatcacaccagtgtactctagcctgcgcaacagagtgagactccgcctcaaaaaaataaataaatagataaataaacataagctttgctaagctacaatcctatgccagggttgtgggggatgtagagatgaccttgtctttgccatcaagaagatgcagtctccctggacagcaaaggtacctgtaaccatggcatgttcctaagacagaagttagatgccctttgaagagttgcttctactatagacctcaatgaaaattcattatatactgctgaaacaagtcatgaggaatcaaatactaaatacatgcatatgctttaaaagtataataaacatatgcttttaaaaataaggtcatcttacttggatgttttggttcaacagcaactctcacaataggagtggcttcgaagttgagtggtataaatggtgggcaggatggcaggctacacagtgttgcagatttcagcacaaaatcttgaaggcctcctattcctgtaggaagaaaagatccatacggtcaataagggatgataaattctgaatttatgtcagaaaaacagcagcatcaacccagtatatgtatcacagagccaaatgcttccaaaatgttgcaagaaatgaggcggacctgcactgtttttttttttgtacacctggataccatttgattgctgtcaaaatacagaaattctgccttttgtttcccacatgtacaaatcctattatatcagattgggctaatgcatagctactttgaccacagaaatgatcacttccagatatatttgtctgaaaacactgattatttctaacacttagttggtttttaaaaatatattaatttgatgaagatgggtctctactgaaataatcttctgccaaatccatctgcatatgagtaaagggaatttagaaacttaaaatgtgatgttgctatgtagtatgttaccctaagctaccctccatactccccctgttttagaagagaatcctagtcaaccccttccccctgccatacactcacttcagacttttggctgatgattgcatgagactctgaaggttgcatatttgtctttgagcagatggaagcaaaaagaatgtcttagaaagagtgataaggggccaggtgcagtggctcacgcctgcaatctcagcactttgggaggccgaggccggcggatcacaaggtcaggagatcgagactatcctggctaacacggtgaaaccccgtctctactaaaaatacaaaaaattagccgggcgtggtggtgggcgcctgtagtcccagctacttgggaggctgaggcaggtgaattgcttgaacctgggaggcgggggatgcagtgagccaagatcgtgccactgcactccagtgtgggcgacagagcgagattccacctcaaaaaaaaaaaaaaaagagtgataaagaggcatattgaatctcacacccagactatgagtagacaacattttagaacaaattaagaaacacatacaaagggccagtgcagtggctcatgcctgtaatcccagcactttgggaagtcaaggaggatcacttgaggtcaggagttcaagaccagcctgggtaacagagtgagacttcttgctacaaaaaattcagccaggcatggtggtgcacacctgtctatagtcccaggtacttgagaggttgaggtgggaggatcgcttaagcacaggagttcaagactgggtgacagactgagaccccgtcaaaaaggacaggaaaggataggacaggagagagaaaaagagagagagtgaaagagagagagcgagagaaacacacacacacgggccatttttgtgcttttgggttgaagaaaggaaacaaagaaaatcactttgctgtccttagttgaccaattgatgtaaaggtacagggtgatgggaggccaccgaatcacacatccagactggtggagaggaactgaagcagaggcttcaggtacacaaacttggaggataatttagaggtttcttgttgtccgactacacagtatggaaacctccatctaacatccacctgaatatctacggtctgacagccactagaatttatcacctcgctacattaacagatagctccaactttaagaaaatcttccttgcagtattctaaaatctgtctttccccatctccacacatcgttcttagtgtgtggaacctccaaaggttcacagaaaatgtgcttctttcactttcaccaactaccttttggattttgaaagcatttgtcagatccttttaactctgttctgcctcacattaggtatcattagctcctttaactaatcagcacaggacatgatttacagaccttttgtgtgcatgggatcctcttcagactaaagtttctaggatgttaaattcctcctgtgcctccagtgtacttctttggtcaaagtctaaatttcttattattgtacctcttagctcagcacacacagtaatacctggctatagcttcttgtttacatctcccattggtactatgatgtaacagatctaggtctaagtttccactaagtctactagaaataacatctccctagaggctaagggtttaggaaaaccccatagtaaatattccctttcaaacctcatccatcctgcttctgacctctgaccagcatgcatttccttcctacacacacagcacatggtttcaatgaaaagataaatgctggtctttcctctgtattaccagggatgcagactgcagatggtcagtatattttaaacactgtctctttgaacttctggtttacattttgctgttccaattaccgaatctactcttgctatttagatatgcccagatttgctaacatgattataattctcccagaaacaaaaagtcaagagaccacaatgttcatagctaagattagaatttatggaaaaagcaatgctccaaagatagtaaaaacttcactacctgtactacatgtcaacatttttacttatttttaaatataattttaaaatctaggaaagggaggaccattaagatgatctagatgaatcactataaagtgactttaaaattccttttcagaatttcttgatttgctatcaattattaaatgcacaacttgttctttacacaaaatacagtctgaagcaactttttgtttttaaaaataacatcagcaagtaccatcttgaaaaaggacattatacccacaatcccatcattctaatattgccactattttcatttttatatttctcttttttcttctctattgtcacacataatttacactgttgtaataaccataaacttcttgtccttcttttttctaattaaatcatgtgattttcatttcagtcactttagtgaaaattataacaattagggacaaagaatttcttcacagaaagcacatttgctaaagcatttttcaactggaattgggggatgagaagtatgttccctccgggtaatcatttcagaattcccagggtaggaagagtgatagcacgggggaataaaattcaaaattagcgtgccattgatttgattttagtcactatatttattttcacatttcatggattatagagggcaccagtatttttttatgtttatcaaaaaagtacatgtgatttacaagaaataaaagagaaagcaggttgaggaacatggagctaaagcaatttactagatgccaagaattctagtttttatagaaacaccagtacttttgtctgattgaagataagtgatcaaacccaagccctttatgatcctgatttttctctatacaacaaataaaattaaataaattggcatgtgaactctatgttcacacagactggaatgacaactgggtacataggtccttgctagactgtatactacacccttcaaattcctcataatcaaaaaccagtattttgtaaagactgttgagccaaatttttttttctaggctgtcccaaatgtttccctttaagaagaatttcagaaagaaatattaaggagagtatcttttatgatatgagactgaaaaaaattgtgtgaggcttgagagatgaattcaccttctgttgaaaacttttttactattcttaacaactccctgttgcacaggtttaatcaatctaggatgaggttacactggcaagcaggaagatggtaaaaccattagtgaatactaacactgctttctgggggcgagcctgttagctgtctggatagggaacagaattaccatcttcaggcaaatttggatttgtaaagtgctctttcattgtactgttacaatttaattctaacattattagaattttaaaaatttgtgggaaaaaacgttagaatatggtctcttaatcaccaaagttttatttcaaactgactttaacattcttcacccaagaaccatcaacctgttcctgttaacctgtttaagctgaattaatggatctctttacacctttgcagtaaatgcaagtcatatgtcatgaacatccatacagcctcatgcctgtgagagaacatcactttggaagagagatgaggattttttttaagtacaagctccccaggtagtgggaatctagagaacccttagttttgaaagaccatcttctgctttaggcccccttgcatttggataccaaagcagctcatatcctctgtttccaattttatgccttggttttgtatctttcatcaaaactcaagattctgcactctttgactcaactacaaagaataacagggaatccacacgctttataactcttgtcacccttttccaagcctgcttggccagcatctccaaagtggatcagtattgcttagctaaggttttcagaagatgggtcaagtctgtccatcatgctaaacaagtccattaaatcaactgccctttaacttcttggtgttatagtaggccttagggaaaaatcttgcaacaatgacatcactatgtcataaatttttttcttctcataggaacagactgagctaataacagttttctgtctgtttgtttttgagacggaatctcgccctgttgcccagactggagtgcttgtggcgcgaggtcagctcactgcaacctccggctcctggggttccagcgattctcccatctcagcctcccaagtagttgggattacaggcacttgccaccacgcccggctaattttttgtattttcagtagagatggggtttcaccatgttggccagactggtcttgaactcctgacttcaagtgatccgccctccttggcctcccaaagtgctgggattacagatgtaataatagttcttacacatattacttcaagatctgtgggcccttttctcagaagagaaactacccagtaaaatgagaagaaaaagtaacacctaaagaatgaaaactcttttttcctggaaatatgctggcttactatctttgtatttgagaagaggtagaaacttgtccctcagtgtcctgaacaagttgagttttattatgtgtcactgtaaggtcccaatttatgccccaagaaaggatcctgagacagccagactaccatcattcaattaagaacagactgacccaatggagcttggttctcatcaagggaataacgcggttctcagtgtgggggtctaggattaaaacagtggaagaaattccatctggggcttggaaacagagtagaatgcctgagtggggcatagtattttatcatgtcttggtgtgtcctaacaggacaaaaagaatctacagaggatctacccaaaaaggatctacccacactcacaactgtatcattttcctggtgagaatgaagctccatttgggtcagtctgttcctaatagaatggtggtggtctggctttcttatgatcctttcttggagcataaattgggatcttacagagaaattagagagaactgaggtagagctgctaagtcttggtggttttttaggagctgggaagaagggacaagaaggaaacaagaataaaatccagattcctgacatggacaactaggcagataagttactagttcaaagcagttgtctattcttcttttaggtttataacttttatcattcatattagttctttatgtaataaacatttgaactctttcatatttttttttctccagactatagtttctcttttcattttgcttctatttttttctctacagtaactttttgagctttttccatttggcgtctaagtttcaaagctcaggaagctgtgctttcaaataattgataaacagttattcaactttctgttagtctttcaatgagttcagttttaacggcaaggaccaaaataggcacttcatagattcctcaatgaatgagtgcacataagcacagttgcggtcttcacagagtttaaaatctggtgagggacaaaggcaaatacacagttaattacgatacaatgtgacacatcttataataggaaaagtatactttttgttcatgtgaagacagaaaccgaaaaggttatgggcctcctggagaaaatggcattcaggagtatggaaataaccacacagaggacatgggaaggagtgatgaggtgtggaaatggcaccactggatgtcttttttttttttttttttttttttttgagacggagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccccactggatgtctaagtgagaaaccaaggtcattattgacagctgcagggtggagcacaaggcacaagtgaaaagacttttccatcccattctttttcttttctttagtcaacatgcattcttgttatgttcaatttggaatccaaggaacttgaatgttataaagttctaaccttatgcaataagtggaagtagtggcagtggtggttctaacagtcagagtagcagtggttttattcatagatttgttaatcaaatttaagagctattttggagtatgacataaattgcatatttaatttttttgtatatattgttaactacaaggaaagctgtaataacttctttatgaggcataaattcatattcaggatcagatccatttatgagttttgtatcctgtcccatttacctaaatttatattttatatagtaacacatggttttaagtgatactcctttaacatgtgctgcattccaattcaaatgacttaaataaatgggggaaacacacaagattcagtaagtcagaagcacaaaatgcttagtatagttgaaaacaatgctggaaatttgttttaagacaaaaagaaaggggaagagatacggctttacacaaccaggaaatcataactgaattccttctacctttaaaccctaaatatttccaattaaaatcaggaaacagagtcacttctggatgaaatggcaacttcagcacaggtatacaaatggtcctgattgaaatgatcaaagaaacagaaaactaaagaaaagctgaatgagtaggtgaaaactagaggagggcaccttgaactgtgagctatttctgttagtcgtggatcagattaaaggaaaatattaagggtcagttcataactctcttcttgagcaagtggcacaacctcaggggataaaaataaataggcagtgtagtgacagcggtctgttagacaacagatcaatgggaaaaaatgaagagcccagaaaaagaccaacacgtgtgggaatgtggaaatgacgaaggggcaacagtggcagacaggcaggcctattcggtaaacagcattgaaacaattagccaatgaaatgtgaaaaatgatataattgcatctgcgtcataccatctagaaaaagaaatttcatgtagatcaaaggcctaaatgtgaaacataaaacctgaaagcacaaatcatatgataccataagactgaagatttgtaagactcactacattattttaaaaacttcaaaacaaaagataccaaacaaatatgggaacaacagacgctgtggactactagagagtggggagggaggttggataaaaaactacctatcaggtactaagcttactaccaaagtgatagaatccatactccaaacctcagcatcatgcaatactctcatgtaacaaatctgcacacatacctcctgtactgaaaataaaagttaaaatttatatatacacacacacacacacaccctgtaaagataaaagctacaaagagatgctttcaatgtcgaaaggggacaaaaaattttaagtatatgtaaacaactagtacagatcaatgaaaaaaggcaacccaataggaatctagacaaagaatataaatagtccaagaaaagacattaaaagaaaagaaagcctcagtcaaaaaacattaaaaaaaaaaagaatctcattgataataaggtaaatgcaaattaaaaccagatactatttcacaccaatacaactggtataagtctgaagaaaccacgtgctggcagttatgtgcagaaaaagtaggtcttatgtactgtagacaagaacaaaaattgttacaactatgagcgagaataagctgcattattcattaaagtatgattagactgcgcaactcaccaatgtgatttctagttgtatatcccagagcagtgttgagaacaggcacaattgtgtaccaacagcacatcacccacagccatacaacccctctctaggtgatttagtgagtgactggtgggagcgtttctgattggggcctactactggcagttagtgagcaggggccagtgctttgcatgtgtgaaaatatcttcccgtacaagaattaccctctttgtacagcttttgaatattctgctggacaaacctgttcataataatctgagtttaaatctaattccattttaataacaaagacttttttgtagtttaatatacaccgaattttcagaaatggaattaccacgtaaatcaaaggaagaatgaacttgttctgaaaacaagctgttcaacattttatcgacagtcactcatggcgtatgagtcatcaataccatatatctgtatcaagcttcatctgtgactgtcacagaaacatggtgactacaaatatctgacttaactcatgtagtcaaactggaacatttatatactaaaatgcatgttattttattgtaaatcacttcacttttatttatcccttacattaaagtattatactgatatttttgaaattatgcaggcaggcagattattttatctttgaatttcattcctgggtagtaaaagtgatgtcagaatatttgttatgaaaagaaggtagagtttgacagggttaagaagtaccccctagaaaaactcatctatgtgcacaaggaaaaaaatgttcaaaagtattcacggtaatgtgtttgtcacagcaaaaaatcgaaagcacccttcaatatccaccaacaggagattgaaaaaataaattataatgaattcatacaatggaatcaacatagaaaaaaaatctgtaaaacataaaacagtacaataatagcatgttacagaaggtcatgaacaatatgatactattatgcaaagtttaaaaattaaaaaaaatatattgctgacacctactgaaattacaaacaagttttaaagcattggaagacaaacttacacagcaagtttcaagaagtggtactgctgaggaatatgggagttattgatgggataagggacttagatagctaacatttcaccaggtataaagaaagttgtacaattaaagaaaaacatgaaaattagttgagtctggatggcaggtacatgaacgttcattatattatctattgtctgaaatactttaaagttttaaaaagtgaatgattgtttcagtcagctcctggtttttatctttttatttctgtaatttgcaaatattctataattaacttgtttgtaaaaaagtatatctttcctctcttaaaatgtgtgtactttaaaattacaactttaaatgcataaataaaatatataagaaaacatatatatgcacagaaaaaaagagctggaggatatattccaaaatgtcaatagtggctacgtctggatagtggggttaaaggtcattttcattttattttttctatatttaaacaaatggtctcaccaaatgtactatttttatgatgataaaacaatctttttttctttttaaaaaatacatttgggccaggcgcggtggctcacacctgtaatcccagcactttgggaggccgaagcaggcggatcacgaggtcaggagatggagaccatcctggctaacatggtgaaaccctgcctctactaaaaatacaaaaaattagccggaggtggtggcggaagcctatagtcccagctacttgggaggctgaagcaggagaatggcgtgaacccgggaggcggagtttgcagtgagccgagttggtgccactgcactccagcctgggtgacagagcgagactcctctcaaaaaaggaaaaaaaaaaccatttatgtcaggggagaaggggagagcacgaacacagttctctctaccacaaagtatgcagtagagcttcccacatttggggaaatcgcaggggtcagcacacctggagtgtactgaataagcctcgccctgggaaaccaactttgtgatcttggtatctcccctaccaagtaagtacctatgatgattaaaaaaaaatgtttaaaaataactagaagttaaaaaaagcctttttgttatttctgtgccttgaatgctcacattgtttgaattaccacagggcaatgaacctgggattatactgtaaatggattacatttgcattaatcaatttagaccctagaaactgaaactgtggtctcacctctggattgccagacttggatttcatggtgcctggtgtccacagagggagtcttggattcctatctgatagggaactggaatgtttcttgaggttaaccaaggttctgagagtgaggagtcttagccttcagtttaagaaggctgtgttgaaccttagtcccactgccaaaccctaatctccagatctactcacaggccaccgtggaattatatgtgggcctgcatcacccgatgccactcctgtgtcctttaccatttgcaatgatcacttttccaaaggttaatattttctacgaagtcaattcaggaattatggaatttggagggtcctgtagaatcttacactctagtacactatgatttccttgagcgcaggctctgaacagttgctgaaagaatatgtcatatgtcttctgtgctttttagatttatttcattaagtgtctagtaatgactaatacttataaacttatgctgtgcaccacaggggagacagagatgaagacagaaatcccacattctattttctcacattttcttattgtaagtgctcctgaagcatttttacagtgcagtcacattattactgagtatttattccaatcccaagcttcaaaagcttgggatttttgagactattgccctacgtctgcatcttgatgtggcacaggtactgactatgacactgatacagcttacttgaagtaacaatattaggcaaaagtaacaatattagaatgttaactaatttttaagcaaatacagatcatttcaagtcaagccagttatcttttccagggcacgcattacttcctggtgagaagcagcacaagaacagaagcagttctgttattgtggactgaaaaaatacaaccttcacattttctttcttacttagtagatcaatgaaataaccagaactacaggttgaatttttggtattaataccattttcaatatgaatggggttttatactacagtagttatgggttttaattttatgttataaaaacacagtattggccgggtgcagtggctcacgcatgtaatcccagcactttgggagtcatgagttaaaagaccagcctggccaacatggcaaaaccccgtctctactaaaaatacaaaaattagccggcaaggtggcaggcacctgtaatcccagctactcggaaggctgaggtgggagaattgcttgaacccaggaggttcaagacctgggcaacagagcaagactacatcttaaaaactgaattttgaagattacttagaaataaagtagaatatgtaattcaatgtaaataggatgatataaaaatagaataataataactaaaatacaaactgtaggaatgctagtattgagattacaagtaatcttttaaaaccaaaaaattataatttttaccaggaaaagttattagacacaagctactataatttttgaattaaagagctgccattattgaagatgtaaactacacaaactgatatttggcaatggtgacactgcagtacagtggggatgtgataatggttctaagtcaaccagatacctgattgaaaaaaataattgacattgactcccacctgacctctgttacaaaaaccaatgtcagacggattgcagatctaaatacaataagtaaaacaaaaaaaagcttatggaataacaacatagaatatcaccatgactttggaataagcagatttcttaaacaagacacaaaaagcgttagtcgtaaaagaaaaaattgaaaaatattagattatattaaaactaagaacttccgtttatcaagagacatcattagatggcagaaagataactcgcaaaggagaaaatatttgcaatacatatacccatccagggacttttatgcagaatatataaagaatgcctataaatcaatacaaaaaaggcagagaatctataagtgggtaaagacttaacaggcatcccacaaatcagtaaacaacaatggtcaatatataaatgaaaaggacctttcacttctctagtcaccagcaaaatctacgtaatatactaccccatacacacaaaaatgactcgaatgaaagcaaaaacaagtatggacaaagatacagagcaactggaactttcagatacccctggtggaagcataaagtggtacattgactaagcttgagcatatgcctactctatgacccaataatttctcttccatcagaaagcagacacattaaccaaaagacatgtataagaatattcaaagtgacaatattcataatagtcaaatactggaaattacttaaatatccaccaacagaagagtggataaataaactggtagtcacacaacacagtaacatgaatgagcaaatcacaaccatgtgccatgacatggatgaacctcataaacagaatgctaaatgaaaaatgcccaatgcaagagcacattctatatataaagcttaaaatcaggtaaatctaatagggtgaaggggtgcggtggcagtaattcgaaaggagcttggcttctgggatgtttgtaaggttctgtttctgggtctgggtactagttacactggcatatgttcagtttatgaaaattcatcaagctgtgcatttaagatttgcatacttttctatgtgcatcttatgcatcaataagtatacttaaaatgttatttgacacaaattacatgggtattttaagtgtttctgagtcttttagagatgctaataactgcaactaataaaaataaaccatttcagaacctttaaaaaagaactggcagcaaaggggagagcacatggttcatctccttgtatcttttttctccacatcctctaatgactaataaaatgtggctttcattgcgaagtctttacactgattctcctggccaggtctgtcctcaaccaaatcacttccttattcaagtgcgtgtaaacagcctcctcctggctgcatacttctgtctaccctctggctcctgacattgtggttcacatgaagtttttggtcttttaaatacccattggaagacgctcaaaaaggctcagaaaactgttccttgattttggtctgcttcattttttgggaaagcaaaacaagtcccagcaccacatgcttctctactgctgcctttatttatttattaaaaaacatccaacacactacccaaagaattttcaagtgtctccttccacttttaccatctaccactgccaaaatctaaccactagcagagtaaaataatctcagctcacatcatgggaaatatttctttggctctgagaaaaccagagagaaagtgctgcaaaatgtaggttaggaaaataatgtgaaagttatttcaagttgatgatttccatagtatggaatgtgatggtcttgcatatgtgactctctgaataaagaccccaaaaatactgtgaggtaagattgtcatttttaattggccccaaatagaagagtcataagggattttcaggggaagcccctttactctatcagggatactcaggtgtcttttctcaataagcattctttagatttatcagcaacaaactaaagaattccactgtaatacaaagctaacatgctgacagagcatctttgaagaagctttcacaagacagactaatgtaaacaattttttcaaggcttcccagcctatgactaccagtgaagtctgattaataataaccaccaaatcacactggctctctgtccacaccagttcatacggggccttatttggaatgtgtctatcaactaatctgggcatcctagtggaaattcctcatgggcccacgagctcacacttgccatagatacatgaacactagggttgtcagggtgcccaaactctgcagtagtttctggagtagtggaaatgctccttccttgtgcttcactctcttagagggaaaaaggcattgtggtgacccaatgtcttacagaggtcagttcttcaggttttactcttgccttccaaaggtctcaatcagcggagcaatagggctgggccaaaaggcaaatcaagtgacaggcagcacatcattcctccctcttgagactaaggcttgactactggattaccctgtcatgcctggtttcttctcccttaggaggaatttcattccaggaggtatcccaatcactttcaagagctcattctaccaattctctggacatgcccctcctctgaaccctagaaaataacacagtctatactgaagctaatccttggtacttaactgtttgcattactattctccataaagaaaatgggcttagcatggtggctcacacctataatcccagaattttgggaggctgaggaaggaggcccaggagttcaagaccagcctgggaaacatagcaagactctgtctcaaaacaaataaaaaataaaaaaataaaaattacccaggcatggtggcacacgcctgtagtcccagctacttaggagactgaggcaggaggattacttgagcccagaagttcgaggttacagtaaactatgatcgtgccaccgcaatctagccagggcaacagagtgagaccctctctctaacaaattaaataaataaaaaaaagaatggctcattggatttggcttaggtagcagaagaggtggcaatacttcctagtatactcaggtaatgagaaaagccttcagggagatatggaagcagtcaggtctccagacccagtacctcatcaggtaaacaaaatcatctctaaaatggtctgttttagttaacatgaatttttttttaaagctttgcaagcaagttttatagtttgcttgtaaaacagcactgtctctgattgattttaaagacagaatgacaaaaaagtaaaccccaacttagattgcacctactttactaatgaggaatctgagggtagcatggggaaaggctcatcccagacaatccctggcagttctggagagagcccagttttcctgacttctagaccacagctttttttcctctgtaccatgtttcctcagtatctcccagataagaaggctatattttctaaggctaagtcataatatatactctcctttccacaatcattgaaatctccttcacagtggccctccctccctccactgaaagaaaagtaaaaatgccaaatgtggctggtagagaaggaaaagggagttggactaactggtggggacaaagaggcaggggtccaccctcacttctatatggctgggtatgcacagaaacggggcggggggcggggacatcaaggtggagagggtgaaacaataattccaaagagaccagtatctaaaccctgaatcatccttacagaagagcaaaagtgctgggcaaataaatactaggtccctggtctacaaatatctccctacaggtaaaactggtttaaaactaacattgactggaactaagtgagggactaagtaccttgacaatctaaatagaatcaggcaaggaaactgtgagagagtactaactctattctatcccagcttccacacctctactgatcacacttaggaagacctcaggtgttgcttcagcacctccagctatgctatcttcttttctctaatctcttaactcttccccgtccccactccccaactcctactcactatggccttactgtctctctactcagatactcaccagaattgctatgcttggcatctagcagatcctccacagatatttgttgaatgagtgaacccaatttgtgttacatattggttaaaatgaagcagtaactgcgattaaactggcaaaaaaaaaaaaacaaaaaaaaaacaaacaaaaaaaaccagccaaccaccaccacaataaaatatagtgattatcactgaaacactgcctcaaacaggaaaaacaatgaccatggcaatagactaattatccattaaaagggactagttttagaaaaacataaaatttattcagccatgagaaatcatatggtcaatctgaatgtgacaacaaattctatgatccagtagcaaaaaaacactaagatatattttgatttttataaaaagtaaagtagaataaaataacattaatcatataagatccttccctctccccttttaacataaaaaggtatacttcttggtatacttggtaagaagatacacatggtatacgggtaatttttctttcttttttttttttaagacaggctggagtacagtggttcaatcatggcttactgcagcccctaccttcccaggctcaggggggccctctcacctcagcctcctcagtagctggcactacaagctcaggctactatcctggttaatttttgtattttttgtaaagaagggatttcaccatgttatccaggctggtctcgaacttctgggctcaagcaatccgtctgcctcggcctcctgaagtgctgggattacaggtgtgagccaccgctcctggcctaaattttttttttaattgaccaattatcaagaatatcagctagattcttaaaaagtctttcataaaaaatatagaatggataaaatggtatcccaagttactttaagctctaaatacctagggtcttatgagtctattagcaaatttccctttcatttatatatggtaccttctgtaactcaatatatggtttttcctaaatataactgactgtgacaaaatgctctccagatgaccaataagattgaagttaatttatatttctgcattttgcatatccaggaaaataatatttaaagcttctgaaaatcatttcaaactttgtgactatacttgacatgggatggacagaaaaatatctgttacctgatatacattcactatcctcagtaacaacagagaaaaacacaaccatgtaaacacagagctctagaagtggaaggagcttgacagtttacttgctttaaaacaacttgcctgcaatgtggaatctctttcataatatccccaagagaagatggtcactcttcatcgggaaagtatggcagcatattttcctgatgaaaagcatgaattctaatttatgtgtgtgcatgtgtgtgtgtgtgtgtgtgtgtatatatatatatgaattcacttattcatcatgaacatctcctgcataacaagttctctggtaggccaatgaacgtgacactgtgcctccatccctcaggctcttcccagttttcctgtgttacattcaaatcacgttccttattataacaccactgcttctagttttactttctggcataacacaagcctttaaattcttgaaagctggctatcacatcttcccaaatacttcttttttcataacctcccgccctctaaaaacttccagttccctccgtgctccatgtacaaaattaatgaagcattgcatttagttcaaaaaatcagctgtggctgggcacggtggctcacgcctgtaatcccagcacttacggaggctgaggcaggcagatcatgaggtcaggagtttgaggccagcctggtcaacatagcaaaaccccatttttactaaaaatacaaaaattagccagctgtggtggcacacacctgcagtcccagctgtcaggaggctgaggcacaagaatcgcttgaacccaggaggcagaggttgtagcgagctgagatcatgccactgcactctccagcctaggcgaaagagcaagattctgtctcaaagaataaacaaacaaccaaccaattgcacaaacagatatatttttaggcagctatttgtgtgggaaaaggtcttcagtttgtgattgacaataggtttggtgtgagctaatagtctgaagtagctgctaactcaatcttaggttttccttcatgaagcacagggacagtttataaagtaacaggttcctttaatggtcacctatatctgaagtattattctgttagaaacgacaggttgggccaaagaggatggcaagatgcctgtaaatcatatcttacaggctgggcgcggtggctcatgcctgtaatcccagcactttgggaggccgaggcgggtggatcacgagatcaggagatcgagaccatcctggctaacacggtgaaaccccatctctactaaaaaatacaaaaaaattagccgggcgtggtggtgggcgcctgtagtcccagctactcgggagtctgaggcaggagaatggcatgaacctgggaggcagagcttgcagtgaaccgagatcgcgccactgtactccagcctgggcgacagagccagactccgtctcaaaaaaaaaaaagaatcatattttacaggtatgaaggacatggagccaaaatgtggtatgaagtcagaacagtcagccagtgaaggcaccagcgtacgaacaatcgtgaggaaaattaggcatccaaccttatgccagcattggagctgctctggtactggggcatttttagagggtctgaggtggaaagacaacaaggaagtctgcaggtgaaaaaggccagcaaggaggaaggggaactgggaggtgacagcccacctgataccgaggtttgctgaggagatggcaaaaccagggatttgtccagagaattttaccacagaagccctctggctatatactcagcggcaaaaagtaccaatgtctcaaatgtagggagaaagaaaagttgataatcatataataattttgtccttaaagtaaactttgtgttcttgagtaactcaaacaaagcattgcatatttcagggtacatctgcttaatcttcaaacacatgagataaaaataaacttggcagcaaagtttgttttttagcaggcagctttctcactccctcctttgggatgttaatctccttattttggggggaaatccttgcctcctccagatctggtttcatgacaccacttaagggcatctttcagaattaataatcactggcccaattgtccttgctctgctgaatatgtcacactactgctccacagacagcaacaggggccagctgagaacaggtttggtgataacttgcaccaccctccctaaatctgatggaaggagctgggagaaatgtaataataaaggttctaaagatggtctagcaaaatgtattctgtagctctgaggcactgaatatttagccattttgaatattatcactggatttacaataggcccttgtgttctctgtttgtgaatagggtcagttggcagctagttaagtttcttagggagttattgaagccagcattaaaataaaaccaagcacaggattccctaaaaactgcaaagcactgggaagtctgcctagaacaatatcaggtcatcttacaagtccaagagcagaatacttgagcagtatgtattagtaatagagggctcacctttcaacagtggctagaactggtcatgccttcatgcctgtgtccatggttttggtttactttctacggggcttcagaactctgggacctcagaggtgggtaaagatgtgaatcaggctagatagtggctaagaaaagtgacctagtcttactagctgtcactataatcagtggttaataattatttttagccaaaatatttcatcatctttgcatctgttagaaaagtcattataaatgtctatctttgaaaggtccaactgctatattactgtgcaaaagatctgtagttgagatacacaagattctggacagtaaacaatagtcctggtacccacaggaaaactgcagaagcatgaggtaagtaataaagcaagttcaaaccatgaccggtagcacacatttacagcaacctcagagagtgatttagaagcattaattacctccaggaaaggtattataacaatggaaaagacaaaatcctgcaatcaggttgacctgtgaaccataagctcagttgcctggtggaagtaagcattaattaccacagtgagtcctctccctgaggagaaggaacctgttccttctactaccgcataagtcacatttcacattaaagcagcacccacctgtaccttcccagcaggaccaaccacaaaagtaaactaaaagcatagtctaaaatgagatgaagagcaaactgcccaagttagcatagatatttgccctactaaatggttttctctggcctttcatgttcatgttattttgggaattttccccccacatttggaaaagaagtggaagctaagtaaactgtaaggaagaagatgaaacttccaactcccaaattcctcacaatttgacagataagggattattggatgaaatagagtgaaacaatctactatatggtgaaaacatgtgcaatcataaaaacaaagaaatgtagagtttcattatttgaggatttagagacaagaacaacttagagtagtgtgaatagtaagtccattgtttagctaataaataggagaccttcatttccccagactgtgctaacatgaagcaaatgttttagtgaaggaaaaggaaagaaatctatttttatatcccctgctacaatggattttgtctgttagagacaaagttaagttttgactatttacaaatgaactcacacatacatattaccccaactcagaagacatacaaatccttaggaatgtttcatgtgtggctgtgtgtgtgtgtgtgtgtgtgtgtgtgtgtgtgtgtgtgtgtgtgcgttcctcaattcacggagtgaaaacactgggtcacctactttcaaaactaacaaattaaagttaaaattgtatctctactccataccataaaccaagataaaaatctagatggattaaaaagtgacacatatgtgtgactattaaataaaattaaaatgcatatcttcataaatgaaaaagtaaaaaagaaaaaagccaaaaacccaaaaacaaaaaatccaacttgtaaatactttaaagacattcagaaaaaaattttaaaaaattagaacttttcccataaatttttacttttatggcaaaaaatcaaataaacaaagttaaaaagcaagtcaaaaatggaagagaattatcagaacacagatgaatagcttcctataaaaagcttttaccaataaatcagaaaatgaataccacaatttaaaaacacagccaaagaatacagacaattaaaaaaaatacaagtggccaacttacatataaggtagtgttcaacctctttaatagtaaaagcaaatttaaactaaaactcgatacctttagttactgacatattcaggactctactgttgaaacagttttgtaacattttttccctagaaaatcaaggggcgtatttgcatatggaaattaattagccttgaaaagtatacagtattttcttaaaatttaaaatctctatgtttattacttcattcccactcattcctaacttgcttgttttcccctttcctcagtgagacatttaactattgtactcatctttttaaatacatctgctatttacttatcaattctagggaattttgttgtataaaatttaatttttgcttttttctttactagtatcttctttttttttgtaaggggggacttgtcattctttctctgattacctcagtggaatgaatagttgcttgtttttttcttaccaaataataaaagcaaaggctagctttttatactcagagttttggaatcacatctaaaggctttgatatgttgaattctgacttttgtcagtgtttaaatccatataggcacgctcctttccatctttaattaatatctataatatgcaaggggtaaggtcaaaaagcaataagggggaaaggccattaacataacacaaaaatcttctagcctaaagtactatattgtctggctctttagtaaagcccaacctaaaaagcacatctcttaaccatagaaaacggcaaaagaatggatgctctggcagttaaacactctctcacaaactgaatcatttccaaataccaggtgttccagtttcactgtgttttgatattgtcagaaaggctagccacttttttttgctccatttaagcattcattgcctttatttttaacataattaactcgattataaatttatgtgatttaatctttaataatggccaagtttaacaactggttaacaaatttcctgaaaatttagcaatctgctcttatgagccgacagttttccttttccatttccagacctgagtgttctattccacccttttggaggttctagtcccacatgactcagtgttggtcttgttcctgtatctgtttctagtctagaaccttcacagtacttgagtcctctttgatgatcgaggcttgttttgctctaaattgcaggtcccctggaactgacatctcagcgcctcaataattcaggcgcttcttaggtagccttttgagcactccctcactggaacctcagcctgtagtgattttagactaatttctagaggtatgttgtttgtcatttccttgaactctgagtagacattaccatgccctttggatattttgttataccttcttacagaagctatttttatccattttaaagagtaattgaaaaaatgttctttattatacatcatcttacaaaggaagtttgcaggggatgataagcactagtgctactgtagtgctttcctacagaggcggcacttgtcaatgagcaaagaggccaacattgtgacatatgcctggagcttcagtttcacttctttctaatagcgaaaacaaatattgtaaaataggcgtaatttatccttaagctgtttggttaaagtgaaatgcaaatgttttaaaccaaaggattgctctactctgtaactgcaaatttaatttctactttgctctaagagtgacttaggagattgtattttaatatctagctgattagaattattttgaacaattttttattattaactttgagttttagtttattttggtcagaaaataatagcttgtgcacattatattttggagattttattaaaacttttcttgtgacctagtaaattcaatttttaaatttaatttctacttagagtacaaaattttatatctacctattaaacgaagcttattgtttgtattatttaaatattctatttccatatttatcctctacctaatttacatgtcaaattctggaaggcatgtccaagtcttctaatacaatttctattctgtaaattctaatttttattttaatgttttgctttatatgcacagtatctaaaatgtctagaggagggaatatttgttaaatttttatattttactcttttttacctacttaatctactttgacttaatctcagtcatattattctatcattattctttggagcaatatacactgagattttgtcctatatttcacggtaataactataacagtgaaaaaaacagccctgtgtttccagacttttaggatactctgtatttcagtgctaccttacttgggacataaagacttatgaccattataattttagttccaattgaatttttctttaataaaatataactctttgtcctgttgaatgcttttcctcttgaaatttcctctacctaacactaaatttgtatctttatctttacaaaattgtttactttaaacaattgttgtctttatcttttattttcaaactttgaactgctttatttcacatggttcctgcaaacagcatgattctcttgagttttttggagtgcccaatataagcgtcattgtcttttaattaagttgttaagttccttcacatttactgtggtaatatatttggtcttgggtctagcctacttccattttcttatcttttttcctcttagtttttttgttatgttttgttttaccaaatgaagttttcttcattcctttctagaaatcttcacttaattggaaattacatatcttatttctctctctgactagtgagtgccttaaagaaaatctaaatctatctgtctctacctgtatcaagaacaatgttataaccgttgcttcctcgtggggaaaagttaaaaattcaatgtgttttaagttaacttttcttttaccttacaaccctactctatctactttccaggtcttgttaaaacaaagattctacattcagattttttaaaacaatgtgcctcttccctttcaacaattatttttaaaaagacctaagcttgagaaactatataaacacttagttggcttaacctgttcacattaatagttttgttgttctctattctttcctctatgttgtttcacattataattcatttcttggttagctgcagtactattttaagcagttctttgttaaaaggaaaggtatatcaatggtaaagtttgtgagattttgcaatgttagagaatgtgtttatgcttttttttttttttttgctcatgcatccaatcattctacaaatacagtcatgcatcgcttaacaacaggaacacattctgagaaatgcaaccttaagcaatttaatcactctgtgaacacagagtatacttacacacaaatttagatggtacagcctactacacacctaggccaatatggtgtgtaatgctcctagactacaaacctatacgccgtgttactgtaccgagtactatacacaattttaagacaatggtaagtatttctgtatctaaacacagaaaagtttcagtaaaaatagggtatgataatcttatgggaccaccatcatatacgtaatccttcactgaatgaaacactgttatgcaatgcatgactgtatttactgagcaagtatcatatgctaaatgtttttctagatacaagaggtacagtagggaacagcagataaaaatccctacccatatggagcttacattctaagagtctagaagattagacaattcatgaatcacatgttttttcctctcaaattctgcagccaagaagagatgcttgatgttgacttcattttcttttctttaactattattttttaaactgggcatcctgcttcaaaccatctggatgttctagaatattttctttagtcttcaaattcatatttttctctggattatttcaaggtctaggttaagggtcttctttctcccaatgtctcccctgtactccaactatgcctgttagtaagggtgttctttcaatgagagcccaagtccttaaaaattctctcttattattcttcccagtataaacacacacacacacatatacattagtatatacatttatttatattgaattatctgtatctatttttcatgtttccagtcttttcacttaaaattttcactgggctgagcacagtggctcacgcctgtaatcccagcactttggtaggctgaggtgggcagatcacctgtggtcaggagtttgagaccagcctggccaacatggtgaaaccccgtctctactaaaaatacaaacattaggcggagggggatggtgcgtgcctgtagtcccagctacttgggaggctgaggtaggagaaccacttgaacccgggaggcggaggttgcagtgagccaagatcacgcactccagcctgggcaacagagtgagactctgtcttaaaaaaaaaaaaaaaaaaattcatgttactttcctttgagttctatcagaatttctttagctttcttctcactcgctaattcaggtttcttcagtattgaatctgttcctcactgcgttgttttaaaattctgtaaccatgtttttaatttccactaactttttctgttctcagttcatttgtttttcttatctgctctgattttaatcaatgcaatgccctcttaattttactttgagtaataactcatttttctcagttttctcctattttgtacaagaagtctgtttcagacagaaatatcacttttgtcggtcaaattggtctttacttttgaatgctacatctttctatatatccatggattcttctatgttcattccaagagagggaagtatccatgtttgttttgtgagtcataaagagttgtgccagatagtgtgtaagtgttcaaatcggtggtctccataaaaaaaggaggatagattttagttttattataaatttatttgccatgttagtgatccaataatttgtataaaatagtaagtggctggcaagtagaatcacaataagggattttacttttgttccaaatatatattccaggtcttgagtaaactaagtgataatactgattaataggagcatctattatacatgtgttatgtatgtgtattatccatagatatataatacatgtatatctggatttattatatgtgtatatatacagatacatacgtatgtatgcaaattaactttaatatctacaaaacacttaaaaatggatattagatcacaagtacagcctcaacaatgccaccaaaatatatatactgtgcaggtattattttattctccaactttccttgatttttgtttttccatcttattggtatccctactgtaataaaaaaaaaaggggggggagtttattttgtcaagtaattgcttaaaattcctttccatctcctcagatatttaaagaaaactcacagttttctttgtcccatcttttctccttggctacttccctacttttccctacaaatactatgcattattcacattgcagtaagttacacccattcactgtaaaaaagaacaatacaacacaccctgaaatctttggggctactaatttctaaaaaggttacttcaagcgtaaagttttcttttataaaaaagaaagtttaaagtttcatcactcaaatgtagcctatctaaaacacctggaaatgatttcaaagtttcaaagtcactattctgataggtattacttccaacctaaccattactggcctttgaaatatagaagctaaaagcagactgcacggatcaaatactatagataaaagcattttgaaaagcatacggtactatgaaaacataaggtggtagtattaaaaatggatttcgacatgaaatcccaaactcattcatttcagtgattccttagtgcttggatgagggcaagcactcatccagtgagtgctttcatccagatccagttcagcatcttactgggatcatttcaggccagtcagctttaatcaaattacactctatccatacatgattagaaacaaactgaggttttggtcaagtgccacagtttttcactcagggccatcatgctcactttcttggaagacacttggaaattatgtgatcaaatctgaaagtaacttttcaagaggtgtgtgtggtctttctgacaaagaagagctttatatttgcgactgagttaaaatctctggctgtaactaattagcgataaaataacaacaatgaacatggaatacaagctagaagaaatcttagactctaaaacacatgttaacagagtgaaatttataatatctgctattatatctcgtctatcaaatatagccaagaatatggaagaaaaaaattgttaaagataacacctagtaggaatttttaaaaaacatctgctgagacaaagaaggctgggcatattgtatgtaaaagtaaaattacaggccaggcacggtggctcatgcctgtaatcccagcactttggaggccgaggtgggcagatcatttgaggtcaggagttcaagacaagcctggccaacatggcaaaacctcatctctactaaaaatacaaaaattagccagatgtggtgatgggtgcttgtaatcccagctactcgggaggctgaggcaagagaattgcttgaacccgggaggcagaggttgcagtgagccgagatcgccccacttgcactccagcctgggtgacaagagtgaaattccgtctcaaaaaaaaaaaaaaaagagtaaaaatacagtaagtaaaatgaggtgttttgaaaacgtatggaacctaccgaaataattaaaatataagcagagggagcagatttagcagtgacaaaaattagaattattcatggataaccaattcttagtaatcatgcagtcatagctcactgctttatgcttaaccaagagctttaataaacattacattatttgggtttcacaacaccatgaggtggaaagcccttgtgaacttataaagagaatagcaacagtaatgaatttgaaatacaacaaaagagaatctgagaaattgcccagggacagagattatacacactcatagcacagtggctcttgacaccacgtaagcaagagctcaatacatatctgttgaactgcaccaaactgataatacattcaataccacttttattaaaaaaagaaagaaagaaagaaagaaagaggtaggaaaaaaagtacaaaagcacctgtgagaggggagcactacaggaaaaactatggaaggctataaggtgatttgtgatcaacggttatgtcagagaagtggtggcaaagatgaggagactgttattttgacacttctttattgtctggattttcacaataagcatatataacttttgaaattcaaatgagtgaaaccaaaataaaaatgtgccagctaaatttgttaacaaagaataggtattgcttttaaaacaaaaaaattcaaattttgtattttttaaaaatgaaagctaaaacaccctaggattttgctatagtttgtgactactggatcctgaaaatggaacagttaacttaatgatcaaatatacttgacagagatcttggtggagaaagaaatttagattccattaatacatattgagcaccaccatcagatattagacactgtattaagcagctatgcagtaacttaggacttagaaagtacctcaactcaattcatgcacatccttccttatctataaccaattatatccccttccagctttatagataagcaacccctatactttgaacacaaagtcaaagataactattttctagttatcaaaggcttctattcatgagagtccatggcattattacatttaagaacagttaacttgtctttattttgcctaagcttggaggcacttagctagagtaaaatttggcaaaacaaaaagatgactcattttgtcaggcactgtaaactgcctatcagaggacaaggtgtattttgcaacttaaattctgaaaaaggtcattcttccctcctctggctcgtaagtgattgactgttagggactacacctagctttctattatatgtctcctttaaattaagaggacaaatctattatttggaaatacacatggctcaatcaattgaatgtgcttacaaaaatcttcaacctctttcaagaactctttacatgccgtgcaaactattgttgcatttgggctctcccacccaactcgccgccttcactctcctcattctggaaaacagtgctgtcgctaacacggtgagcagccacagtggctgaaccaggctactctctgtctgtctttgcttggcactggaaaattcctttgtctttatacttagcagtagtgtaatcttagagaaagaactttaattgaagaagactttactgaagactcacttgggagtccctaggtgagtttaaaacagatcattgaaatcttttccacagctgggtttggtcagtagtgccattgggcggactggatcttcagcccaagcacaatcccagttcctttatcgggaggtatctataccattctagactagaccaaatttcgctcttcattttgataaaaccaaactgcttcctaagattcattccataaatatttcttgagtattttgtgcaaagcagattactaaatactgccagagacacaaaaatgaatccggcgccattctcaaagaacttgtaatgtctaagtcttaaattgctaggacacaaaggagaacatttcagtactgacttacatttaaagaatgatctgaaaaacacaaaaagcagctactaatagaaataaaataggatataccttccaaaacatgagaatttaaaaatgcagaaaagtatagtcaaaaatgcacttacagaattattaaaatcaaagcataaaataatcaaggacagaatatatcagtgataataagggtgaccacatagaacttatcatccgagctacgattttaaacggtgaaaggcgacactattaataacttctccaagatgacaggcataaacaggatgtcctcagcaacccacgttgtaaggcctccctagttatgaaaataaatagcttgctttactcaaaaagatagatgaagttagtgggttcaaatgctcagcttctctacttttccacaaaatctagtagtcaatgttttcggaatcttgtaatcaatgaggcaaagaaaacaaaataggatacacagaaagattctatgatgaatacaaagaacaaaactatggatctgctatattttaaaataaacttaaacttggtaatgacttgtgaccttgggaaataatgtatttttatatcacgtagcgttcaatatcaatacattcaaattattgttataattttactaataaactgtcactttctacctgtttgggcttttcttaaagacaattttatattttagcataggtttaatgaacttggtttcggttataaacttgtctaacctcataaggggaaatttttcaaatgtattatccaaaaaactctggatgtatctgaattatgtagaaatcagactttaatgagccaaactcaaatccagaaaacactcaaagttactctgaggagtgaagatatttagaaagacctaagtaagactaatgttctgttacccacaaactcttagagctgtgttttcaggctgtaaaccgtgctagtgtatctcatgtctgggcagattaatatatctactaatgaaaaacacacacccaacctcgttgcctactctaaactgatgtaggcccttgggagaaattaattcttggggaacacagtgaacatgagaatcaacgaagatgtacacaagctggtggccacatcctagaaactcaagtttcctaataagctggacctccagtctctctttgtgatttgctgtccctcaagtttcccatatgtaacctagaagctaaacgccaacaaactaatgagtaactgtaagaatatctcctagaacttccacagactccattttcctcctgctcaaacttctattccatttctgtgctcagaagcagcacctgggaggggagcacacagtcattcatttattcattcccacccacacttgaacatgcatcctagtaaagtgcacccaggctcaacatcagagatatgcctaaagaatgaggacccttgccccaggagctccgagacactaactgaaaacacaaacaatgtaaaggaatcaatgttctaagggagatctattaaaagaagtacaggaactcaaagaaaggaaagagccagatgtatctgtctgacgcagttggggaaggcttccaagaggcggtgacatttagctggcaatgaagggagaaagaacacttgaggagaagagacagcgtgtaccgagacacagaggcatgaaaatcgtggtatattcaggagtgctgagaactgaagcatagggaggtcagaagaagcagacagtgaagggtctctttccaaactgagcagaactgacgaatcctcactgtcagcttctctcttccttttgaggagcccagctatttctctgcctgtcctttccagtggttttgccccttacaaagggaaagacccgggttctagatcaactctcaaactatcagctgcccaagcttggaggagacccagcctctctgtgagtctcagattatttataggagaaagggcctacagaacctatgaaactcaagggttctatatgcagagtatcaaaaatcattagagcatattttcatttttaataatcatagtaagtgagaagaatcagtaacagtgtttcaaataatctcagctatacaactacacagaaaataaaattatagctaataagcaatggctgggatagtgtaatttgctgagcaagtcaaaatcctttcagttttttaatatgcaaaatgaagagaaatttaccactaaagtttgtttcaaggcttaagtaagaaaacaaacaaaactgactcagtgaacacctggcatgcagttggtactaaataaacgttggttaaatctaatttgatatatctttcaagtgcattaataattgtggcttcggccgggagcggtggctctcgcctgtaatcccagcactttgggaggccaaggcgggcggatcacgaggtcaggagttcgagaccagcctggccaacatagtgaaaccctgtctctactaaaaatacaaaaattagccgggcatggtggtgggtgcctataatcccagctactcagaaggctgaggcaggagaatcgtttcaacccaggagtcagagattgcagtgagccgagattgcaccattgcactccagcttgggcgacagagcaaaactccaacttaaaaaaaaaaaaaaaaaattgtggcatcattgttagtatcagttaacaaaatatatgcaaatatagtgaaactgattatgtaaactgtttagaaagtgaaaatttactattgtcattttagaaaattgaaggcttgtggttttgaagaaaaacaactattatacaataaatctactaattgctcattttgtttagagctaaaaaaaatgttcctctttcctttccacccctattcccaggggacagaaaatttacctttgatttccaagcatatctgatttcttccagtcattatagagtcaaataataaaacaaattcagatacaacagtgaaggaataacaacttttacttcaattctacacttgaatcaatagactcaaatccttagaaatatgatcatcaatgcaattatgtgctgaactgctaaattaacagtcatctgggaaacataaaacaaaactagtgacaatgtgcttctaattgcatgggggttcaggatattagtgatattttatattctgcttcattgctcactaaacagcatatattttcataataatgcttttttccaactagaaacaaccaaaggtgtcataactcaatttccaagatgaagagaaaacaaaaatagagaaaatatatacagttgaaacaatgcctttagtagttggaagaggggtaggaggggcaagagaatgaaaaaaagggccaaaataaatttaaatgcctgctttgaagtcattcttcaggttgaaacagcaggctaaatcaatttcaactcctctatattaatgattcagtcatctctaagcctccagtaataaaaagtgcctgcctgcctgcctacctgctgcctgccctgcctgccaacctgcctgcctgccatgtgtaagactctgggctaggcagggggatatagtctataacctacaatgagaagtcctgggttgtgttaacgaaactgtagcacagtaaagcacaaaatctactgagcattcatatgccgttaaccctaaggccctttataaacagttacaggctacacgttttacacatgggcactggtgtggacagagcacaggctcatgcatgcgctgacattgaaattgcactctgtttctctgtgatttgatgaaaatctgtgggaaaggctgcccccttgtgttcatctcagtgcagttgtgaccctgctagagctggaacattgcagatgccttttaccatcatcccatgatggcttcagagaggggacttcggcctgctcagtctctacccaaaatcaaggccagtgtaaacgagaaagtgccaatgcttctgagctcgttcaagtccaagaaagccattctggacctctcccgaggcacagccaagtgagctagtcctcatggatccaatcaggataactattttgttttgtttaaaaaacaaaaaactcctgcttatgagaagagatctttggaaggatggaattcctctatgtcaaatggcctctggacctctggctgtctgaatgtcacttaaagcaacccacagatagagaagagggcacagagggtactgaaaacagcaacgtaactaagaaatacaggaaaacccaagacatggacagtggaaaaggtgaggaagggtcctggaaaaccaaccaggagagaaaggaaggccatagagattcatctacctcaacttccttctatgcagatgcagtttcaggtctggaaattcccacaaagtggccaacttgccagaggtcccactggtaaaatccagtgctgtttctccaaccagaggatgccttatttactagtttgcgatcaaaactgtgaagcacctacaaataatttggaagactaagcacccagtatgagaaacctaacctagtgatcaatatagaaccaaacatatagtaagcacaaaataaatgtgagtaaatgattaggatataaaattaagccaataaagatttcacttttcagaggaaaaaatagttcactgcattaaaaaaaaacaaaacctgctttttttctttttaaaaatctttggatcctgagaaaggaaggcttatgaaagacaccttatattccttcctccctctctcacatccttccacctccaaatcccaagtccaaaaacagataaaattagggagaggctatgtcaatgcaggaaaaggtcttatccaaaagccaaaaactttgaaaaatggaactagattaaaggccacccaggtatattagaattaacttatgacactaagatagcagttggttgctccagaagttgagaaagagagagagagaaagagagagagatcctgggcttcacaaatatccgagagtaagaaggccaagggcataagtctttgtctcagggaagaccctcaggcaaaagtagttctggctgctgccttctggctcaattggagacagctaggactgcggcccgcaaaataagaccttgtatgaaaatggaaaaggctactccctcaaaagaaactagtgctgggataattttaactgtttcaaatcatttatttggtaataataaagaaaccagaacaacataatgctgggtttaagctgcagtcccagctttagctccctagtgaacttatttaaattcacacacatgaatttatttcttactatgtatgcatgtattatgcatagatagaagtctggaagaatacaccgataacacctgtaggaatcagccctaggaaggcaacttgcttagctttttctatataattacctttacagtaaaagagtggtcataatttacttctgtaaataagatgtcttaacatagacatttaatgtatcgcaggagataaaatcatttcaagtttatatagaataaatgtttaaaaatagcccccaattattaaagctaaaagtgacagaaccagattcaaaaatgaattattgataccctcaaaatcaaacaatacaggcttgcaaatacagcagaatagaaaacagcatccagaaacaaactacagttgtatgggaaacgtggtagtgaaacagcggggaaggaagcaggggcaggggcaagtttatttgatatactgtgctggcacaacacctatgcatcgggaaaaaaacaaacctgaatacccaagcttatgcattacctgggtcatgccctagaaaggcttagccaggcacatgagagttatagaacgtaaaacattcaaagaaaaacacaaggaagagtacaaatgccaaaataaatggtagaaaataagagaatttttttaaaaaagagggaaagcagtagtggagcttaagtctatacagcacacctatgagaatactatacaaaataacaactttaggcagaggcaattgagtcttgccttcccttggcagcaaccttagctcaggagactggaaaccggctccaagcagcttctggggggtaatcttggctttacaaaagcctgggacaatgttctcccctcctgttgactggaccatggcacagagaaaagaacagaaagatactcagaatatttctgcttctcttaacatcaaatggcctcacctttttcagtccaggacatacctgggagcctcccagaacacagtgagggcaggaagaaccagttagtttcagtgtactatctgagctaaacaaaaaatccccagtgataacatcatcttggctctgggagttgaataatccgaacacattaaaacatcactactctgatattctttaataagaaatgttcagaccaagaaagtattttgctttcacctaaaattccagtagatttatactgaaaagccaatgtattcacttctaaagaaatatttctatactttctatctcccttatgtacttgagaattttttttttaagacagtgttccactctgtcacccaggccagggtgcagtggcacgatcacagctcactgtagctccaacctcttgggctcaagcaatcttccacctgggtagctgagactacatgcaagtgccaccatgcctgtttttttatttttctattgtttgtagaaacggggtcccactatgttgccaaggctgcctgagaatattttaaactttgaagaaaataaatgatgaacactaaatagcttctggctgctcatgtattccctcgcctaagcgtattaagtgattaattgattcatgcattcaaccaatatacattgaacactcaagagatcttcaccaggaataattaagtgtgaagatttgggaggcccagtccttagggaatttgcagttagtcctctctaaatcagcaggtctgggtgttaggaaggtaaaagctctgtgctcatctacaaaggagagggggactttcttccctaagcaaagataactaactctcctcactctatgtataaaaccagaaaaaggccaagtgttttttaaaagaccataatatattgtgttccagggaagaatctacgtgcttgcaacccctactgctcttaacataattctggaggttcagttgaggattttccttgtaaacgatatcttaaaagaataaatatatccttttattttaataaaacaaattatactgcaattgtgtgggctgctttgtatttgtgaaccattattttgtcagaatatcattttagaagaacatatgcccatttttatagttaataacttcttgcaaaaaaaaaaaaaaaaaaaaagaactcaaactttcactctgaatctaccccacacagctaatggctttgttgaacaggcatatggcttgtcagagaagaatctgggacaatatggttactactgtttccttctccactttgtctgtaagcttgtattaatacatatgcctcccagtagaaaactctctccctcctcctactttaagccacaggttctgcatcagccactcctccttctccaaaatgtctacttgcggagtcacactccaacccgaatctggagtggggctccaacatcaatgttgacaattcaggagttttaaggattcactccttttgccttggttctcagaaaaactaattccctctatcacctctgctatttcaaacttcctcttaaaagctatcaaaaagttttgaatctttgcaacactgaataagaatggagagggaaagtcagagtttcagcaacagacagtgaatctgatttcttttctacatatattgctggacgacgtctttcagatcaacttcactagaacaaaagagtacttttcccccagaaaagtactcttttcctattttttttagtagcctacttaaattctttggattaaaaaaaattgcatttaaataaatgacattttttaaaaggggaaagcattctttaatcttcataattaagtgcttcacttatcattttctttctttatgtgtgactttggaggtctatttgttaattataatatttcccaaggaaatcagtgataacaattatgttgcttaattgacattttgctttttgatatttttttgaaatgaaataatgtgcatcatcccacaggatcttcggagctgccttccatgatcctcagctcacaaataagaaaccaaggatcggtgaggcagaagagaggatcagagaggttgaagagaagatcagagaggcctgttgcccagggctacaaggcttaaaagttagctgaactagaattttaacccaaaatattctatttccaaattaaacactttttacctctctactcaattatatgggataaattctacaagacaccaccagcaaactcaaggaaagatattaatagtgttccctaatttttttttttttttgagacggagtcttgctctgtcgtccaggctgaagtacaatggtgcgatctcagttcactgtaacctccgcctcccggtttcaagtgattctcccgcctcagcctcccgagtagctggggttacaggcatgttccaccacacctggctaatttttgcatttttagtagaaatgaggtttcaccatgttggccaggctggtctcttaactcctgaccttgtgatccacccacctcagtctcccataatgctgggattacaggcgtgacccaccacgcccagactgttccctaactttttgaagaaaaaactcgttaatatttaagatataaaaacaggtaaaagaaaactaaaacagacaatataggtccactactcatcttaagaaacagaccttaactaatacttgtgtatttctcctcagtcatgtcctctctcaagacaaccattaacttgtacttactgtttatttctctgtgcatttatttattttttattgcatatatatctgttcttaaacaatatatggcatgtacatgttttgttttttgggtttttttgagacggagtctcgctctgtcgcccaagctggagtgcagtggcgtgtggcgcaatcttggctcactgcaacctctgccttccgggttcaagcaattctctgcctcagcctccggagtaggtgggattataggtgcccaccaccacgcccggcaaatttttgtatttttagtagagacagggtttcatcatgttggccaggctggtcttgaactcccaacctcgtgatccactcactcccccttggcctcccaaagtgttgggattacaggcgtgagccaccgcgcctggccacatgtttttaacctttatataagtggtctgcaacttgcttgtttttaaaattaattctatttgtgagactgactgaagttgatacatataatgtacttcattcatcttcacgaatgtataatattccattgtgcaccataatctacttatctattcttctgccaatggatatttagggtgtgtccctttttctgctttcataaacagtgctactataaatatccttgtacttgtctctttaagagtgtacttaaagctcctctaagatacacacctagaagtgggattgctacatcctgttgtcaagtattttttcaagtggttgtatcaatttacaacaacagtttacaaatgtttgaactgctccatatctgtaacacagaacactgtcagattttaacatttttgtcattttaatggttatgaaaggacatttcaccgagattttaaaatgcatttccttgattacttcacatctaatgtctgccacatgtcatgtttcaggtcatactagaaacatgtttctctatccagtatcacctttctcctaatcatatactttacattttctggaaagaccgaaagacctgccaagtctttataataactgccactactcaaaattcatacttactgttataactgaaaatcacctttcccccaagctatcttcatagtctttaaaaaatacctttccttttggaaatcaaaaaaaaaaaatctacttaaccaatttacccctgtcttacaacttgcactccaatcagactatatcaatttatgggcgtaagagagtatatttccaccttcttcaaagcccttttgacaatcacttgcttttctgttggaaaaaatcaaatctgaacttatcaaccaaaagactattgtgtgaaccatcaaggatatcttcctaacctgcatgaaaccatataaatgtcaaattatttctccattctgtcatgtgccaaaaatactaagaatagaggtcaaatgtctcactatctgttccttgagcatgacctttgcttggctcattaccgcccacctactctttcctccttcctatatctgacatttgacctgctagtgtcttattagtttagctaaattccaggctctggcctctctggcctgcccagtgttggcatgacaactatgctgataaatactcaactcacgaagtatgtttccagcatatctttggaagagaatatgatctgcagtctattcattattatgtgcaagttctaaatacaattgttcactttttcaactactgtacctgaaataggattagtagggccaaaaccacagatggaaatgaagaaaactgcaacaagcctatcagctgagtttgcaggaggtggctctatggcaggggagactgtcccctctttcccaacaggaagcaagaggacctaatgcttgagagaagatggtctcacgagcatttcctccaagcttgtaactagggaagccccaaatcatgaatagcctatagtccctctggcactttactcaagacagtcttatatttcaatgtctatgcaatgctcactggactacccatctccacttcttcccagaacctcattaccgtccaatttagtcaaggtataatctaatgatttgctagcaaatgctcgttgtggcttttccatgcatctaccagttttcagaatcttattctgtccaaaaccttccttcttaacagatggctatgttttctacattgttgagttggaagagactataaaccttgtattattgaccatttaagtttttcattgcatcttttatctttcctcttttcctacctattttccactgatacaacaagtataatcaaactccagtaaatacacacacacacacacacacaaacacactcctttgactcaactattccttcaaactgttaacccattttgctcctttctttaactgacaaatttcaacaaaaactgttccaattatctctcatttcatcttccctaattatctggcctctacattgttaaatgtcatttaagagtaaaagaggaatatactctttgaagatggaggggaagagaattcccatcaaataatcctttgttcttatacaatatctatggcagcaatgggcttattagtagataaacagttattagattatgaagctgtattaatctatgtgttcaaaagaacttatatagtcattgccagttacttcagacagtgaaaatgagaattaacagacacatcttaagttgtaaaataagcattttatcaacctgtatgctaacaatctgatctgggtgatagacaaggggactcccaccttcccataacctgctcagcagcttcaagagctaaagaaatcagtggcttgtcacatctgtaaaaggcaactgtaatccactagtcgcaaagcattgaattagagtacacataaaaatatgataaagagaatatagcatatcaaataaaagaaattcattccaaattatactaagattcagaccataaatgatttcctttgagaaaaaaacaaaccaaatctcaattagaaaattaaaatataaagtcatctatgataagcaggaaccaagacttaaagatgatacataatatattagaagaattgtagtatataaagaatgggttatttaagggcagaaggaaagatacaatgtaacaagtcatcaataagacatcaagagaaaaggaaaaaaactcaagtaatatggaaacatattaaataactacagatacagaagtaaatatcccatcttaataaatattattatgggatcaaggaaagttacttaatctttgtgtcaattttcccatctgtgaaatgtatgtatctcatttggcagggaataaagaagataatcacttccgaatatttagtataatttctagcacatagtaagctctaactgatgttaattattgtcatgaatataatcagtattaacactggtctccattacaaataaactggatagtcaatctgattacctatgagcataaagtaccaaaactgacataagaaacagtaaaaagaacctgaaagggacaataacaattaacaactaaccaaatatagctgacttcatgggtgctaatatccaaaattttagggaccagaaaattgctatgccatttaaacagactagagaacaataaaaaccatcccctaatttgtgatttgtttcatgcacctaatataatgctgatatcaaaactccacaaatacaaatatacacaaaaaactacagaccaaacttacaaatataaacgttttactaaactactgacaaactgagttcactgctcaataatatacttgaaatacactcacctaatactgtattccagaaataaaaactggcttaatattaggaaatgtgttaatatgattcatggcataagaggatccaaaataaaaccctcgtatgtgtcacctgaaagatgtagaaaagaccatttgataaatctcattatctacccacattttaaaaattaacctagtaaacagaaaaaggaggatacttccttttcattataaaaaactaaccctaatctcaaggtaacatatatatatatttatgtgtgtgtatatatatatatatatatatacacacacacatataacatatatagataacatgtatatataaattcctctaacttaacaaatgaaacaaagattcttattgcaccactatttaacactgttctgaaagttgcagcaaatgcatttaaacgaaggcagggaaagctatattcaaagaagggattgtctccaagagaaaaatatacaggttaaaaaacagtataggaagtatgatttttaaattaaaaaatgctactgaactgtgtactttttaaaatagttcagatggtaaattttatgttgtgttttcttaccacaattttaaaaaatatgcatatatatggacagaaaaagactgatggttacccctatagtaagcaataactcttatttagcttatctgcattttcaaagttgagaataattgattgattgattttttttttttttttgagaaggagtttcgctcttgtcacccaggctggagtgcaatggtgcgggctcggctcactgcaacctctgcctcccccgggttcaagggattctcctgcctcagcctcctgaggagctgggattacaggcacccgccacacacccagctaattttctatttccagtagagatggggtttcaccatgttggccaggctggttttgaactcctgacctcaggtgatctgcctgcctcggcctcccaaagtgctgggattacaggcgtgagccatggcacacagccttatctgcattttcaaacggaccagtatgatggtttacactatactgaaagtcatcttttaaaaagaactttaaaacattaactatatataaaactatattaaaataaaaagacaaatttcataataaagaaatcgaacaagaaaacacaaatatacagaactgaaaatgagaaagataaagtttaccagatggaaagaatcaagtattttatgcaccaagcccagttagttttgcaagtgaactatttcaaaacttttgaagaaaaggtaattcttacgtcatatacacatttctcaagagcagcactatacaatacggcaaccgctagccatacatagttattaagcacttgaaatatggctagtgcaactgatgggtaaacttttaatgttatttgaattcaatctatttaaatttaagtaagtgaatgtacctagtggctaccaaatggagagtgcagctgtagagggtaaaaaaacgaaagcttcccattttagtattatgataccaagaaactaatggccattttaacttataatgcaagaaaagtctggataaaatgctagtatgttgaacctaataggggttgaaaagaatatgcaatgatcgagtgctgttttttttaacgcaggaattcaaggacgccttaataatcaggaaattaaatataattcatgacatcaattacagcaaggagaaaaactctataactttgtcttcagatgctaagaatgcatcaataaaattcaatatccattcccgattattaaaaaaaaaatactttcccggcacaataaataagagacaccatgaatcgacaggcatcagcaaacctgaaactaaaacaccagaagtattcccattaaagtctggaaggaactagacaaaatagcaactgtaattattattatgtaccatattcttataagcaatatgaaaataaaaagaaatatgacacataactactaggaaaaaagagaataaaatcattactatctgtaaaagaaaagccattaaaatcagttgaaactcttaaaactaagaaatgactattaggttttcactcattaaaatagattatcttcaaatggaaatgctgataataaagtacatttaaaagaaattcactagtaagtgaatttaaaacattataaaagtatcacaaagtcttaagaaccaaattctactgagctttcccttgaaataaattaaatcaaatttgctagtaaaacccttcaaaggtttctgacgcctaggttaccccacatgactaaggattcacacacagacacagacacacacacacacacacacacacacacacacacacagattatcaacactgacttcctattgacccagcaaccaaccatggcagacctaaaaccagttcagaaaaaggctaattaatatttattttcctcatgctgtgaaaagaagaatatcatgtttcctctcagaatatgtccttgaacttttaaagatttaaccatatggaagagatctaaaggagtatatgaaaaggctaaagatttggaatcctaattcaatttcccctcacattttaataggagcctgcagcaaatatttatttttagagatattctcagtagggaaaagaacaaaacgctattgtgtgctaaacatggtgaggtctctctggtcccatctataccaactttataaacatcaggttagaattaaataactttaaactttaaatcaactatttccagaccacaaaatctattctacacttatcggcacacataagttctctaagtgacttatagctgagttcaaatgtgaaatctggatttttcaagtgccaataaaagaactttccttcggactttgactgaataatgctgaattgtccaagaatgccatgtaatgttttcatttccttttccaacaaaaattttcatctgcacttgataaatttactgactccgtatcatttatgatgaaaagcatatgggtaccgatcatattggtctccactattttcttattaaataggaattacaactttttctcaaagtttaacaaaagtaaaaaaagatgaagtttacaggtgtgccctgatcactatgaacatctctttatatgtgtcctgtcatgagtctgttaaaatgcaaaaggaaacaagaaattatctacgattagcaatgtggtcattttaaaacatagccacaaatactttgacatgcctcccatcaaaaggcagagtcagttccctccctttgaacatgggccagctgcagtgactcacttctaataaacagaatgtggcagaagtggggctgaaggctttgaaggctaggtcataaaaggtgatataccttcctcctggctctccctgttgggttgcttacccataaaactttgccaccatgctgtaaggaagccaagcagccatatggaaaggccttagttctactcccaaacaaggttccagacaacaactggcatcagccccgagacatgtgcttgaaatagcctccatatgactttagcccccaggctttgggccatctcaatagacaccacgtggggccaggtgcagtggctcatgcctgtaatcccagcactttgaggggcagaagcaggcaaatcacctgaggtcaggagttcaagagcagcctggccaacatggtgaaaccccatctctactaaaaatacaaaaattagcctggcgtgatggtggttgcttgtaatcgcagctactcgtgaggctgaacctggagaatcgtttgaacccaggagacagaggtttcagtgagctaagattgcaccattgcactccagcctgggcgacaagagggaaactccattacaaaaaaaaaaaaaaaaatagacaccacgtggaagagacaagctattcccaccaaaccatgcaagaatggcagatgcttgaaaaaataagaaccatctttattttaagccactaggctttgagtgttaattattatgcaacaacaggtaactggaacacatagattatttcagcccaatgcagccatcttattctttccatttcaaaactacctgagaagacaaatctgtttcaaagaaaaaaaaaaaaatgttgacattcctggtctcagtcaactcaccctagaaagccaaaagctggaatcccagcatttattacctgtggctgccagctagccttctcttgggcagttttcttctcactccttaatataccagactctcggctgggcgcggtagctcatgtctgtaatcccagcacgttgggaggccgaggcaggcagatcatgaggtcaggagttcaagaccagcctggccaacctggtgaaaccccatctctactaaaaatacaaaaaattaggtgggcatggtggcacatgcctgtagtctcagctactcaggaggcttaggcagaagaatcgcttgaacctgggaggcggaggttacagtgagccgagattgtgccaatgtactccagccagggtgacagagtgagactctgtctcaaagaaaaaaaaaaaaatctatatacacacacacacacacacacacacacacacactagacacatactagacacacacacacacacacacacactagactctctggcctcttctgtcctgtcttaaacttactcctagctttgaaaagttgcttttattaaacaccctggcttatgagactgctgctactgctaacatacgctacacatttttaatcaaggaacaagtaaaatttgcctaaaaaagtaattctatgactttgaggcaggtaaccagttcaagatgttttaatgaagccattaaaatgggttatcaatcaacccaaataatcatatcaaaacatttactcttcctcctaataaacactagggagggaaatatcctaattactcaaataaggtttttcttaaagaaacacagcctaaatgttaaaagctagaagcaatcgtgaagataatctagtttagaactttttttaagccactgggaaactgacaaaatccagggaagatcttcatgacttaagtaaaaaatgtctacctcactccatctccacctaggatgtcaacctgccatcatataatgacaatttgaaacttcaattctgtttgtattttaccaaaaaaattacaaatacaattttgttagtattttatagctacagcaataaaatgtactccatgcaatgttatttaatgttttatctttaaagtttaggattatgacaaatcccagttaggataaacaaaagtatccctgggaatccatagtcttcttataaaaaattaaaagtggctgttctatttctatcataagaagtattagtaatcattgccctagtccaaatcatttgggaaaacaagcccagcaaggttacataactggcctgaggccataaaactagttagtggcaatactatggccagaattttggtatactcatgcttcctagtcatgcaggggactcaaccagatttcaattaataaaagaaaaacaattactatatgtttcaattcaaaaagccccatcaaagtggctggctgcatttcagttccttcaatgttacactcaaaatccttctggtagactatctttctctttaatgtaaagaaaacagaaccttaatggaggcacctcaggcatcaccaggtgaatggaaggcgaatgcagccaagagtgtggactggctattcaaaagccattcacaaccccaatatcttttgccttaactacagaggctggaagagtaaaacactcaatcccagggctccctggcagctagagaggatatatgacaaaattacaaaaatgagcatatatacagaagtcactagagaggcatttctttccaaataaaaacattaatcctgttagaaggtcttgacccttgtgctctcttcctgcgaggaatgtgggtatgattctcagagatataaggccatcttgcttctacggggacaaaagccacatgctgagccactggctccctgatgacacagaagagtcatgacaccagccctggactgtccacccttgggctttctactgagtgaagtttaagactatgcagttggttttctggttacttgcagctaaatacaatcttaactcttataggaaataaatctggcttttcctcttcaatccattttttcccgaagtggttggttgtccatcaggcttagtcttatataagtaaatttggtaaacaaagatttagtcaccttcatccttaccccatgttgtgctaccatctcacttttttaaaaggtcagtaaaagacatcaaggtatatctcttctccaagaataaatgaaaaattttagcttatagtaggtttgtctccccgtaccatatggcagagccaaggctgccttgggaagcagaagagagagaaatggtatctctccttatacaccacttaacctcaatcctggaaggcatctagaaattcagcaacagaaagaaaaccagaaactaatgcatgccacagtctcatcctctactagggaaagaacacaagcaccaggccttaattagagaagatcgtataaaaaccattcactcagcagaatgccttttctttcccttgagcatcatgctggagatcttatacctcatgttccatttaatttgagcaatacagtaatctcaaggaaggcttatgaacaaaagtagggtgttttccattcttccaatgtcctttctgataaagctggctgtggcagcttaataagatgtatcaattgttaaggttaaatggcattttccaaagggatggaagaaaataggtaacaccgatgagaagctaagcattctacaaatttcatgccaaaaaattaaataaagaaaagaatatatctctgtaggtgaatagcaaaatgctttggcaaatttttgggattcaagtttataaaatccagacaaaccattagctattctggaccaacagactaggccttttttaaaaaagttaaacctttttctaaaaagcggagaattcccaaaccaagcaatcactcaataaatagctctatagctgacaatgaccctaagggttcagaatctaacagtacaatgggatacagtattctacaatacactctggatgcaagagaaatttcttaatctgagtctttagggttgcactagaaaactcaaaaagtgaattctgcacatgggggacagaagtcaaacaagtgataacattaaggagatgaagagtaatatttacagatataaacgacgatcaactaatcttagcaaagcaatattcaaaggataaaagcatgcgaaaaaagcaatgagtttaaatagacctttacatcagaatagtttctgacaatttagaacctaatctgtagaaccagaaatgccttagtcatctagattgactttatgtgaacaggaatttcccctctcgctctgaaataaatggaactccagcttaggctagagcatttactaattacttaagcaatacatttttaaaacagagcgactataatttacagcaagaaactgatctccatgtgagttactccaatgtactaagttaaagataccagaaaaaaaaattatcaaactaaagaataaagttattcccttcaaaaatttcactaaattttcagtgacatgttagataatctcctagaatggagtaaggataaaataaacagcatcaccctacctagcacatttcctggaggtacctcctctagatattccagttcccttcccatcagaagatacaggttttccagagcacagtatgccatgtgggggacttgggggaggccatctggtggagctgagaagcctaatggtacctgggcaaagaaaaatgatggaagacaagttaggaggcatttggaagcattaattggtatttgtaaagttacttctattcatcagtaagatatggtatagcaacatttcatgtaaacctgaaatatgaacatttgaaatggtgtgataaaatatgcctcactttatgaataaaatctgaaatactcaaacttctcaaatactaaaaaattgtctagattcccatttaatcataagctttatggctaagtaacataaattctgttgtgacctggtattgtcactttagctgatcctcacagtcccttgttatttatgtgaaccacatcatacaccagttctggtgactactgtgctatcatttgaacactcattattactattatcctttcaagttgttttatttataatgttcttcaagtattcaacaagggctggtgctagtgccaagtaacatataaaaataactttggaagggtagttagatgtgataaaaatgccaaaaaaaaaggcctaactgctattatatgctatattgttcatatggaagagcatgctgtgatatattaggaacactaatgagaggacagagtacatttacagcaaaaatatacaagtacaagtacattagatttattagctccccatacatcatatttattcttatggaactattgtctcaaatgattcaaattttgcattgtgtgaagtcttcagaaatatacccaccatataaatgcaagtatccagaaggcatttcaattaaccaaccaaccaatctttggtgctcataggcctggggtgctgccctaatgctatgaagggaaaaaaatggctgagatacaacataaacaaagagattaacatcacaagcatagggtgaccaacaaaaaggtagtataggcaagtaaattcataaaggttcagaggaaggagaggcccctgtgctagggtagactctagaaatttcatgaaaatgatgacctttcaggcacatgttacatctaaatgtatgtgttctgctaaaatgacaactctcaaagtagctctaaagatgggctggagagatagaaaaattataagaactgaatagaaagaaatggaattatctacacaatatgactgtccacttaaaacaagctacggataaattataattagtgagacagcttagcaaggtggcaaaaatgcaagatcaatatacaaaagttaattatacttctataattaggaatagaaaatgcataaatagaatagcaataaatagaaaatatgtgtatttaaaatgatttttagaatagcaacaaaatctaacaagtgatcaaaactctttataaataaaactataaaacttcatgaaaaacatttaaaatgacctaaataaatagataaataaacctaatacattcatggatggaaagatgctgtattataaaatgctgattcatgccaaataggtgtatggacataaagtaattccaatcgaagcctcaacagggcttttcatagaagctgacaagctgaccataaacttgatatataggagcaaataggaacaaacaagacactaacaaagaaaaacacggtaaagggatttggtctttttgatgtcaaaacatttaaaaatgaagacagcactgaatagagatagttagagacaaccagaaaaaaataaaattagtccagaaacagacctatgtacataggtaataatctgatttctgacagagtggacaaagctaatcagtggataaagatggactattcaataatgttggaacagctggacatttaaatgaggaaaaaatgaacctggatgccttctttgcaaacaatgaattaaatatttaaacatgaaaagtaaaatattaaaatttagaagaaaacataagagagttttgtgacttcaacatagacttaatttcaattttcttaggatacaaaaagcaaaacccataaaataatgataattcgagtacatttacattaataacttctgcctattaaaaggtaccaaatggaaagtaaaaacaagttctacactggagaagaaatttgcaaaattcaaaactgacaaggaattagtatccagaatatacaaaggacatctgaaaagcagtatttaaaacaataaagtaccataatagaaaaacagggaaatgactccaagaactattaatatcttcacacgagaacacaagattgaccaataaacacattaaaagagttataaagaaaatgtaaactaaaactgcaaaataccgtaatatacccatcagactggcacaaatcaaaagcctaacaaaaccaaattttggtgagcatgtggaacaactgtaactgttaaacactcctattgggagtgtaaatcagaactactttggacaataaattggaattatcttgttaagcaagagattaccaaggcaactccactataggtatattccctagaatttcttgtaaaagtgcataaggagatatatacaaaaataatcaaggtagcattgattagatttgaaaaaaaaaaaaaaaaaaaaaacgaaaacagcaaatatatagtgaccaaaacactgtataaataaaatgtacatttaagtaaaggaatcctatgccacactgaacaataaacgagctacgggaataggcattaacatagattaatctcacaaagttaaaaaaaaaaaggcaggttgtagaataactacaatgaaattccatttatacaaagtttcaaaagcatgcaaatgtgacaatattctttagaaatacgtacacaggttgtaaaactataaagaaaagcaagagaaggatgtggcagacagactaaaagtgcccctcccatgatgcctgcttcccagtgttcacacctttgtttagaaatctccttctcgagtgtgagtgggacctgtgacttgcttcttctaacaaacggaatatggcaaaagtgatgagatgtcacactgtgattctataccatcatacaggactctgtcttgctaggagattccttctactctcttatatggcttgatgaagagggcctccaagttgggaaggtccatatgacaagaaactgtaggtggcctctaggagctgagggcagccaaaggccagaaaaaatctgggactcttagtactgcaggtgcaaatatatgaattctatcaacaacctttagtgagcttggaagcaggttcttcatcagtcagtcctccagatgagaatgcaccctggccaacattctgattgtggctttgtgagaccctaaggagaagatgtggctaagccatgtctggttttccaacccacagaaactgtggatgacaaaatgtgtaatgtttcaagctgctacatttgttgtaatctgtaatatgcagtagcagaaaactaacacaaaggatgaacacaaattctgggtaggggttactttgaaggtaggtctgaaatatttcaggtttttttttaagcagttggaattaggttttatggtgctctggttactgaaataagaggccatttgagctgtcaatgtattgtatcattcctgcttaagacatgagacacataagcaactgatttcaacctgtagcaaagacacattatgcagagataaagtggattgttcatggaatttgtaatgccaaataaatcaatgtttcactaaataacaatttcttgctcacttaccttcacaaaaaaggaaaaaattaactgatacttgacccttactgataaatagcaaactatcaagccaagataatcacagattacgtagatgtataaaaaatcatagatgagtttttatacatatcactttcagactcccataaaacataaccctatacacaccaagtgctgcaatctttcttgctaaattagaacatgccatagctcaacaaggactgcttcactgccacgcagctctgcactctccaaggattaaactgctaaaactcatggaataagcattcaaggcaaagaaaaactgatggcagagacttacttcaactgctacctccttctctctcacttgtagccaagtaccacagcttccctggtttatctacagacaggctgcttcctgcacagagaggagcatgggtttttgtgctcatgatgctccacggtgccagctgacaatttcctagcttactgctttgtgctgatccagactggctgcttggacctctggcactgtcttcatcctatgacctctattatttaattatgatataattataatgtatatatcttgcttacttccaaaaatgttctgagacatctctagcctgtgatccctgtttcgccccttggctcaggcatttttagatgctgcctgttcacctacttacagaccctcctgtccagactcagggtctgtgtgccatgcaactcctgcctatcccctgctcactgcccacacctttggcctaagccagctagtttttggatcttcctatttctcaaagaccggccattgccctggctccagcatgacatctgctcttatcagttcttttctctaaccacaaggtgactcttgcctagaagagaaaagccttataattaaacaaggcctgaaaatttggtccacatattggtttcctaaatgctactaattgagacatatatgacaaatgttatcaaagcaacacaaaaggatacacagtcactcaagtgtgcctttccagagacaaactaaatctaccaacaagataatcaccagtcccaacaaaatgtgaaaagatatcagaccctcgagaaacaatatataaatattttactttcaattcttacccttcgtaaaaactcaagaggactgtatttgggccccaagacaaaaattttctttcctcttcgagccacaccactgaacacccgagcaaatgcaataaaagactcttggttgttttcttcctggagcacaggtttaggggtcatactttccacctgttgctcgtcacctgacagaaacaaaaagataattagtgccaagaatgccctcttaattcaagaactgtctgaaatatagaaggaggagtgaatatgatatctttcgtcaagtttcaggaaaaaaaagaaaacaaaacaaaacaagaatggaaagaatattgataaaaactacgattaaagcttaaaaatctcaagaactaaaggatgagtgtcccaagttaagcaaaaaggcaaatactttgcaacagagcctacttaggaaagctatacctcttggctcctctccttttggacatgtttcaatggcactcccatcttgggtgggctccaagggtgcctgtccctgtgctgctgcaagcttctctgcatgcctttgtcttgcacgctcacgtctctgagcaatttcttcttgagtgagaggcctacaggatatcacaaatatgctgtcatctctcagttcatccaagtagggaaacagcaagcattgacatggctgggtaagatgaagattggtcccagctccattccaggcaattttgtccaagtcctctccctgtctgtagcaataagagagggcctatcagcctctctctaataatgctgtgtcccaactattctgagcttatgaactgacatgcaagagcccaagtccccatctggagcaatgtacaatagtatggaacctttctcagatacctatattccttctggaaaaggcaaagaacaggaagaaggaagggaaacagtgacagatactagggtttggaacgactctggcagggaaacaagcataaggcctcaataactggggttcaagaggaagggttcaaggtcaggatgagtactggcaattcatcaggactagaaggtcaaactgaaatatcagccactgtgttagacctaagaagtaccatcacagaaaaggcagtgtgtgggtgtgtatgtgtggttttccatgggggtgagaatgagaaggggtgggggaggtaattaagctctttttcctaaagaactaccctcatgtctgtcaggacgcagagaaggtatttagagttttaatactaaaaaggtgttgacaaaaggggaatactaagttgaatacaaattctgtttgggagtttgggtttggaaggtagaaaccaggccggtagactgtttcctaggacttggctcccttcccacgtagaggtccttatgaacctacctgcatgctcaaccccaacacatgaacaagaccaaaccctgtcctaaggctgatagattaacagcatcttctgccctatactctgggaagtgaacatcaaagcactcaggctagtcctctggtcctaactttatgctccagctctggaagctggacaactcttcatggtcccaacactttgtgcctctctcccgtgttgtccatcacctttgatattatgattcctgctttatttgccaatctcagacttcacacctaactgataaccttcatccccactttgccatgccatattcccctcctctctccgtaagcactggaagccatgcaggtaaccattctccctacttgtcttccaaatggccacagacccttagggctcctgatgcaaagtggcctaactccttctacctttctatttcacgtaagctaacctgcaaggtgactgcttaaatcattgactgtccactgctatactcttcagatatccgcctgctggacaagacttctctagtcctagtatccaggactagacactacttctgccttccttagcacctgtccctcaaaatcaatgagtttagttccaagagtaggcccttccactcacacccactctgctgcaggtcactgggctgtgcaatagaatacaaaaatatgagaaacaatccttgagcctggcttggtcaggtgtcttgttaggcaatcaaaactgctggcactagggggccacactaccactgcaagagacaagctcctcattataggaagctctaaatgtcagaactttcaaatacagaatgaactctgcttcctcacaatttctagccatggccgcagttctctcctccggagcaacatctaacaaacctacttccctctcctttcctttgaatcaccagcattcatgccttccccaccttccttctcttccccaggctgaccattctagccgttccttcaaccaatcctttgacaactttccttgtttctagacttttgctaaaaactcataagaatatctgaaaagtgtgaattaaaatataaatgcagaacacatttttattattagagtaggaaggaaaaaataccagaggtacctgctagcatctaaagagaaatggtctcttccaacaggtttatcactatgatccagagactgttaatcactttacatatattatagcacataatttatcacaacaattaaatgaagtagatatcgtattcctattctacatataagaaaagggagactggaaacttaagtaactcgacccaaagtcacacagatattaaatggaggagccataattcaaatccagatctgtatggctctgaagtctatgctcattatcaccaggttatgtctttccttcaagaggaattaaagataaaattgtcatcttatgtaaatgtgatttcactttagttttagtgaaaaaagaagtgtatttgttcacttgcagattaaatcctcatctgtctaagttcatgaagtgatctggaataatcagcatgtacagtcattaagtaagcatcaactgtatagatgcctgctgtctatctatgtatctatccatccatccagttaacaactactgtgtgccacacactgctgggcactgggaatgatggtagcggggaacaaagcagatagtaatcagcaaggatgtgtaaaaagtacccactgtgtatccagcatttgttgagaacaaagaaatttaattacaagaaaatggggccctactagtgaggaaacagttgtgagtgttaagttatttaggctatagttaaactaaccatggatgttacttcttgaaggggcaatagttactaatactgagatgaaggagaccagaggtgagaatgttgaccgaagattcaaatgtcaggttggaaggtgaatttgaagaagcaaagaaaagaggcaagaacacaagaacagaggagaaagtcctgtaacagtcccacacttcatttacaaccacagtggcactgttgagcagtgagtaaaggtcagtgtcttcactaagttagggaaaaaattttttaggctttgtgggcgccgaatcctgtttcctgccttacttttctccctggcacatatcactaatacattgtactctatactaaaggaaaataatactctgctattcctggcttgtatgtctaatacaatggagatgaaaatgctatcaaaccaacttccaatggtacattttcccaaatttaaaaaataaaacttaaatgaaaaaaaaaaatcagctagaagatggaaaagaacaaagtaatggtgatgaccttgcccaggtatacctgaaaacactatattattatgtaacaattgttgaacctgatatactggttaaaaaacaatgacaaaaataaaatcagtaaaaaaacttcatggaatagaatggattgcactatcagaaatatactaaaatcagaaaagcatatgatgaattattaggaaaaacattcacagaaaatgtaattaacagtagaggcataataatactattattcatcagcaagaaatgaaggatgggtagagctaggaattttaaatgctataaatacatgtatttcaaatcttaacagcaagttttccaattctctgatattccctatgattctaccagaatctctcagatactcccaatggccaaaaaacatccaatatcctacatttgttactacaagaaattgttactacatgtagcactgaaatattatctgggagtagcctagatacataattagacattcattcattccattattcactcacttacttactcagttagccactcattcacccattcactgacctgttattcccccatttggatattcactcattcattcttcatttactcacccatctattcctttacttatccccaggacaaaaattattgaatacacttaatgtccaaatcactagggaagtactaaaaaacaaagcataacctttcccctgaaggacaaacagaattttatcagaggaaaagaagccttctcagatggaggaacagcacaagtacagataggacatttgttcagacactagtatattagagaaacagaaataaaaatctagtcgaaacatggtttggggtcaggtcatggtgggtcagaaatgccactaagacaggtcaagtttatttcacgggctgatgatctgaccttcagtcactcacatatcattttcatgatttctgctatatctgcatattattatttaatacttatttaaatgcacaaacatttttaactcaataaaactttaaaatctcatcatggtaaaggctttatcacttgacatacacaggcaatacacacaaatacacattaaaataaatatgacaactaattatattaaaacttgtttccctaagtaccactgaaatcatcgccaacactttacacttgaatcaaaactgctcaagacagtgaggatcattaagggtttttgagcaagagacatatcttcatagctgagtcttataaagatcactctaaagaaagaatggcaagtggatcagtggaactaaagatggggcaggagaaccagctaggaggttgctgcaacaatatccacaagagatgatcagaatctaaactagtggggaaagcagcagagacagaaggaggggaacacacataaaaaacaggaaatgtagaagacacagattccccaagactctggaacttgaggaatatccctctcctacacctatcacacctgtgcacacataatacacacagggaagcagagatcctcatacattcataatctctactgaggtaggcagaattagatgagacaaggcagacttagattagaacttgcctgacatgtttaataaaagttaattgttgctactactgctaacatactcttcaaacttacatcacttcaattcaatattccagagctgatttcaacaactttctcctacagaggtatcacaaaaggatatactactgtataaattgtatgttaccctgggggttggcttgatatgaattctgggttgaggaggaaaagcattatccgtgccccccctacccacagcccaactgcatcccaccaaacatacaccatattcctagcccagcccaactttcccctttcccttaccttggcttattctgaggcaaggccttagcatcaactgcaaacattttggaaacaaatataataactggagcagtgtcctcacttccacatttcataaaagctaaacaaataggaagtaaaaatgtcactatttttcccattattaaaaaaaaaaaacagatttttctggaaaacaattaaaatgtttagaacatggatggcatcatcaaaatacaccagaagtccataactttttccaactatgataaaaattttaattagaaaagggtaagattgctaggaaagaatagcagagcaagagcaaacagttggcagaaataagaaaagaaaagcaagcaaatttgacagggtgagggatctcatatgaaagctaaagctatgcaatgaggttaaccacctaccataagcactaatacatttttcactgtatcaagtatagaaaatagaattgaggaatgttaccaaaggccaacaatcaacaaggtagcttgttaataagatacataaaaatcaatagctttcccaatcccccacaataacaagttagaaaataaaatggacaaaaatactgtattatgatattaacaaattcttagaaataaattaagattcaatactattaagataccaattctccctaaatacacaaattttaatgcaatttcatattaacatatgaacattttccttaacctatactggaggtaaaaaaacattgattaatgaatttttttaaaacaattccatcacctcacgttaaaataatttatatataaagaattcaacagtaaaatacaaacaagaaaaaagaaaaccacaggaagtaagaatcaaacatgtatcagaagtcttgccagtggaagctttgaatgaggaacagaatgacatgccctgatttatatcttaagaggatcactctgttttgtctgcaatagttgagaaaacactaacaggaatcaagagcagaagcagggatactagttgtttcattgttgttgttgttgtttgtttgtttgttttttcagatggagtcttgttccgtcgcccaggctggagtgcagtggcgttatctcggctcactgcaacctccgcctcccaggttcaagcgatcctcctgcctcagcctcccgagtagcagggactacaagcgtgtaccaccacgcccagttagtttttgtatttttagtagagacggagtttcaccatgttggccaggaagtgaaaacattgggaaatagttgaattctgtatttcaaaggaagaataaacaggatttgctgatggactggatgttggagtgtgagataaatataagggccatagatgactccaaggtttttggactgagtaaatgaaaagattgaggtctccctaactgagatgggaatgactaggtgagcaggcttggggataagataaaaagtccagttggggatatgttcagttgagatgcttcttagacaacacagtgtagagggagttctagatatcagtccagagtccagaaaacagacatgctctgaagacacataatcgtgggaattatgagtatgtagctgtcatttaaagtcttgagattgggtacaattatcaaaagagggactacagataaaacagatgaggatcaaagacttgaaccttgcttgaggcaccccaaagttaaaaagccagggagatggggaggaatcacaaaaagagatattaaggataagcagccagggagacacgaagaaaagcagaagcaagggaatgaaagcaatggaagcctaaaagtcaagggacgaaagtgtttcaaggaggagtgatcaattgcgtcaaatgctagtgacagatctagtcctgtgaagactgaaaactggccattagatttaatgaaccgaaagtcaatagtgatgccaagaataacagtgtagtggtttgggggcagggttacaaaaccaatagaactggaggaaaagaattagagataagaaaatacgtggagacaaatttcatggaacctacaaagcccagaatgggagcttcttttctcacgaggagcatgtgtacaagtcgctggtctcaccctactgcctgagcaaaatggctgtaacaagaaaacctttggggtgagggtgggaggcaaaactggtgaaatggtcatttgtgaaactgttcatctgtggaagtggacatttggcaaattggccatttagcaaactagcgttcagcaaactggtctagagcagcctggatggaggacagtcaatgacatggtatattccaacaggtccatctttcctcacctgctttcagtgcttgagtttctggtggaaaagagtcaaaagtttgtgatcctgtgcacatcagtctctccactctctcagctgtaatatcaaggggactaggaagtttctgacacaccatagctgaagtctattgttaaggactgaaaaccttgagccagtgcctcccaccaaggcgaagattcactgtatgcactaaatattgaggtaacaaagtctgtccatacagaaaatgcctgtgctacaaggcaacactgctttatgcatcacatctcaaaacatgcatacaatttcagggagttcacaaactccttaaagctcagaaaggatcctcatgacagatactttaacactgaggcccatgaaacaaatgagaacagagcttagcaggttggctacaggtgaccttgaaatgaaacagttatctaacacaaacatctaaatcatctacttatatttgaatcttagtgtaaacatttttatttttatagattactaaacaaacacaaaaagaatagtcttcctaaagaagttcactattagtaatgttaacacaaattagtattagtgtattaattatcaaagtatttaatacagtttcatggtagaacactaaataagcagagaagacttattttggattgaatgttatttccagagaatttcttggttaccataacgcattgttttttctagctttatcaaaactatttcattaaaaaccattagaataaaggataccaagaacagcatgggatatgggtagccactgactgcaaatggcgttgatctgaactttagggtctgaatgtcgtgcctcccgggctccaatttttaatcctaaagaagtcactattttatcaattttgtctttgtccctgtggtaaacacaagattggagaggggaaatgtcatatgcagatataaacaggcagtggaacccaacattatttggcatatttttaccctaatgtgttactttttcaaaaaaagctaaaaatgattgaagggaatcctgccgccacacaaggggcctccccaacctctactcttacactttcaagtgaatccttctttaagatttcccaggaagtacttctccaccatctcctcaagcaagctataccaagtggtaaagcagtcttacaaataagtgctaacaagtcattattccatctcaggaataacttagaaagcaaatttactaaagcaaacttataccagaaaagttatttctcaacttccccattaatgatcctagctatcaagcaccttttctactttaataactattttttaaaagtgggtttgcataaacaaagacccaatgtttctttctatcctttcatctcttctcctcagcactctataaaatattgctatcctgtccctccaacatcaccctttagctgggttacataggcttctttaaattgcttccaagccctgtaatcaactcatctgtagaagctctgttcattttctcagaaaatctcagctttctgaaatatgactcatcaaactggaaagtgagacaaattatactgcctaaagatgcctaaaggtaaacaataagagtcttactttttcaaaacagcatcatacaaactccatatattttccaggatcaactgtacaaataaaggtttctttcctttggcctgtacaaaagaacatacgggcttaagttcctgaacatttaataggcatttatatattccttcttgacatgcttttattatcaatatgtttcatttctacttgaaaatatttattcaaaaataaagtagatgaaagtagttataagaatgcactaaacagtcaataatccacaatcaataataatccactgttctttcctctgggaaccatagactttacaagtgatatgaccatttgtgggtcatattaccatggctgccatcaaacaaatacacacagcacacaagccaagagctaaaacttcactctgcacatgcgggctctttccatggacttcagtctaaaattatgttacaagaaacataaagcattcttaaacatatttctaaaggttcacaaggataggaaaattttgaaaacccaaaaaaccccatcattactcttaacaaactatgcaaaaagttaatagcaagagcaccttgaggggtatactcttccatacacgagatgggatatattaataaattgatacctcctttctgaagaactactggcaacagtattaagaaattaaaagtcattggcttagaatgctcagttttaaaaaaaagcatcatgaagacataaaacttatgcacaaagatgtctatcataactctacaatatcaaaacatttgaaaaaactatgtccaatcttaagagaatgattcataaatgatagtgctctcacaaaataaaataacagggtgcttactgaattatttcatagaatcataactatcctatgagataagtgctattatctcaattttacagatgaaataactgagataaaagtcatagagccaataagtggtggagccaaaattcaaacacagagtcaactctcaaggcatgctctttcccacttagctatattcactccctttaaaatatattgtttataaaaaagcttttaatggcaagggaagatgttcatgatatgacaaaagcaaaagggcagctacgttgtataaacagcatatctcaactgagggatgtatatatctatgtaaaaaggatgaaagaaattataaacatctactagcagtgctggctttgatttttttgtttactgtggctttatacttgtgaatattttctcaaagcaatgtatatgattttcaatgagaataaatttatgaaatcctggttttaacattaaaaacacaaagctccaagaaaagtatcctttgagggtatatgacagcattcctacaccacctctatctatagaaggggtttcagggagcacccacctctcccgatctacactgcacgatgaccagcatgcagtgagataaggcctcagctgacactagaaagacagtgtgaaccatacagggatgtctagaagagacatctctttatggtgacagggacaaacaaatgcacagcacaaaatgtgtgtcttcaggtgcccaagatctaagatttttggtcttctgaaaaaaaaagaaaagaaagaaaagaaaaggcagttctttgctcactatacttaaaaggactaagaattctgtatgaataatacctgtatatggacttgtaagcctttcccaattatatacagtaaaaaatccctcatgaactcacctgcataaattaaagctgaattacatttattaaagatattacagtataggttttcatagggcaagaatatgaccaacaaccaaaagggacatataccacattacctgatcacccttcatgatctttttagccttcatatttatatagtaatctccccacaaggttttcataagaacttcctttttgatgccaattttttgactgtagattctggcgaagtgctcaattctgaaagaagaccaaatgttcatgttattaataacaacgattattgatttctgtgacaggtactgttcaaacttctttacacgtgtattactaaacttaatccagtatcctacaaaatttcctcattttacagaaaagggtaatgaagcagagatatcacacagggaacaagtgaggtggggatttaaatccaagcggtctggctccaaagcccatgttcaggtctacaccaatatgaattgtactacatgctatagctttctttcttaattttgcaggtgtaaaacaagataaaattagggacaagaaaatgcaagctccagctgcctgtcacaactatgccaacaataaaattttatttcagctactcactgctgttaagtgacagctgctcacaaatgaaagaaattcttgagccacaacctgccaaaacaagatttttattatcctagattaatggtaaacatacacacactgacttaactcgcatcaacccacagagaaaaaccacttaccaccgtggtctccagtcacaggaagacagtcaatcaacaactaagggtcctatatacagcatctgcattgtctggataaaggacctaagaaataccttttctttagagaacaatctagtttaaggtttgagattagaattttcaaagtaccagcatcttaaaagatgcctgctcaggaaaaaaaaaaaggatatccccagttttttccacaccatactgaaagcccaacctaatgcaatcgcacaagaaaaggaaataaagggtatactgattagaaaagaagaaataaaactatctttgttcacacgtgactctttaatcactcttccacaaatgaagacaaggtgaaaggctgaaatccactggtagagttcctatgcctcaaaaagaaagcaggctctgccttgctgcctactctgtggatccctaaaaagattcaggcctcctcctggcttccggtgtttcagcacacccagaacggcacacagagccttacttccagatgttaagtcaggatacccttatctctgtggcttttcatttataaatacccagttttgctaggcaggctgcaacctgccatgcagatttgcaaatccaattcaggacctacaggcaggtccaaggtccacatatggaaagaaacaataggaggcaaccactgtggactgacttcccaggcactctccaacctaaccttagaagggagccctatttgttagtagtgatgctccctggggcctcaataatacagctgaagctttgctctccatattggcgacttgggtctattcttagatggttaaaaccagagataatgactgagcgatgaatacatgaaacctgtgacattttctttcttttaaatttgaattattttttcacctgatataggaccaatttttgtatatccttcactgacacttaaattctgactttaattattctattcatatggttcatgttcctgtctactaacctgtgaaaatcgcccccaaaccatgtgcctacagagttctacttatagttctatttttgcctcatgcactttgttgttatgataattgatagttaatctcttcactagtaaatgtgtcaattatctatatgaaaatgatccttatgccataattcatttaccataaatcctattttattgttaatattgccaaacctctcttttcattcacatttggttgacataatctgagctaaagctttggtatttagcctctgtccattatgctttaagtttatctcttttatgtagcaaacttatggatttatttttttaataaaatttcctttctaaaaaatatctccttagtaggggatttcatacatttattggtataatcatttattggtacaactgttttgatcagttagatttctggtgtggtttctattcttccaggatttttttttaaatgttgatttgtgttacccagactgtattatacattattttatcttttataatatgtcagataaatatcctgctcttaattctgaaagtggtaaacttaaagatttttataaataaacactctaaaacctctatcaaaatcataaattatagtaagacatttgcccatttgcttaggctaggctcttctagtccaccatattaaatattcacacatgtgtacacatacgggtacacaaatctttcaaaaatcttgttgcttatccttttcattcttttttatcccgtagttactacaaaatttgcttaacatcaacccattcgacattactgctagtgtttttatttatttttgtcattagttacaatttttaaacactgacaatttctagcacttccccattcttgaattctattttaattcatttcctctacagagtaactgcaagcaagattctaagagacctgcagaaagatttatattccaagactactgatctattcattgcctatcttcctgaatgacaactcagtcaagtatgaaattactgagccacacacacccttttgccctccaagctacccagtagattaatgttaattacagaattctaatactcagttacacaaagacaagtaaatctattacaaagggcttttcatttctcttctctcctgtccctcttctataaggttgaggactcagttctatgtatctaaaacaagaacttagattcttgatgctacccatccaagtcaatatgcttctgcttttcagagcagactctcccagattaacatcaattaacaggatagatttcgggagaagacctaggttcagcctctagtcacacttcttaatcctttcccactgcagagtttatagaaccatcttgcaaattctggaatgtgctcattttccaccttttgtgacacatgcagctgtcaacttggcctattcactgacattttagaggaaaaggggaaggaaaaagtctctggtgctttcatttccaccactactttcccataaattcacatatcaacttgttgagaacagacagtagccaatctctaaatctgaccttgtctaatacaggggaacattcatttattggctgatagtatctaaaaatgtcaaaagtaagggctatgtaaattacccttattctatccattcaactttctccctattccctgtccttccacaataaacttcccccaatttgtgtgatttagactaaaattagcataaaacattgaattacttatgaaaatcaatgtaagaaagggacaagcctcccatcttgtggcttattagcagaatgctcacaaatcaggaaatcaacaagtacgaccgtattatatgactgaatgaatcactgtgaatgaatctaaagaaagtcttgaaatcatcttagcccaatattcttgttttttcagataagtaaactgaggcctagaaaggtgataatgacaacccatcaaccatatatgaaaagtacaaattctcagcaggttcacaatttctattttcatcatatatgcattacttcaatttatttagctctagtatcatctttcgggcatcaaatggactaagatatctataatttattacaaacagaaaattatgatattatattacactgccctgcccaagacaaaatctggtcaaagggaaattggagaacaagttcctgtaaaaaggaaaatacattttaaaaaacggagccagagatttgttaggctacacccaagccttgcattctagtcagctcctgatcctttctttctttccaattctaagtcatactgatataaatttcatgaagagactctgttttctcctagtgcatcatttctagttctatgatccctgcaaattacatgcaatatcaagcccacaactaaagttaactacagttatggtcccactactatttatccaaaccacagacatttttctcaaagtaataatcttttaactacatttggattttttgattccacaagtcagaaactgttgcagtttaaaaaatgtgatcaattacctactccattctgaaatccaatgtcactgttaacatggcctcagcatgtgcaaattcgggagaggcaataagaagaaataaggatccttataccccatagggaagacaccaagagaagaaccatgtcaagaaaacacaggcttcagactcaggcagactttaatcttaatatcaactctgcctcttagcagctgagtgatgctgaacaaaagttacttaatgttcttgagacttagataatagatagtaatatctgtttcaaaggagtgttgtcagaatttggtgaaataatttaaataaagtgagtaactcaatatttagcatatgtacatcctcaataaagctagactaacttttgctactgttggtatcaaagttgatataaatatatttgttcatctatgtacaaataactttaagaagataaacaaaaaactgacatgaaataaactgagctaaggaataaggtgggatccctttgtggtatacatttgaatttactcaagaataaagttaaagttaaaaatcaattgtatataaaatctataaagaaatgcaagactggctcaatattaaaaaacatcaatcaatgtaatataccatattaacaagctaaagaagaaaaatcatacaaatatattaattaatacagaaaaggtatgtgacaaaacttgacacattcataataatgacattcagaaaaataagaatattaggggacttcctcaacttgataaaggacatctaaaaacagcctgcagtcctaacattatttctaacggtgaaaggcttaatgctttcctcctaagaccaagaacaaggcaaggatgcccactcccatcaatgtcagtcatatagtgctggaaattctagccagtgcaatcagcaaaagagaaaacagcatgcagatagaaaaggaaaaaaatacaacaacccctatttgcagacatgatagtctcatagcaaattccaaaatatctacaaagaactgcaagtgagttcagcaaggtgacagtatacaagatcaacatacaaaaattaattgtatttctatatactagatgaatgtgctaacaccaaaattaaaaatatcatttataatcattcagaaaaatgaaaaattaagtgtaaatctaactcaacatgtacagcacttggatgctgaaaactacaaaatgctcataaaagaatttttaaaaattttaaataaaaggagaggcatagtgttcatggaatagaaaaaattcaacatagcaaagatgtcaaaattctccccaaattaacaggtttaccaatcaatttccatcaaaatcctagcaaaatgtttttgcagatataggtaagattactataaaatttacatggaaaggcaaaggccttgaacagcaaaagaaattttgaaaattaaaaataatgtggacagaaataatctacctgatttcaagacttattatgcagctacactaatcaaaattatgtggtactgttggaaagacagacacatagattaaaggaacagaacaaaacactcagaaacagacccacacaagtatgtccaagtgattttgacaaaggcacaaaagcaattctatggagaatagataaccttttcaacaaagcgttctagactaaatggaaatccaaaggccctctcctcccaccaaaagaaaaccttaacccaagcctcacactttatacaaaaattaactcaaaatgggtcatggattaaatgtaaaaagtaaaaccaaaacttatagaaaaaaatgagagacaatctttaggatctagagctaggcaaagagttcttcaacttgactctaaaatcaagatccataaaaagaaaaaatgataaacgaaacttcagccaaattaaaaactttgcggactttgatggctgggagcagtggctcatgcctgtaatcccagcactgtgggaggccgaggcggatcacttgaggtcaggagtttgagaccagcctggacaacatggtgaaacctggtctctactaaaagaaacacaaaaattagctggcagtggtggtgcacacctgtagtcccagctactcaggaggctgaggcaggagaatcgcttgaacctgggaggcggaggttgcagtgagccaagattgcgtcactgcactccagcctgggcaacagggcaagactctgtctcaaaaaacaaaacaaaacaaacaaaacaaaaaacaaaaaataaacgttgctcattttgaaagacactgttagaggatatgaagtcaaactacagactgggagaaaatatttgcaaagcacatatgagacaaaggactactgtttagaatagaaaaaactctcaaaattcaggagtacgaagaaaacacattaagaaaatgggaaaggatgtgaaaagacttttcacccaagaggacctacagatgacaaatcagcacatgaaaagatgttcaaggtaaaccagctgttaggaaaacgcaaattaaaaccacaatatcatattagtacacacccaacagaattgctaaaatgaaaacggtgacaacaccaaacgtgaacatttggagaaactggatcactcacgcatgcactgctggtgagaatataaaatggtacagtccgtctggaaacagtttggtagtttctttaaaaactaaacatacaactatcatatgacccagcaactgcactcctaggcatttattccagagaaatgaaacttatgttcacacaaaaacctacacatgaatgtttatagcagctttactcataatggcccaaaaaggaaaaaaaaaaaaaacaccagatgtcctttaatgggtgaataaactggggtacatccacaccatggaatactactgagcaacagaaaggaaccaactacagtattaatgcatgcaataacttggataagtctctagagaatcatgctaagtgaaaaaaatcaatttaaaaaatattacatattttttggttccatttctataacacccttgaaatgagaaatttggagataaatggttgtcaagggttaaaaagggtttgagggtgggaaggaagtagctgtggcaatataagggcaacgtgaaggagccttgtggtgatagaaatgttttgtatattgacggcaaatggcaaagtcctgcttggttattgtactacagttctacaagatgttatcatggataggaggcagttactgggtaaagggcaccagagaactctctgcattatctcttacaactataggtgaatctataattatctcaaaataaaagtttcactaaaaacaatcaactgcatataaaatctgcaaagagatttaatcagatgcaaacagacttacccaaagccccacccatctattgcactggtaaacaccacatttccctgttctggagagaagtaaaggtgagaatcatctgtgtcctccaagccagtgctccagtcatatacttgctctccttgttcagaatttggattcacttgggattcagtctccctctctgctctttcttctaggactttagaagtaaaaagagtccctgtgagcgcattaatctaggagagatggtgaaatggcagagcgtcattcagatgctcagcatgctcacggcaggagaaacactgtttaacctgtgttagggctagaatcattagtcagtttgggctcattaagcatacatgaatggaggtgacattcataatcagtgaataacttagatgtatccattcttcctaaactcagcataactaaattataaggtttttggaaggttattttgtgattattattattagtttaatgtaaatgttaatgtgtcatatccttaatttgtttctcagtgctgaggcctagtatcacaaagtactcatgatttccaaccccacaatcctagtttgtaaccttagtccactgccttgcccatctctcacatcggctgtctgaaatgtgcactaccctcttcaggccctcttcccaactcctaatcctcaactctactttcactcccaaataggcagtaatcttatgtcctacctcagagagaaaatggaacctattactcagatttccttcaagtgccccacatcccaatctacaagctcacttatgtctgcaaataccactgacctttctcctgccaatgcagggcaggagttattttacctgttcctaatttttttcttttttctgaggtggagtctcgctctgttgcccaggctggagtgcagtggcgtgatcttggctcaccacacgctctgcctcccgggttcacaccattctcctgcttcagcctccctagtagctgggactacaggggcctgctaccacgcccggctaattttttgtatttttagtagagacagggtttcaccttgttcgacaggatggtctcaatctcctgacctcgtgatccacccgcctcggcctcccaaagcgctgggattacaggtgtaagccagctcgcccggcctacctcttcctatttctacaacgaatgatatccatccatcattctttttcactgttctacttttattgtttcctgcctttaacaaataaatatactcaagttgctctcatcaacagctttccactgtgttgaggaagacatttcaaactctcacgcacggcatatcaggttcactgacatctaaatcctatatcctttttcccatctcttgtaactgttgcaaacgatctaattcttcagctaaaaaacaatttgcagttccttaaatgaaacactgtactgtgctttttcttgcctttatgactttgcccatcgtattccttctcttttgaatgtccttttcctgtctacctggcaaacacctactttacttccatctcaaggcttccattttaagacttctaactcattcttccctcttgacccagactgggttagatggcccttatctatgctgttatatcacacccaggacttatctcattgttctccaaatatctctttgtctcccctactatactgtgagctccttgaaaatagggattctgacctgttcatcttatattcacaatccctagtgcacaatggacatttgataattcatttattcaacatatatctatgaaatatttgctgaataaataaatgaatgaatgcttgggtaaaatttcctgtaacgacaggtaataaaatactacagacaggtaataaaatcctaatatggcttcactttggaaccaagatacagttttaaacaagagagcctattgtccaagctttatatgatgggtgattccaagagatggaaaagactactgagaacatgctttttctattgcctctcttgtagaataacagcaacacgtatgaatctgaagtggaaaagttcccttttctgtagcaacggctcatacccagctcagtaacttccttacaactcttcttcgtggctaaattttttaaatactaaaaattaaaatacctgttctaaaatattcttgaggtgagaataggcctcttgtggggtgaatttcagttccactatcaagcgatcaatcttattaatcactaaaaccggacggatgttttcaagccaagcttgtcgcagaactgcctgtgtctgataaaaacagaaagaaaaatgtaaaactcatgatttgaaataattagagcacattagaaaatcgtgattaataaccactctagactatgccagtcagacaaaggtattcattaggcattcacaaactatgtatacagcggagtagcaaagaactacacataagaaatcattgttgcctttatgcaactgacagttaagaaggataaataaggccgggcatggtgggtcacacctgtatctcagcactctgggaggctgaggcaggtggactgcttgaggccaggaattcaagactagcctggccaacatggcaaaatcccgtctgtattaaaagtacagaaattagccaggcatggtggcacatgcctgtaatcccagttactctggaggttgaagcatgaaaatcacttgaacccaggaggcggaggttgcagtaagccaagatcatgccactgcactaaagcctgggtgacagagcaagactctgtctcaaaacaaacaaaaacaaaaacaaagtatgttaaattaaagtcatcatctctaagatcccttcagaactctggtgatttaactccttcacagactggaacgttaccaaatgtgaaatataaaaccaatgttgtgattgtcagtgaaatgcctaaagtcagtcagttccccctctttcctcacccttaaccatttaagtattttctcatcacaatccattacctgtggacagactccttccacagcatctaccacaatgatgcatccatcacaaatgcgaacagcggttgatacttctgaggaaaagtccacgtgtcctggagagtctatcagattgatcaggtactcctcattacctaaaatacaatttgtaaacacacattttcagttgtccaggtacacaatgttcttcctcaggcgttctagaataagaaagctgaaagcttctaagaaaaaactgaacaaagctaaaggagttgaaagctcaatccagagctaccattccaacttttcccactgatgggactactgattccaaatagcatctatataaaatgttaaaggactttattattctaatagttaccacttaagagcttattgggagccagccactatgatactcacttttaatgtgctaatcacatattattgaatccttacaatatccctatgagatacatattactattctccttttacaggttaggaaattgaaactgaaagaaatcaatgcctaagggcctgacagtaagagctgttcaaagggccaacaaagcagttggccaagttcttccctacagtttgtcaaagagcagtgtatgaatctgctcaatcaagatttagactcaattctacaaaaacttaaggagcagttactatgtgccaagcagtgtgctatgtgctctcccattaatatctccttcaatagtctcaacagacaaatgtattaaacttatagtagggtgatgacacatcctgagttgtctggttttagcacggaaattcccacatcctatcaaagcccttagtcccaggcaaacaagaaaaaaaaagatcatcttaggttatagagagttatcactaaacataacttagtataccatgcagaaaattagttaatactttagaattctgtactcattccccattattgataaatttgatataattctcttttaaaggcagaataactattagaatgctcaaacatatactttacttttgctcctccccttaactcagtgtttatcaacttgaatgcactcaagaatgactacagggttgagtatcctttatctgaaatccaaaatgctccaatgagcatttcctttttgtgccatgttggtatttgaagagttttgaattttggagcatttcagattttggattttcagatttgggatgctcaacctgcaatttatgggccatttaaaggattttcccccaatataattttaatgacttcgcttgtgccctaggtgatactgatgataaacaccaccacaacaataaccacaaccagcgcttaacatctgtggactgcctattcatggctggcattgttctaagcataatacagaaattatctgatgtttacttacaacaatcccctgtagtagttacaactattagcccaattttatatagcaggtaactaaggcacagaaaagttaagtatttttctcaaggacatccagctagaatccaattctgaggttgactaagatcacacaattcaaaatgatagagcataagttcaaatccacttaactccaaagaccatacctctaaccactacactcagaaggcagtaactttcacctcacatgccaagattccactgctaatgaattcctaaaacactgggtgaagcattcccaagtgtactgaggctcagtgggaaagactgccatcagttagcaacagactgccttcttcagtaccactcctccccgctgcctcctggtcttttcatgcaaactgctttatgaggaaccattgctctgctgaaaccaccagagaaggctccaaccagagaagaccatggagatatccagtgaaaatccaagaagtcaaataaccagagccctggagcaatggcccactggacctcaatcgagcctttcactgtcagatctcacaccagttctcctagtcaacattttcgataagtatcgtgatctcaaccaagtacaccagagaaaaaggagcatgtctagtagtggtctagggtcctatcatacaaaattaaagctgtgagattcttagaatcactcagcattttctcagcctaagcctttattccatagaaaaacatgctaacgccctcaaaaggtaagagactgacccaaggtcccaaaagaagcaagccagaaatacacccagggctatcgaaccatcttagtcacttctcgggtcttagattccttcatactttgcaactggggaaacaacacttgcctattcatctggctaaactccagactttagagtgggagaacttcaagcacttttccatcctttgtgatacgaccgggacctgatactgaagtttcagagactgggtctccagtcaagttctttacagagtctaaaaatgcactcgtacagacatttcaggcttcctatacaacagtgctcttaccttttattggagttacagaccttttagggaatagtcagaaaaacgaatacctatctacttatctatgctcccctaagtacgcgtccatttccagattctttgaaattcattcaggaagggcaggttcagatctagagaggaactgaaagctagagatacaccaagtgtttccacccgacaatctacatcctaaaaaataagtgtctgatcaaataatatagctgagaaataaacagccagccttggagctcacatcacacatacatattaaaggttcagagaagccctgtaaaagaagtttgtccaattctgtttaacctggagtttctcaaatatatttaatggtgagaaggaggaaatgccatggtcagttacacagctgacaaaggcttggctcagctctgagccaggcctcccaattcctccttcaatgcctttttcatcttaaccctttccaaacaacgttaacctaaatttcaaaggttggggacagaagtcccatatccattagagaaaaaacgtccccaagcacagctcttctgctgtgacttcagccacattatgtctctttaaaaaatgccacttaccacttttgcgtgtgtgtgatcaaattaaaaaatacataaacgcagttataggggtttaccatggtagatattattgttattgccagtattaattatttaaaaagtagagaatgcataacacttttcaagagacaaaattttttaagcatgctaaatgatctttccgatttgtaacaaagtcctgaagctatatgttgaattaatccctgcaatagcattcagggacagaaacttctgctgctttacttcccaggcattccaaactaaacggcttcatttcaaggcacagatctaatcagtcaagcaacaatccaatctttttatgttccagggggctgaaaaaaaagttggaagaactgaagttaattatgggagatatcttccagacaatttctgctgctaatagggagttatgggaaaagaattcctcccttgcccatggttttaaagtgccatggataattgtctcacagaaggtgcacatttgtcactaggacctgccaaaacatctctgtattcagtaaaacttcatgtaaggagtttagtgttcaacttccaaaacactggaaatgctcactaaagcatacatagaaagctgatgagagaaaactttccataaaataaaaaagaaaaactgaagttatggaagaagatctgaacctcctgaaagtgtcctttatgtgtcagtgtattggtagagtattttgcctgacaacaaaaataacagaaatataggcagaacctgagttatctgaagacatgttcctacattccttatgtatgaacttctaacaattatatacaaaaattgtaccccaactatatataaagtaaccacaagtctccctccacaggaaatactacttttttttgttttttgttttttttagagacagggtctcactgaaacattcaggctggatgcagtggcacaatcatagctcactgcagcctcaaattcctgggctcaagcgatcctcctgcctcagcctcccaagtagcagggactgcaggcacacaagggtaacttttattttttgtagagatggggtttcactgtgttgccgtggcaggtctcaaactcctgtccctaagtgatccttctgcctcagtctcccaaagtgctgggattacagatgtgagccactgcacctggtttccttttatatcttaaatcactattatccttttatattttaaatcaatgtataacattataagttataaatcaactaatacgacttattatttgacagaactgtaaagcacaattgtaaagctgacacaggtaacagggtaactatctttatgagaagcctgccacaaggagaggtgaagggtggttgactctgatagtatgtgtcaaaactgagatggggtcaggcacagtggctcatacctataatccaaatgctttggaaggccaaaacaggaagatcacttgagccaagaccagcctggacaacatggtaagaccatcatctctacaaaaaaatttaaaaaattagccaggcatggtggcacatgcctgcagtattagctactcgggaggctgaggcaggaggactgcttgagcctaggagttctgggctgcagtgagctatgatcaccactgcactccagcctgggtgatagaatgagactcttgtcttaaaaaaaaaaaaaaagtgacaggggttaggaaaatgagaggaaaaatgatctagaaacaactatgaatagcaaactgattaagttttcttttgctgcacaaacccgacccgaagacctctccagaccttcctccaacatgaaactagaccacgtacagaccacttctgattacatttggcctcacccgcttttggtttttctcagtatgatgccagtccacatctgccacccagtactgtggccacaccctgaactctgacatcactgagaacttctccacctttcaaggcctgctgcgtagatagtaaatctaataattacacatccacattgtcttgattcctttgatcattggcagttttgcttggaagggtgtaagaaccagaataagaaaccctggagtaaaaaaaaggttgatgtttacttcttataatctctctatgcttagcatcaccctggagagaaggtcatagatcaaggaccaatttcacactgctaatgcatgtcattactgtaaggtgctagtctcattatcggagtaattgagagagtaattgtaggataactttgactaagaagggggaagagggaaaatgcagaggaatgtggggctgaaagaaggatttatgtatttttttaagacaagaaagacaagaaagacttgagcatgcttaaaagctgatggatacaagccagtacagagggagaggtggaagatactgaagaaaagatcattaagtccagagcacaggtttttgccagtgacaggaggcaagcaaaaaatgcccataccattacgttttgagatacagtggcaagcaggtgagaattcttctcttttctgtgaaatagaaggtaagaatgtctgctgagattgtggaggaggggatgacaggtaggctgaaagagaccagaaggtttaaaataggtattgggaagaatgagcaagacctaacagtgagagatgggaaatctgccagcagtctggaggaccacttgagaacctagcccaaatgcaaggatgaagacgtgtagagaattagctttatcaagggttaaagttttgttgggaaaaatatgacagaaggtcaagaaccaaagagactgaagacgctggcaagactgtcagtgaaatgacaaatctgggctgtatgaagcaggaaatgaatgaagaaagaggctgtggggagtcaaaaaaactagagaacattatgaagtcaaagaatgggtacctcattaatcaggtgaaagaaagagctgggagaatcaaagattgtagagaaggaagtatttaagtttgaaaggtcgaagatggatagctcaaggtgatgctaaaatccagaaagtattcatgacaacaggtaggtgaaacgcagaatcaatgttgttgagaggataagctgttgaagaagtcattctcagggatggtgaaaagccaccttagaagattcaggtaaaaagaacaattatgagtccgggtgccaaattcactaatgaacaggaaccatcaccaggagctgacaatgactggaaaggtgaataattggatggtctgagtcttgaaagaagaagtttgaaaacaagggtagaagaattaacttttgtaatcagatctgggaacaaaaagaatggcaatcccatatgctaacccagagatacgtggaacatgaatgaatgagtagcattcacttggaaaaggtacaaggcaggcaatgtcatcagaagacagccaggcagaagggggaaacgtcaataaaaagacattgaggatgtagcgatgtttgtttctcttggaatgttttcacagtaagttttggtaaggaagggaataatgggaaattgaaagagggtgtcagaatcacagagaaacatggggaagagactataagagaggccagatcatgtggcttgcatcgtgggcagtgactgaagaccacagggacgtaggtagtgttggccacaagacgtgcataacaatccctagtggaaaggagataactcaagcctcaggaggaattagttgtggcctgacttccaagagactaatggtccaagtgaatatgctggaaatgtgggttctaggactactaccacatgctagaaattactctgtccttgggaaagtgtcttcacctctctgaactccatttttgcacatgtgtaaaatcagagtaatacccatcacagagttgctgtgaagattaaacaaaatcaggcatatgagacacctagctcagaagtgaactatcgtgtacctagtttcttaggcctggcatcaactgaatacttcacaaagtaaagcattcattgtctgacgagaacaaaatctacccttcagtcaaatgaggggtaatggaactcttccctcccagcctcattctggaaagaataaggcaagttaggaccatgggtaaacgttcacacagccagaggaaaagggaagctactgcctctgaataagagatgactttctgctacatgctggccttgtctgtaattagatggcatgagtcagtgtctccatggcctagtcttcggagtataaaaccagagagccacagagctgaaatcaacacatgcgtaaatcctccttctgcccacaaccactaaccctatcctaacagaggtatttacaaagtgatcaacttgcatatggacctctttgcagaagactgctatatccttggtctccctgtttggaggacaacctcactgcatatggctgactcttgggtgaatcccaagtgtaccactgaaccaggctattagctagactatatgcctaaggttactaactaaaagctcataagctaaagcccactgcagtgttttccatatggtgttttacaatttttaaataagttggcagcattttgatacttggaagattttaccgaaaatcctgatgccaacttttcttgaaaaaaaaaaaaaatcactcaaactgcctcacttatgcagaggtgtcaacaccatgtcaggaactaataatattgtacttaataatcacatctgacaggtgttagaataagtaagctatttggggggagaaataaagttagatagttacctcacagtgtgtgcatacacatacaacttgcattaaatataaaaattgaaaatataaaataactggtgatgaactgagagtgatttttatttcatttttgtgttttactgtatattctataacacacactaaattttctatagtaaatataaacttgggccaggtgtggtggctcacaactgtaataccaaaactttaggaaataggtagaaggcttgcatccacgaggttgagaccagtctgggcaacatagcaacatcccatcgctacaaaacatttgaaatatatatataaataaatatatacattgaaatatacatacatatatactatatatgcaatatacctaatatgtatgtatgcatataaacttgtaaatttatttaaaatattttaaaagatgaattagataaaaacttcaaaagttcagcaacagcaatatttgctcagatataaaaaatggctatacagtagaaacgactgcagtattccttttgatgaatttcaaattatttaacccatgtgaatctatttctctcttctgtatctggattctaggctaaaggattcaaaggcattacatccccttaggatattttacagaacgtatattgttaggaatacttcctaactcttgagatgacaagataaatgtatggtatccttgtgggtgggacacaaagagaggtaagaaacaggcaaataacaagatttaataatatgatcccaatatttgtagcaaattttggtcacaaacgtaaagataatagaggttccattttctcaaagaaaaattaggttcctggaaaatgctgagatagtgtatgaccttgatggttttcaacaccacttctataatgtgcaggatttatctgtttactttaaactagaataagaccctatatttcaacccaaataaatatttgaaaatacttttgaaagctcggtaaattaagagtcagaaccacagaaagggcttaacttgcatttagtacacagattctcaaataagagggcattcgaagtgggtgagaaggaggggaaggcatggtataaataaaagtcacctgtggagtttcttcaatcatcaggtttccctctttttctcccatctaggttccccttcagacgtcccaccttcagaacaggaaataccccattctggagaatcagtactaagatacagataaaaacatatctcatctctcaagtgctctgagaggatatgtcccagtcaacattcctaacttctatccccataaggctctgcactgtcaagtgtgatgactgctcggcccaaattcccttctaggcagtaatcccatgctcacaagaaacatgtttgacactttgtgactccactccgatcaccactgattggattaggaggtgactaaccaacccaagcgcagccaatccataggtgcaacctctgtgatgggctggcatgaaaagataagcagagccgcatcctgctcttgagcctgtgtgctcagaaacacaagagattgaagcagtaggcaacagaaataaggtgaaaacagacaggataatagggtaagaagtcagggcaaggtgaatgtacaaagatgaagacatgacagtaggcaaaagctatgagacagagaaaagacatacaggataatagtggaaatacaaacagacacccaaatccaaggacaacagtggagttccagaggaaggatccataaacttttactgatacggtctctagagctatcttggatccagaataaaaatctggctccaatttttatgagacatcactccaataagactcctgtttttccgttttcatgaatattatttccaatatcatttcacacatatgctttcaataatctatcccaccccaacccaagctagcttaagtctctggtctatgcaatcaagaaagcatacctggctgggcgcggtggctcccgactgtaatcccagcactttgggacaccgaggcgggcggatcacctgcggtcaggagttcaagaccagcctggccaacatggtgaaaccccgcctctactaaaaatacaaaaattagccgggcacggtggcatgcatctgcaatcccagcttcccaggaggctgaggcaggagaatcgctggaatccgggaggcagaggctgcagtgagctgagatcatgccactgcactccagcctgggcgacagagcaagactccgtctcaaaaaataaaaaagaaagcgtacctaaaacaatctgatctgtgagcagccaaggtcaaggtcacagagctcgataaaatagagttcagaccattcagttcccagggtcctatagcaaattctcctacaatactacaccagaaagataaatgtgaattggaacaggtgaattttatggtatataaattaaaccttaataaagtggttaaaggactcaagggagggggactagagacaaagtatagagcagaacaactaaaactgacaccagaggaatcttcaaataaaaacagactaataatctgagtaaggaagaaggcagccttcaaatctcttgaagtctataaaacgagataagaaatcaatagacccttaacctcattctctggatcacaggatgagaatataacctttaaaatgtgagaagtggtttaaaaaaaaatgaagcgttaaacattaaacatcgagaaatcatgtgcctaagagcttcaaaactggtttggtacaacagccatgccccacacagtacatcttttggtggcagtgtcaaagatatgacacttgtgaaggatgaaccacatgtaagtccattagggaaataaaatttatctttattattttcttctaattacaaaaatatacattttgtgtaaaattttcacatactacaaaaataaatattttgaaaagtgcaagtttctccataatctagcccctgcagagagctactgttaagggtttggtatgtatccttccagacacctttatctgcatatataatatatttttattacctaaacacattcatatcttacaaaaatactctgcaatttgttttctgtctctgaacataccattttcccctgtacaataacatatatattaaacatttgttttaacagctgcacagtatttcactgcttggatatatcagtttattgaaccattctcctattgacattcaggttgttgttatttttttcacgaatacaaactttttagtgaatatcagtgacatgtatctcatatacttacatgactatttctgtcagataaattcctagaagtgttactatcaatgtagcatcctcatttgaggacagcaagctggtactgatcacggcagtctacctttaatctactccaaatctaacatgcaggccaggccatgaggcagaatagtaaggctgaaccagctaaagtcctagggctcctgactttccttgtgaaggaatccatataatcacctggtggagggggcaggtgtgaattgccagttcttctgccctcaaaccagtcagaggtttccatctgcatccaagcctggacagcctgactctgacaacagatcatgtggagaggccagaataaaatacgtggaatataagcaaagaaactgaggcatgcaattaattcagaaagacagaagaggacatgaaagatgcaaagctgtgtttcgttaaaacacagactgatttacctgttgcataatgtagggaaatggcactggatttcatagtgatccctcggatctgttcatcttctctgctgtccatgtaccttaactggaaaaatgcaacatatgcatcttcacttcccaaagaattaaaatgtaacattaaaatttgctaatttagatttttgttttaaatacttatatttaatttgttatttttatttatttttgtagagacagggtcttgctatgttgcccacactagtcttgaacttctagcctcaagtgatcctcccaccgtggcctcccaaagtgctgagattacaggtgtgaaccatcatgcccagccaatacttaaattttaacctatatagagccttttttttttttgagacagagtcttattctgttgcccaggctggaatgcaatggtacaatctcggctcactgcaaactctacttcccaggttcaagtgattctcttgcctcaggcctcccaaacagctgagattacaggcatgtgctaacacacctggctaatttttgtatttttagtagagacagggtttcgccatgctggccaggctggtcttgagctcctgacctgaggtgatccacccacctcagtctcccaaagtgctggcattacgggcatgagctaccgcgcctagccctctctcttttttttttttttaagatgatgggggtctggagaagtgaagttgattgaggggaagggaacatgaaaaattgaaaaacataaccactaggaaccataaatgtattgaaatactgcataccctccccagagtgttgctcatccaaatatcagccgtgaatgatggggcaggtcaagaacaacttacggacagtagcatttgagggaattctttctaaacatcaataacatagccattcttttcctatttataagctgtttgacaaattctgagcagagactgaaacagaagtctctagaagcaagagaagtctttattcctttcccaaattaatagattttgaatacatcttttttaaaaaaagaatacagtagaaaatatttgtaatatgaccatttagttgatgactttcataacactgtaatacccaccaatgagtgtctacatctcattttctaggccttgcagtgcatcagtactgacagtggtgtcgtttaaataaagatcccatccctttccaactccttagccctaagcaccagactaaccttctcctcctttctccagaatgattttcccttacccttcctccattctctccactgtcaaacttttgaaaaattcttaacctgtctattttctcctttctttcattcaaaagcaccaagaattatctgttgatatgaactgccacatttattcatccatattaattctgaaattttcagaaaagcttccatttccacagctctggcaaaatcaaagtcctaaaagctatcaatgacctctggcgaaacgcaataatcattctcaatcctcatttttcttgattccagtgcagcatgacagttaccctttgtgtgcatgtgtgttacgtgcatatgtgaaattcttccaagagtctgaaacctcttaatttacctccatctctccttagatcccactgctggtttcccttcacctctccaacctctcagtcagtccttccttcagaaagtctcagtcccttgtcagttttctataatgtatgtttttaagcactgaattggtatgaaacgtgtaatacataaataacaacacaatgaacccctgtgtatgcaccatcccatttcaaaaggaaaaaaaaaaatgtttgttacttttgaagtaccctgtgcccctggcttacaggtaaccactatcttgaattttatcttgatcatttccttattttctttataatttttaaaaatgagtgtgtcactaagcaatatatcatttagagtggcaagttttaagccttctataagaatcatacttaatatattatactgtcactttttctctgctcaatattgttttcctgagattcagccacattgacgtaatttattcatttttattactgtaggactccacctcacaaatctaccagacccattcgtccattgtagagaatgaaggaagggtaagggaaaatcattctggagaaaggaggaggaggttagtctggtgcttagggctaaggagttggaaaaggatgggatctttatttaaatgaaaccactgtcagtactgatgtacttcaaggtctagagaatgagatgtagaccttcaactggtgggtactgatggacatggagactgattccagttttttgtaactattactgagttgatatgaacagttgtgggtctcttgtacactccctaccagtagaatttctgagttattaaatctgcacatcctcaacctaacttgatatttccaaattattttccaaattgttggactgatccacagtggaatagtgcgtttcttgatccataacctccacagctgatattgctggactttattttctaagtaagatgggtgataaatagcatctcatggttttaaatttacatttatcctattattaatgggattaagtatccttttgtaagttttttactggccatttaacattccttttctgtgaattgcctatacaaggcttttgtccaccttcctactggttgcaatacagatttattttgttttggataggagttatttatagtctctgaatattagtcctttgtcaattatatgtgtgttattaatatttttcacagttaccaggcttgttttttccatttctttctggcatctttgatgaatatgtacttaattttaagtagtttattaaccttttataaaattgtttgcacatttttgtcttaagaaatcttcctttaaggtcataaaaatattagcccatattattttctaaaagctttagtttttaaataaaaaagcttttaaataaaaatgtcttaactgtgcaatttgtgtgtggtgttaactagaggtccaatttttttttccacagggataaccagttgcccaagaaccacttgaaaggttcatctttttcccacagatctgaaatgccagcctactattctgagccgtcagtcaatttcatgcctcagccgattccaggccacaggttacaacacatcaacacattgataagtcttgccagtgggtaagatgtatttccatatcttactcttcttcagtcccggctattaattggtttatttgctcttctgtatatatttttaaatcagcatatcaagttgaaatttttaaaaatctgttggaatttttactggaattgctgaatctacagatcaatattttttaaatgtcatttaaaaaatagacagccaatacgtaaatatggtatatccttccatttaagttttctccaatatctcataggttttgttgttattgttgttgtttttgaagagatggcgtcttgtgctatccaccaggccggagtgcagttgctgtcacagctctttgcagcctcaaactcctgggtttatgcaactgtcctgcctagcttcccaagtagctgggattacaggcatgagccaccatgcccggcacaggtacatttattatgctatttaaatggtttacgtttttaaattactgtatattacctatttattgctcacgtatacttcttttcaacagttttcgtatcctgaaacctgccaaattgttactaatatcctagcaatttatctacatttttgttttcttcctttccaaaattcacactttttatttttctttccagctttatcactgcaactagaacctccagtacaatctaaagtagaagttataacacaatgagcagaagggtgtgacagccattcttgccttattcctggctatgaatagagaagttttaacacttcatcattaagttcaatcttcattttaggttttttataaatatcccacatcagattacagaagttctcttctgtaactacattgcaaagaggttttatcacaatagatgttgaattttactacatgtctttatatctgttgaaatgatcatgattttcttcctttaatccattaatatagtgaaattacatgttaaaccaatcttgaattccttgggataaactcgatttggatatgaataatcatctttttatactatgctgaattgtttgttaatgaggatgataatttttgcatccataatcataaggttggtatataattctcctatattgtactatccttaacagacttttggtatcaaagttatgctatcttcatatgatttggagaatactgccgattgttgggtttttctctgctatattttgaaatggtttaagtaggactgaaattattctttgaatgtttggcagaactagagagttaaaccatctgggtctttactttatggaaagatttttgccagccaattcaatttcttaaatgactatagaataattcaagtttcctatttcttcttgactccattttagcaagttatgttttccagacatttttccattttagcacttttaagtttactggcacagagttgttcattatatcctattattaccttattaacttctgcagcatttttctttctgggtatcacatatttctgcctcctctcttttcttcttgatcatcttgctggtgttttgtcagttgtgttactcttctttaaagtcattcattcaaaaatatttatttatatatactatgctttctatatgtccaaagtacagtgagccacattaggaacattaccaggtcaaaagtgtcaaatgttcctcaacaatgtcaatgaaaaacaaaacaaaaaagtttcctagtcaagagaatcaaaaattgtctatattgctagtaattgtttaaattaataactttatatttttagagcacctttaagtttacagaaaaattgactgaaggttcccacatactctctcctcccacccacacagtttcccctattatatctatcttgtattagcatatggtgtgatacctttgttacaactgatgaaccaatattgatgcattatgattaattaaagtccatagtttacattagggttcactctttgtatttgttagctgggttaatcttttccaaaaacaaacttctggcttcactgatcctttctataaaatgtctgtttactatttcattaatttatgctttactatttcctttcatctacttacttcagttttgtactttctctaaattctcaagtggggaaaatataagcatttcattatttcactcaacctagttttcttcagcctcctctagatagtatcttgggccagcttccctcccaacccacacatcaattcccaaatcgatcttcaagtctattgggtctaccctgtggattcaattttgcttctccgtctcctcttctctctattctctgtcacctgataaaccctattgatcatatcctaaattcattatggaaacgaatatatctttatttttctactgccaagtaaattattccaagccctttcaactcatagctacaaataaagatctctttaattttatttcctcaaacgctattttcaggctaggtgtggtgactcacacctgtaattccagcactttgggaagtcaaggcaggaggattgcttgagcccaggagttcaagatcagcctagggaacatggcaaaaccctgtctctacaaaaaattagccaggtgtggtggtgtgcacctgtagtcccaggtacccaagaggctgaggtgggaggatcacctgagcccaacagggcgaggttgcagtgagccgtgcatgatcacaccactgcactctagcctgggcaacagagtgagatcctgtctcaaaaacaaaaaccaaaaaacccactattttcatcacaatcctcaggcacaagcagctttcctttgatacttaggttaacttttaaggtcttctataatcttattctccctgccagtatgttttctctgtcactagtctctaggcaaacactccactcaaatagagcacaacacacaaattagcctttatccgtcttatttcccactacctggtagcttttctgtcttctcctcaaaccactcaactcattcacctacaaagaatctcttgcgctgtgaaatcttccacaatggtgtatcatttgcttgctgcaaaaactcacttttgcacttaggataaagcaatacaaagcaatacagaagtaactatttttctcctcagcatttttatcttgcaaaatggattggcagcttttagacgcaagaattatgttttatacccttttggatggctgaagaacacagaaaatggttcatcacattgttgatagctaatactgaaatgcaacaagtatttataaaataataacataccttgcctgctaggcggctggagatgattccattgctagatataagacagtcagccagagtagtttttcctgttaaaatagcaacatcaattcaaatctatatcttttttaaaaggggtcatggatcatacctatagatttaaaatctggtcataagaattggtttagtaaagattttctatttacctatgctaggtgacaaaagagatttattagacttttgaacagaatatcatctggaaggacacagaggctagcactctataatgctgtaatcttatctccaaccctgtggatctactcaacctcatctgaaaagttgtcaagtaactttagagaacatactcttttgccatatttccccatgcatggcctcagctggaatttgctaaactgtcttaagaaaatacttacttatcaaagaaattcaggaacattatccatatctcttactgtttgtaatatagcatgtggagggcataaacatactgtaacaaccaatgaaacctagtatccaaatctaaacctaggaatctactttaaagcaaaagaatcttcgaatatatttatagttacttttattaagcagactacatacaactaaagtctatgagattttatgtgatataaacaggtgattctgtgtaaagaatgtcaggggtatgcataattactacaactgggttggagtaagcaaaggagggtttttttccttcaagacaagtctttattgcactttaggaacttcagcaaagctatggaatctctgtattgttcaaaccagagaccaatgagtaggagaactgaagatatttaacactgctatctgtctgcaatgtaaatatgtattagcatataatcctagagcatcactttcctgctacccagtaaagctgaatttattctaagtacaccaagtatatacctccctagaaaataattatcaagcaagcaggaactttgctttattcacagcagtatccctaggaccagaacaacgcttgtcatatagaagaccttcagaaaatacttgttgaatggatgaatcccaggttttttaggatagtagcagcttaacataattttaaacaatacatttaaagtaatttgttacaccccactaactttccacttgaataaattcataaagaaaaaaaaaacccttttatcagccttcacattctcaaaatgtgagcagtaaaattataaaaactcatggaggcaggggttactcactggatttgtactaaaactcattcacagctggcttcacttgtaagtgatccactatctgtctttctgtcagtttccatactcacattacttcagctcttctatcaatgacaacagccacctaatctctgactttggatccatcctaagcatgtctaccaatctaatctttctcatgttttatttgattacatcattcctgctccatgttttcccccaaaggctccctactgcctaatagtagacattaatgatcgttttcatggtgaagcgtttaccttccctctcattattatcacatttaatcctatagcctataaagcaggtatagttttcatcctgttttacagatgctgtatattgaagctcaaaaaggcaaggtatgtaacttgaaaatggagatctgaacttaggttgtctaactccagagctggagcactcaactcttatcccagttcctagctggcatgagcagctctatgagatatgactcagcctgcttcttcacctcgccaactggtccttcatcttcaggatggtaaatatgttttatttcatatgcccatcccaatcactttgctgtggttacctaaactaccaagaggtttgaaatcaagaggaggcttagcatgaaggagcgctatggagttacagcagtatctgtcagaagaacataccatgggttagctatctctgcctttcccatatactgggctttgaccacatatatttccctctccccttgatgacacattcccacctgtaatgattatctccatttgtcatcttgagcccccttcaagtgtcatctctaatactaattatgttgtgaggtcttttcctaacccctcacttcctaatcctctagttctcccaaccttagagtctacttttttctcttgtttgtctcattttgctctgctccccgttaaaacctcccctgggctagtgccctactcataaatctccaccttcagacatactaagcaaaatatcttgaacttaacagacgtttgataaatatctgatgaattaaataggatcacataccacagactctaaggacattatgtcaagactacagacattttatatgtaaagccatttcaaaaacaaaaaattcaagttctgctttaaaaaacaacatgacataatatatagaagaatgctactcactaggtaaccgtgttcatttcaaatgctttatagcaaagcaggcttccctaacatcacacaaaacttttaaagaaagaagacttgcttcttagcaaacatcactctcagctgtccacagcttcactccactgagacatacagagacacatctcccttatttatcaaaataagccatttaaaaagtattcttaccatggtcaacatgagccaaaacacaaatattcctgatgttggcagtgtttttctggagttgaatcatcttatccaaactgttgagcaccatgattacttatttcctgtgactaaaaattaaatatgtattacaaatggcccagaggctaaaggtcggggcaaaagaaaaaaataataataaacgctgggaggtggcaagcttctcaaaccccttaaaccaagaacccagtgaatgtttattgatgagatagaccaccaaggcctaagtccagttcgagcactaaagtcagtatcctaccacgattacacttaaggagtttgctcatccttccggatccaaaggctgcgatgaatcacgcagctcgaggggactgggtgcacagtgacaccagtaaccctgccggtggaggagtactccagtaaacatctccaggccaatgaccacgtacaggaagggttgcatccaggagggagagaaaatgctgaagaagatgctccctttctctcttcagtcttcccccaagtccctcattctgacattctcgctcgtcctcgcgcgaggtcaaatacccagctttattcctgcccatggagcccgaacaaagttttgggtcacgtgcttattatccaagcaggtgcactgccggtctttcattcctttctaaataaaaaggaaaaacctctacactacatgcccttcatttctgcagggtcccagattcgttctctttgaggatcctgggtccacacagacaggcgaccgccccggccccagacgggaagcggcactccggggaccgaagctcccagcccgcgctcggccccagcccctgttcccgcctcagagccgcagcgagcgggttcctccggcaccgcccaaaggctggcctaggaggttccagcccccagcgccagcccacactcaccggctgcagcagccccaccagccccgctccttctctcgggtcgcacccacaccgagagcttccgaaagtccgagagctctgcgggtccgacacgcccgcgcgccagggggcggggccggctgtcgctcgacctttcacccgcacgtctctgacgccgccggaagccggcgccgagtctgtcaccgggcatccctctgttgccttgactacggcgggcgctgtgggagtggagaagctgcaagtgctgaggcgcggtggaggaaagcatgggagccaagagtatgaggagctggtgtctgtgtcagatttgtagctgcgggtaagaaacggctggtgtagcggcgggcccgggcttgggagccgacctagggcctaggtgcacggagccggctcctcgggaaccctgagagtggccgtcccccggagatgaagggacgagggcgcagcgacatccccacttatcccgctccgcgaatactcgctcctcacccgcctgctacccgggggtaaaacgtttgttcgtagcccctgagactcccaatcaaggatgcaaagtaaaatgccacccgggccaggtaagtaatatatgtgaagccgcgacgggatataacgctggtgagtagtgggatgtgatccgactgggagagtgcatttccaccccataatcccccaccacgaagatgagaaagaacagtgctcaaggccctgagtctgcaacccatatcacattttctttcatctgtagctttctgtcctcccagccagaccatattcccattcccgtccaggcagcagttctttgggatccgcctgactgaaaagtcagtaagtagtccctaccctgaaatctagaatccaactgtgagtcctgcctaacaaccttccatcacctgtaaacacagtcctctccttcctcagcttcactattgacccagggattagatcattatttgctaagtaaatatgaacgttgtcaatccctggtgtatttgtaatcccattcaaagaaaacacctacatgttgatggaaagcagtttttttaatagtctcataataaacacagttcataattatatatagattaaaatatcaacaaattaactttgggtgtatgaatcctcagactggtgtgcaggagaaaatttttacttttctcctaatttatattcaacgcaagttcctttctcattcaactgtaaggaaattcagtcttcattatgttgagggccaccattggaatggcgtgattttacttcttgtttgtttgttttgggctgtggttgttagttttgtctttttaagggtttatttttattttttgacaatgcaataaatacacaagaagtatcataaaaatctaagcaaaaatatctataatattgtaaaacgccttcataattctatcttccacagataacaaatgttctttaagacttgttttacatatgcattgatttttttttttttttttttttgagacagagtctggctctcttgccaggctggagtgcagtggcgcaatctcggctcactgcaatctccgcctcccgggttcaagcaattctcctgcctcagcctctctgagtagctgggattacaggctcgtgcgaccacacccagctaatttttgtatttttagtagagacggggtttcaccatgttggcctccatctcctgacctcatgatctgcctgcctcggcttcccaaagtgctgggattacaggcgtgagccactgcgcctggcctgcattgatttttttttttttttaacaaaaaaagagaatattctgagcatactattctacaatccggttttttactatttacaatctcaccaacttccaatgatcatgcataaagaccaccctcattctcttaaataactgtatactattagcttatatgatatattggtcaaggttcttagttgtggataacgtaatctcctctggttagtctaggcaaaaaggaatttattaaggagtatatatatagttcacttggaagaacttaagaaatcattttcaaaataagcttccacaaaaattttaccacagaccaggactgacaagggagccactgcctctgccataatcagaaaattgcaacagagctgtagactccagaatcactcgtctcttccaaggtcaagaagctgccaagttaggaaaccagcttgcaaatcaagatgccgcctaacaacttctagctccaatctcttgttgcctctattatgttccatgcaagcaaaataaatgttgtgccttgactctctccttatgtagctctcttctgaatcaaagtatcatgtgaatacacatagtaggtgaaacctaaattgtatgtggaacctttctgcaagagcatgggaaattccctattagcttttcagcttctatagtgtaagaagacactaaattgttatgagacacttaattgctgtgcttccaccacatagggatagaccattatttattgattgtttttgtaaacaccattacagaggaaacagtttttgggggtttttttgtttttagttttttgagacagagccttgttctgtcacccaggctggagtgcagtggcaggatcttggctcactgcaagctccgcctcccaggttcacgccatttccctgcctcagcctcctgagtagctgggactacagggtacccgccaccacgcctggctaatttttttgtatttttagtagagacggggtttcaccgtgttagtcaggatggtctcgatctcctgactttgggatccgcctgccttggcctcccaaagtgctgagattacaggcgtgagccactgtgcccggcccagtttttggttttttagtaaagctctagaatttagaaattgtgagtttattagaggtctctgattaaaacgcagttataacacaaaatttttttaaggttaatctttcagtttattttttgcacaggcgacatcattgtccacgtggaaccacaaggatttatgaaaattctggggtgttttgccctacaactgaatatttggaaaaatatcctatgtatgacaatgttcttccacctcagagtcttaaagccaagcaagaaattcgagcatgccatggtaaaatggaaggaataactacatttaagtaaatatttagtaactatttgctttacttatttttctctcaactcttctggtgtcaataaagttttctagctatttaaattgaactgttcagttgatttaagttgaaccaatctaatagtcaagagactagttaagtcacaacttgaaaaaaaaaaacagaaaaatgagaattaagttaggttgacaaagtgtgagaagaaaaaagggatataaaaagttctatttttttttaacttcttaaaatatctcatatttatctactttccactgtcaccaccacctagagtagggtgtctaatcttttggcttccctgggccacattggaagaagaattgtcttgggccacacataaaatacaataacaccaaccatagctgatgagctaaacaacaacaaaaaaaaaatcacaaaaaaatctcataatgttttaagaaagtttacgaatttgcattgggcctcattcgaagctgtcctgggctgcatgcagcccataggccgcaggttggacaagcctgacctagaggaatgcagtcactttctaagtataatatctgaatctactctagtttttgcagtttgatctgttttcaatacttcagcctgcccaaataattttaaaatgcaaaccaaaccctatcacttctctgcttaagatactcttaaactttcccattatctttaatataaaccagaatccttaccaaaatcatgtagaggcatggtttgctcactatttacttctctaattcattttcactgtagtgtccttttcactcttttatgctccattccatgggccatttttcatttccttgaaagtgccaggtttcccttgtctcagagtcttccaagatactgttttccctacctgtagttttccttccctctcctagctaatgctcattcaatctatagatctcaactaaattatcacttgaaaaagccttctctgagacttttcagattaggtaaaattcttctatgtaagctcccaaagcaccttcctgttatttatcattagattagtttcagtgtttcatgaaagcaggaactaagtctattgttatctcagcattctatttttagaaaacgaatacaatgcctactagcacatactaggtacccaatatttgttcagtgagtgatgaacaaaaatcctcttaagtctatacttttcatttggacttaccttttttgatctctgtatttttgtcaggtggattaagtattacatttactcattattttatttaaactgttaatgtatgtgctgtattcaaggtacaatcttagtgttaagtataaaaatgtcaagtttgtgaaccccaaatatctgagataggtgtcagttaatttagaaagtttattttgccaaggttgagggtgcatgccagtgacacagcctcaggaggtcccaataatatgtgcccaaggtggtcagagcacagtttggttttatacattttagggacacacacatcagtcaacatatatgtaagatgaatattggttcttccggaaaggcgggacaactggaagcagggagggagcttgcaggtcatatgtagataagagacaaatagttgcattcttttgagtttctgatgagcctctccaaaggaagcaatcagatatgcatttatctcagtgagcagagtggtgactttgaatagaatgggagacagctttgccctaagcatttcccagcttcacttttccccttagcttaatgattttgggactccaagatttatcttcctttcacaagttgaagttcctgctttcagggaactcagacatcatatttctataatttagggttttaaaaatgctctgtaatagctttagattttggtgttagttattttcatttcagatgcagctcattcttatatagcaaaggtggagactttccaacttttagtctaatatttatatttttaacatttcaggcattccttgcagtaataatattttggtgactctagttactagtgtaggggtatggctcttccatagatggaagattttacttagtcctcagattttggtatgcagtagtgccatctagaagtgttaaaattgcagactccagagctctatctaaaagagccagtagataatagagtgggtctcaggaaactgcatttttaaccagcattggtggtgattctgttgccactgattgagtgcagcaggtcaggcactggactgcttaatgaggatgacatggaacataaaacagagaaggtctttgctttactgttgtttatagtctgtgggaaagtccagaaataaaaatatcagctaaataactaagataattatggattatgataaatgagatgaagaaattgaataactggttgagattgattaaatgggaatggttgttcttttttcttcactttaatttattaatatttttttcttgatgccttaatggttcatattagagatttgaaataaattttacaatatttgtgtttattgaacaaagattttgcttttaaccagttctaaatgtagaaattgagaaaatttaacctgccatatctttcttttaaaaggctttccaattctggatttcccctgttgacttattcaagtaagccttaataatttaaaaaacaaaacaaaacaagaaatgtcccaaaggtccatatatgccagtaaaactaaaatatttgtttattaaagtgtcatctcttcacttagtaagacatcggatcttttctttatattttcactgggaaactagcagtatttctaagagtcataatctaggagcttgaaactcttgcttgactctctcatgttggctgtgttgactaggcagtagaaagtggatttatctgtacaaacaaagaagcattctgtacctttgtatagtacaggaagtgactgtgtaaagaggtgtctgaacttgtacaagattttggatcctttatagcagtacagttgtagctcacttagatgactgccagagttggcaggaagcctgccctgaacgagtaggattctagacacatcaaatgtttcaggatatatcagatgaataagactgcattcaccctctactactactccatagaaagctgctttgggtttggaggcatactttctgacacttaaatagtctaaccagagaaactgggacttctgagcttactctttgcttttcccttcctgattctctcacttcctgactgcattttagcctattcccctctagttcgtatttgggaagagcaaagaacaactcagatgtcttgacaagcagaggtatgtgatttctactactcttcatccattaaataaaaaattattaagcatttattaagcatgaagcactatactagtcacctggtatacagtggtgaacaaaagcagtcatgatctctgtgctgacagatattacaatctattagaaatggcaatcaaaacattactcaaaataactctaaaactgcaacagtgataaaatctatgaaggacaggcacaggtaccttgacaaccagaccaagagtttgactttatcaggggaatgagaaaaatgagtcaaaacctgaaggatgtcaaattaactggattaagagggggaaggaaatgcattccaagtagagagagagagtagcttgtagcaggaaggagcatggaaaggagaaaattgtcaaagaaagccaggtggagcagagaaagcaagaggaaacaacggtgagagttgaggctagtgaagaagaccaggcagagcctttaaaccatgttcagtgttgtctatgtcctacagtaataagaagccatgaaggtttttctgttttgtttttttggtggagggtggagggtggacttggggaggaagaaaggtaaggaagaggctagggagatgagggcaggaatgacttgatcagatttacatgagaaagaattacttcaggtgccatgtggagaaaagattggagggagaactaaagtggatgtgggtaaatgagtttcgaaagttattaaagtgattcaaatgagctgttgcaaaaactttgcatattatggtggtggcagatgtggagaaaagtggttagatttgagggatatttatgaggcaaaattgacagtagttgatgatggactagataggggagagaattgaggtataaagggtgagtcctagatttctgactatgcgtctgaaaggatggtgatagtgttcacttaaatagagaaaaagcaaaaaggaccacatttattgaggggaaatagcgagttgatttgggacgtattaagtgttgagttgccatcgaatccaatggcattgaatccaagagaccatcatagatactggtatgaagctcacagaagaggtccaagctgagatgtaaatttgagggttatttcgatctaggtagtgatctaagttgtgggagtagaagagttatcctcaggagtgaacagtggatgagaagaagaatgtgtaggtaggtccaagtcttgaggaacgctaacatgtatttaatgatggagtagaggtagatgaagctacataggaaactggaaagaaataatcaggaagtcgggaagagaaagtttcctagaaacagacagtgtgcacaataatgtcaattactgttggagaggtcaggtaagatgaggactaaaaatgttcgatgaatttaatcacatggaagacattgtgaactttagagctgtattagggaagtggcagtgctggaaaccagactgaaatggattgaagtgggtgagaaaacagttaattagtctaagaagttatgttgtgaatagaagaattcagtgagggttttgggtttctttggggaacttacagacatacgcagcaaatattggttaatacaagatagtttaatcacaaaatgagtcacgtgtcaatagagtccagaagaaaaaagcaatccctgaagtcttggggtagtaatagtggtggctaccatattgatcttactatgtacgaagcagtcttcaaagcatgtgtgtatatccttaaaacaactctgtgagatagaagatattattgttccattttatatataaagaaactggggcataaacaggttaatgaagttatccaaggtcctgcagctagtaaatgacagaaccaggatttggacctaggtggcctgatcagtctaagtttgtggtcttctccattcctcagtttttacctcagtgtctgcagtactacctctgtcacataatgttacatagtacccaggttggctgcgttaccatctggcatccatccatgacaaggacttctgggagatccaaagattaggaacactcaaatctataatctgaatgtgatttatgtctaaagaccagagttactaatcatttaacaataagcgagaaaacagcatgaattcaaaaagaagaaagtatgccaaaatagtttgctggagactgtaagtaagatgaataaggactttgacaaagtggactcaggggtaatatattttttaaacttttcaggtttagtaaattttacctgaaatttccttccaggttagaaaaaaaatcaattacttgaggatattatttactgaagatccgattaactgagatctattgtaatgatgttttaaaaactaggatttttgatatatttacttttctcaagatatttagtcactggataggaccttataagaaattcagttacctctttcaagtagtttatcaactattaccattttaatatcttctcagacttttccagtaaaaaagaaaaaaaagccttgacattttccatacttcattgaaataattaggaataaaagaacttgtgaggctatgtttcaaatttatatatttcaggtcggattattgtccttatgaaatagttaaacagcctcgccatgtgccagaagaatataaaccaaaacaagggaagattgatcttggtactacctacaaacgggatttgaattcgtataaagtgcagcctgtggcaatagtccggcctttggagagacaagttaaaaaaggaaaattggacactgtcccaacctataaaggtaacttgctgtttcatacatgaaggagccaaaaaactaaaactcacttccagctttaacatctaatatcaaattataactttggtgtgctgccaaacttagcctccatggcttaggaaagaacatttctctctttggcaaaatagtattgtatagtaacaaaagaaaataggccatttgtctgattgagtggtaaaagacccacaatcccatccaaattcatctactttgttagttttctgtctcaaaacatgaaaaacaaaggatgccattaaagaagcattatgtcacatttgtcactttgtgtcacatttagttggcattgttcttttcttcccatcctagaaaaagttgaaactctaccgagagtattgggatctttgaggtcaaataaatagcaatgcttttctccattcaagtcctgaaccaacctataaagcaaaagagttgccagatggagaagcaaaatactgcttttacactgataaaggacaaagtagagaatgaacttttcatctgtaagcagacgcttcctgatactgaacctcagaattagataggcttatctaccccatgatagacagtgctagactaccacataggggtcctgctcctctaagaattctgggatggtggaagggtgagaatactttctctttgcaggcaactgacttagaggagtacaagttgggccatgtatgcttttctttccaaaaacctgtttttttgttgttgttgttgtttttgggttttttttgtgacagagtctcgttctgtcacccaggctggagtgcagtggcacgatcttggcccactgcaacctccacctcctgggttaaagcaattctcccacctcagcctccaaagtagctgggattacaggtgcacaccaccacgcccagctaattttttgtatttttagtagagatggggtttcaccatgttggccaggctggtcacgaactcctgacctcaagtgatccacacacctcagcctcccaaagtgctaagatcaaaggcgtgagccaccacgcgtggcccaaaaacctgattttaaaatactctagtacttttgaggaatggggtctttgttttttaaacacaggctgtttttttttttcaagatggagtcccactctgttgcccaggctggagtatagtggcgcaatcttggctcactgcaacctctgtctcctgggttcaagcaagtctcctgtctcagcctcctgagtagctgggattacaggcacccgccaccatgcctagctaatttttgtacttttagtagagatggggtttcaccatgttggccaggctggtctcaaactcctgacctcaagtgatgcacccacttcggcctcccaaactgctgggattacagatgtgagcccctgcacctggcctaaaaataggctattttaggcctattttgattttgatttatgatagtagatattacttttatatctttttattaataatgtaattacatatataggattacatttttccattggttatgtaaaatagctgaatggatatgtcctaatataaaacacttttgtaagagtgataccatcaataatcaaagtaatgattcatactttatttaggtaatagttaaatgcctattttatctttaaatttcacgcctacccattcaacgagtaagtaaagtgcaggatatcaatatgctttcatctatcagcctacctattagggaggtcaagaaaatgttttttctgttttttaaatctttgagcacataacatactacacaaagaacaaattgtgaagactatgtgaatggtgaagaagtatattataattaaatgtagcatagagtaattgctgataaatagattgatatgcgtaggagaaaatgtactgtgccaaatttggcataaataataattgatgaaaatgaatttgttctttttttgtttgttttttgagattgagtcttgctctgtcacccagactagagtgtagtggcatgatctcagctcactgcaacctccgcctcccgggttcaagtaattctcctgcctcagcctcctgagtagctaggattacaggtgtgcgccaccacgcctggctaatttttgtatttttggtagagacagagtttcaccatgttggtcaggctggtctcaaactcctgaccttgtgattcgcccgccttgtcctcccaaagtgctgggattacaggcatgagccactatatttggtctcttatacaatcacagtaagattttctttttttctacaagatccataagaaaaataccagtaatactgttgtccccgatgctgggaacatgtacacacaatacacgcacacacttataccaacactactagctttccatgacctgggtttcctgtagattctgatacttccactcctatggttgtagttcaaggataaagaattttgagttcctctggcattctcactactgaactttcttagtcaacaaaggtgatattttgtatttcagattttcaggcatgagacaacaaaaacactaagagccaaggttgtacttccacactctgtatgaatgtgctgcaggttttgtagataacctatttaaaaacaattctacagctgaagagaagccacaatgggaagatactctcactgtcctcctttgggaggccaaggcgggtgaatcacaaggtcaggagtttgagaccagcctggccaacatggcgaaaccccatctctactaaaaatacaaaacattagctaggcatgatgatgggtgcctgtaatcccagctactcaggaggctgaggcaggagaatatcttgaacccgggaggtggagttgcagtgagccaagattgcaccactgcactccagcctgggcaacagtgcgtgactctgtctcaaaaaaaaaaaaaaaaagtatttgaaataaataaaaatagagacacaacataccaaaacttctgggatgtggcaaaagcagggttaagaggaaagtttataatgctaaatgcctacatcaaaaagatagaaatatctcaaattaacaacctaacattgcaaccaaaagtactagcaaaataagaacaaactaaacccaaagctagcagaagaaataattaaagtcagagcagaactgaatgaaattgagaccctcaaaaccatgcaaaggatcaatgaagcaaaaagttcattttttgaaaagataagattgatagaccactagctagattaacaaaaaaagacatccaaataagcacaatcaaaaatcacaaaagtgacatcacaattgatcccacagaaatacagaagatcctcagagaatattatgaacttctctaggtacacaaattagaaagtctagaggaaatggataaattcggaaacacaaattcccaagattgaactaggaagaaacagaaatcctgaacagatcaataacgagtaaggaaattgaatcagtagtaagaaacctatcaaccaaaaaaaaaaaaaaaaaaaaaaaaatgccccagaccaaatgggttcacagctgaattctaccagacatagaaagaacagctggtaccaatcctagtgaaagtattccaaaaattgaggaagaaggactcctccctgactcattctgtgaaactagtatgatcctgataaccaaaatctgacaaaaacacaaaaagaaaaagaaaactacagaccatggtccctgaacacagatgcaaaaatcctcaaaaaatactagcacactaaatccagcagcacatcaaaaagttaattcaccacagtcaagtgggttttattcctggtatgcaaggatggtccaacatatgcaaatcaataaatgtgattcaccacataaacagagttaaagacaaaaatcatatgatcatctcagtagatgcagaaaaagcatttaataaaatccaacatcacttcatgataaaaactctcaacaaactaggcattgaaggaacataactcaaaatagtaagagccatctatgacaaacccacagccaacatcatactgaatggacaaaaaaccggaagcattccctttgagaactggaacaagacaaggatgcccactgttatcactcatatttaacataatcaagcaagagaaagaaaaggcatccaaataggaaaaaaggaagtcgaattatgtctcttcgctgacaatgtaatttatacatgggaaaccctaaagattctgccaaaagactcctggacctaataaatgacttcagcaaagtctcagcatacaaaatcaatgcacaaaaatcagtagcatttctatacaccaataatcttcaagctgagaatcaaatcaagaacataatcccatttataatagccatacacactcacagtacctgggcatacatctaatgaaggaggtgaaagatctctacatggagaaggaaaccatagactacacaaatgaaaaagcattctatgatcatggataggaagattcaatatcattaaaatgtcatactacacaaagcaatctgcacattaccaatatcatttttttgcagaattagagaaaaactattctaaaatttatatagaacccaaaaagagcctgaatagccaaggcaatcctaaacaaaaagaataaaaccagaggcattacatctcctgacttcaaactatactacaaagttacagtaaccaaaacagcatggtactggtacaaaaatagacacatagaccaatggaacagaatggagacccctgaaattaagccagacacctagaaccacctgattgtccacaaaattggcaaaaataaacagtggggaaattgtttatccctattccataaatgatgctggaaaaactggctaaccatatgcagaaggatgaaaccatatgcagaaggtgcaagaaggatctagaattttaaagccagcaaatctgaaaactgtgtatctagtaaaaatagcctttaaaaattaaagcaaattaacaatgttttcagacaaaaaaagaaaaagctgagataccttctacaaaaagcattaaaggaaattcttcagttaaaaggaaacttattccagatagaagcatgaaatgcaggaagggatgaagcacacagaaagggtacatatgtgggtaaatatgaaagaatattgacaaagtcaaaattactatattatgtttttacacaaatataaaagtaaattatgttagaacagtagtacaaaaggcaagaggatttaaatagaattaaattgcttacaggttcttccatgctagaagtggtaaaaatatccatttaagttggagccagaaaaatctcataataagtcaaaaattcatttttatttttaaaatatagaaagttaaaatagtaaagtggaataatacaaatgccatttattaatacaaaagaaggcaagaaataaggggtatgggaacaaagaagggaaaagtcaaaagcaaatagcaatacaatcaacttaagcccagctagatcattgcattaagtgtaaatgaacaaaatattgtgattaaaattcaaagattgatttttcacacattaaaaagatattattttaaaaaatatgccaataatttacaacttacataaaatggataaattttttgaaaaatacaatttaccaaaagtaacccaagaagaaataaaaagtcaaaatagccctatatctataaaggaaattgaatttgtagaattgaaggtgtaattttaaacctcaccataaagaaatccagaatattcagattctgtgtaggatgcagaaggctagaaagattatgttgccaacataacaataagaaaaagccagataatctacaaaatcataaatgtttatgaatcctttagaaagctgagatcacaggttaaccaattagcctgacatctgaggagaaacaacttccacccagttgagacaggaggcaagcactgtttcacccaaagcagggcatggaatgaagactagctgttacacaagtgaataaaataattcattacatctttaattgctaaagacttgagtatgagctactgcgagagtatagaagctctgagaacttcagacactaaagggagagttcaaaaccactcatagactcttccctatggatgttcactgtgtgatcatgagaaagattgggagaaaggctggagaccacagaaagtttccttcatagtgcgggcatggagagaaaaatggttgtttttgcaaaagaaaaaaaaaagcaggaagctccatttgaatgcctctaacctacagagcaaaagcattaatccactgcaggaaaggcaccactctgacaaccccaaggaataggtgaagatgtattgcaacttgatgaaagacaaaggaaaaacaagaagaagaagcaaaataaaaccaaaccttgaacatgaagaaagaacaggaaactgtcttgggaccaacaattagagacctactacatcaagtgaaagggcaggtgctctgagagagccctgcttctgagacccaggggcacagggcctgcctaagattgaagctggactgggacaacagagaaaccaccacacacccgctttccatttctcaaacacaagatcctaagcttcaaatatacaaagcagcaagaatttatagtactaacataagaaatgtgaaaatatgcatttgtagttggagacttcaacactgtctctaagtaatctatagaacgtagacaggaaatgaatatggatataaagacctgaacgacactatcaacaatgttgtccaaattgacatttgtaaagcacttctgtcaacaataacagaatatacattcttttcaagtgcacttgaaagcttcatccagataaactatattcagagtcataaaaaaaaccttaacaaatataaaagacttgcagtcgtgcaatgtgtgtttttgatcataacagaattaaattagacatcaataatagaaaaaaatgtggaaaatctccaaatatttggaaattaaacagcaaaatcctaaataactaatggctttaagcaaaagtaacaaaagaaattagaaaatattttgaatttaatgaaaatgaaaatatagtacatcaaaatctgagagatgcatctaaagcaatgcttttcagaaaatttatagcatttaaggttcatattagaaaagaaagtcttaaatcaatagtctaaaccttcattgcatgaaactagaaaaataagagcaaattaaatccaaagcaaagcagaaggaaataaatgaggataacagcagcaatcaataaatttgaaaacagaaaaataatagagaaaaacaatgaaaccaaaaattggttctattaaaagataatgaagttaataaatgaaaagagagaagacaccaattacaaatatcaagaatgaaagagaatagaccttatagacgtttattttacattgtggcctcttcttttttctttttcttatttttgacaattttatcaggttgccattcattccatatttgcttcaagaaggaagacattaatatttagaaggtaatatcaacagtatttgaaaaccacttgaaaaggagagaaggaaatgagggagagaaagtcaattaaacagaaccttagcctgagatgccaaattcataatagaaactttgttgatgtgttattttctggggaatgtgagtctgagtgagataattaattggggcatgctaagttttcatttatctgagggacatccaaataaagatgtctagtaggtggataaatatgtgggttggtgtttgaagggaggtctgaagtagggattcaagtttgggagtcaccaccttacaggtagtattaaaaccatgggagtagattggtgatatgtagattgaaaaagctgaggccgaggatgatgtccccttactttctaaaagtagtttccaattcctcggtaccacaagacaccacagggagcagtcccaagtaccaggaaaaagaactagcataagcaactcaagacttttgtcctcaaagaagaacctagaacagctcactatattaaaatggggttggagctgtgtatacaaatagtgggcaagtgcatgcaggcacttcttggacttaaacctgttcagaagagaataaactttctaaccagattttagtggctagacataaaaagtgagctgaggaaacatctaacaagggcgatagtggagctgccacataaccaaactgtattgttagacatggacagcattgttttcttgtttttccataagtatcataaaacactaaaaacagatgataatgattatgatgttttaaagatactgctagaatgttatcaaatattccataacagataataaatattccaggcatatgagcataggcatatttatagggagaaaatcaattttctgcaattatgtagaacttacattcatactattgtatgctatcacatccatctctcagtgtccaaattcttgcttccattttgaaaaccaaagctggtttggtgagggagaaatattctcttctgtttactctcttataatgaaaatcttttttctcttgtgtggtagcaagaattctccctatatgattgtgtggaactataaaccttcaataacatctatgattccttttagctagtgaaaaatagtgttatacttttatactgtagtttgcaaagaagagagattccctcatggtacctcaagaaaaaaaaaagactctggtaaagcttcatgtgaactgaaaatggaaagctatcaggtgcccagggagcttgaaggaagagcttttcccttcatctctgcaataagctacatgatttctctcacagcatcttcacttcccttcactcatctgctctgattgccactttactaactggccacctctgcctagttatcatttctgtttctttacaggtctattttgaatgtaacttcagctttccatagctcttagctttacctcctggcatccttttcaattctcccatttctatctcactcattattttcaattttaggtttacaagaataacaatgcttgatctagctcatcttttctgtcagtttgtcttaaaggtctctgctggcctaaaggtcacctattcttgagtcaggtacacgctctcatccagacatcagtaacttaatcatttagtccaatacttggccattttggcagaaatggatacgcattttttctcttcaaagaagatatccacataataagttttcaaagtttgacctttcctgtaaatattgcatagactttagtccagattttagtacattatcctgtgtaataaatttctatcttttataaattaacttttggtatttagaaatacatattttggggtgaagtcaattctatggtatttcctagcttactatcttcctcatggagaaatagaaaacacaaataatccttagttgaaatataaacatttcagttttagtgaagtgtactatcaccaacttgtaatggtgttacaagtcatcattctgcatacaccagagtgacccaaaatgctccacagtctaggtaaactgcaggagtaagcttaaggttatttaacttccaaaccccagatctctgctctgatggtcacttgaaattctacaatttcaaacacctctgaagacattcagttaaggcctctggcctctagatggccctctatcttttgggaatgccttaaagtccatttcatgagggaaagttgaagccagtgatctttctgggatagcacaagttaccctgtatctttgctcaaggaattctttctgtaggcttcctagagtataccagaattaaatttttctcccctttgatgagtctctccaaagcaaggagtaatacctgtattacttttgcccacccatgaagggcacttgattttatttcaagccctggcttttagacgtaccttagcattttgtgagttgtaattaaaatcccaacctcttcctaggaatacaaccataatctcctaaactctgtcctcacctccaacacagtccttttggctttcaagaactatccacaatcaggctcagatgtgcttttcctttgttatgtaatcagatgaatctgaaagtggaaagttacatgtattaaagtgaggagatgggtagaggaaggtggaaatgaagaaaaagaacgaatctgaaaggaatcagagaaactgtattctgatactattgtttagatttctaaaggaaatggaaagatgtttggcaatgagagaagtcagttatgatttttagaagatggttgttttcttcagcatttaaaaatgtttttgctttgttttaattttcaagacgattatagagcttgggaccttcataaaagtgaactttataagccagaacaaacttaccacccgcctactgtgaaatttggaaattcaactacatttcaggatgattttgttcctcaggagataaagcctaggcaaagctttaaaccctcctctgtggtcaaacgttctacagccccttttaatggtattacaagtcatcgccttgattatatacctcatcagcttgaactcaagtttgaaaggccaaaagaagtttacaaaccaactgaccaacgctttgaggatctcacaactcaccggtgtgactttcagggtctcattggtgaaactgcaaaactctgcagacctgtacacaccagagtgacccagaatgctctgtttgaaggaagcactgaattccgtgaaagttttcaaccatgggaaatcccaccacctgaggtcaagaaagtaccagagtatgtgcctcctacaggtagcatgctgttaaacagcacaagccatcttgactatgttccatatcaggccaaccatgttgttcccatcaggccagtttctcaaaaaagaagtaacaattttcctttccaaggaaaaagcatcatgaaagaagattttccagcatgggaaagttgtcgtcaaggacttattaagaagcagcagcagattcccaacccatctggaaaatttgatggtttgagcactttcagatctcactatgtgccacatgaattgatcccaacagagagttgcaaacctttaaatattgcttttaagagttctgttccatttgatgatgtaaccatgtactctgtagagtacacaccgaaaagacaggaaatttgcccagccagctatccctctcctccaggttatattttcgacaatacaaattcccaaggtcataaattcttccgcaagattattcctgcagtgaaggccttctaataaccaaaatgtgcttaaaaggaaggtactagcaagttgttgtttttccaagagaaaactcaatttttatagttaaaaaatttatgatataataaatcattttttatatttttaaacaagaaaattggaaaatatattataagaaatcagaatcttaaaaccattttttattgatattttaatcaagattgttctttaatgtgcatttcagaaggttgaataatatgcattcccatgagaactattttagtattcaacatactgcttagtagcttgtccccagtctattatcatttgtaattctgtttataattatggcaattgtatggttattcacataccatttgtcatttatcaagcacatcaggattatctagaacaacattgaaaatgatacatggattcctcttccaaggcaacaggattcattatactcagacttcacggcatctacatagcatccactgaatcaagttttggttggtggtatacagactgctgcactgctcctcaccatgttcaagttagcaagaggcactgtggtgtggcaaggaaaggctctgtgtgctgggaatcgaaggacttgagttcaagttctgactaataattattattatttttagagacagggtctcactgtcacccgtgctggagtccagtggcataatcacagcttactgcagcctcagcctcctgagctcaagtgatcctcctgcctcagcctcccaaatagctgggactacaagggtgtgccaccacacctggctattttttttaaacatactttgtagagacaggttcttgctgtattagtcaggctgttcaatctattggccaggctgctattgaatcccaccttggcttcccaaagcactgggattacaggcatgagccactatacccaacctgagtttaagttctaataatatagatttctatttgtactaccttaggcagtgactcatatctctgagcctcagtgtctttatttgtaaaatgatgtctgttctcaaaaagagtttgttttgagcatcagactgtatggtacattttaatccttaaagtacaaatgtggaggatttttttttaaaattgctcaatctctttttgtacttgttttctccttttcaaattaggataattacttactcaatgctcattttctggcctgtagcaaggattgtaaaataacctaatttgctttgagcttatgagtagtatatacttctgagaggagtcttgtcctttaaaacttcatgagcacctgagaaattcttaacagagaatggaaagcttggaatggggtaaatacagtggtttgaataacagtatttgcagaaaggaaaaagtattatttgctagggtagttttaggaagactgacagctctgaagaaatctttagggtaaatgtaggtaattttgcacctaattgccaggccaagtcactgtttagaggaagaaccagccccagcagggggcataatcacctggttcacctcttccggtgtgaagataagtgataaggtaaagaatgatgccagtaagtatagtagaaacactctattgcatttataaatgctaaaaatttccgaatgaattaaactcttattgggtggtttctttttttaaaaaaattaaataattgcattatgggagaatatgatttattttagcataaagtgaattttagtcttttatggcttcagaattatttcaaaatatactttattgaaaatcaatatttggttattttaattgttcaaaagtaatttgttctttacatttattagtaaaagtatggtgtgtgaaactatatttccatgcaacataataaaatcaataaaaggaatggattttcaagaaatcatttctttacctaattttttttaagagagcattttaataaagtcctgtctaggttaacctatacataagtagatgttcttactttttaaatacaaaacaatgtaatcagaattaaaaagaagggaatactacagcactctgtcatcccgtcccatattccaatgctggatattcaaatcactctgtaatttaataggggtggtctcctccctggacaaaggtcacccttaataagacatctactagagtttccagaggcaatttgccatgggataaggattgaagatgaataatggcgtttccccataatctaacactcagtataacaggtgtgaaaatagagattgaaacagagaacaatgtaagacattcagcctaggagttcaggaaagtctgccttagggagaggatggacaggtgagctgaatcttggaagataagtaggaaattgccagatcaagaaaaatgggaaggtgggaacagcataaaaataggtacagagggaccctctatctctgtgaaagagttaaagggacttccaagctacgttggtggaaagctagcaatccctgagtcattctcctgttaggcctccttgaaatactatgtggaaacacacacaaaaaacattttaacagggctggaaactagtaatattactta

SEQ ID NO: 590 - DNA, 145277 bp, Homo sapiens
tagcacatacatagcatttaccccttcattttcaaatgaattttatccttttccccccattgtttttgaaaattgaatctttgtgaaaataagggttaatttaacataatcttactgtaggttcaggtgttgtcattatgaagaaacacacaatcacagaataaactagggaaaggaatcttggtctgttacctaacaatgggatttttggcatttgaactgtgtacttggtttgactggaaatattatcattccattcttggtttttaattctgtaaaagcaaaattcatgctccttttcttcttttacaaatgagagagaaaatgacttgctctttttattgctatacagttggtaagaagttgccactctttccatctacttcagtcagcttttctagtgaggcgtactcaggagcctagccctgttgcctattgcttgtccagctatagacagagcccgtggtattgaataataacatatcttaccttttgtccttgcccaactactcttaactcagatgtccagtagaatttgttttatgaaatatctttttataaccatattcttggtaaaatatatgcacatgttgaaggatacttgtactatatattattagggttggactgaaatgaaagatttcaaaggtatttgtttagggtattagatcctccagtgatgtatttctgatcattggattgggtggtgtcctaagagaaaggcattttaaatagtgtcatgtcctaggaaaatgttttgtttaaacagtttactaatgttattttctcttttttttccaagttgctcattttgcttctaatacttcttttgattgtaaattagggtgcctaattaaatttgaatgccagagaaacaacaaataatttttttataagttgcacaggtgtcttgtattgtgtgagcatcttgtatttatttgctaaatctggaagccgtacttgaacgatttctgaagtttatagccaagatgacattaagtccaacattcattctcttgaagagtttgtataaagtactatggtaaaatgagtattgcacataaagtcaggctagttctgccactaaatagcttcatgacctttacaaaggcacttgacctctctgggccttgggtttgtttttttttaatctgtaaaaattagaaggttggattaaatggtttctaaattctgtaattaaaaagatgctcagtttttcccttctcgatatgttagtaaacatgagacaaaaacaaaaggttggcaaaaatagtaaatagttatcatagacttttctatatgtatattactagtagatttatgctaactgtatgcatgaaatatctaggagtaccttctagaggatgtgggactttaacagggccttagtagatttcatgatactaggtcataaggaacaatataagtagtgacactaagtcacaagtgaagtcacatgtgggaattactgagtggatgaatttggcagaatcagttttgaaagagctatgaattcatgagtttgtattctaatactaactatatagagaatgaagtttaatgtttctcaaaaaattttttttttttttttgagacggagttttgctccgtcacccaggctggagggcagaggcatgatctcggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattccttaacagttacaaactataacccacttttttctccctcaaatgctgtttcttcaaatagtactatttgagagaagggctccgaagtaaaatacatttgggaaatgctgcctagtctatgcccctttaagaatgttgcaatccatttcagtacattaaagtcccagtcaaagagactgtttagccattttccaaacatttttgatctttgaactgttttataaatgacttttactagcatcccatagaattagtgttcttcagtgcacaatttagaaaacggtaatttttaacgtataattttgtacttaagttgtctatttaatatgtatataaatatataaaacatttaatgttcaaatatagcgcatcattctcagatacatcatttcatttgactcttagatttacctcgatttcttttataccattattttagttaactgtgaagacatagcctgtctaaattagataatttttgttttgaatcctacccttaagattctgttttataattataaatctatccatatgtagcctgcttcttcttcttcttttttttttttccttttggagacagggtctcactctattgcccaggctggaatgaagtagcgagatcatggctcactgcagccttgatctcctgggctcaagcaatcttcccacctcagcctcccaactacttgggactacaggcatgtgccaccatgcctatctaatttttttactttttgtagagtcagggtctcaccatgttgcccaggctgatctcaagctcctgagctcaagcagtccgcctgccttgacctccaaagtgctgggattacaggcctttggccaatgtgtagtcttctgtggtcaatgctaattcatttcttcttcttcttttttttaaaatgttttttacattaatagggatggggtttcgccatgttggccaggctggtctcaaactcttggcctccagcgatccacccgcctcggcctcccagagtgctgggattacaggcgtaagccaccacacgtggccatttcttttttttatccctaatatcaacataccttttctctttcataataatttacttgcccttacaggaaacacaacaacctagagtacgtccctgttctattattaactcatttattatagttaagagaacttggcattttaaacatttttttgaattcagagatggtaccatggttttaatctttacctaagagtatgataaccattagatttctctaacagttttataaattaataatcttgtgcatttggacacaagaccctataaagacttggattggtatagatctaatataacttttaaagaacttttattttattttgaaataattacacccttacaaaaagttgcaggaatagtaaaaagaattctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttagcttttcttttctttgtggccttgacatttttaaagaatcgggctattttaatagaatacttctcaatttggctttttctaatatttcctcattattagatgaaggttgtgcttttcaggctagaatgctttgtaaattgtgtccttatcacaatgtaatatccagaggcacatgatatccatttacccctgctagataatgttcattttgatcagttggttaagatattctctggtttcttgactacagggttacattagtcctcttttatcctcagaggatatgttccaagacccccagtgcatacctgaaacctcagatagtactgtatctacactttgttttttcctatacagcaatgggcaggtagcatatacagcatggaatgctggacagaggtatgattcccttcccagactggatggaataggacagcatgtggtttcatcacactcctcagaacagcatgcaatttaaaacttatgagttgtttatttctggaatttttcattcattttcagacagtgactgtgaataactgcagatacaaaactatgggtaagggggggacagctatattatgtttccgtttgtaataggtaatttgagaggagttactctaccactgtaaatagcctatctttcttgaaagcttcccctcatcctagatttagcattcattgaatatacctacctgaattaattttactatgatagtcacaaatttataattttctaaccccttcatttattccatatttattagttagcattctgttataagcaagtttttcttcttccacccatctacctgtctatataatatttctctactatctgaatgagcttatggatatgtaatgggttataatcagtttttgtccttatgtatttacttttaaaattattacagaattattttagatttacaggaaagtttcaaagatagtacaacttcacccagttttctctaatgttaacatcttacgtaattggagcccatttgtgaacagtaagaaagtaacattggtacattattattgagtacactacagactttatttagattctactggttttccactgatgtcctttttaaatatttgtcaggtgttttgtagtgttcttcaatttgggtttgtctgatatttctcatggttagactggagttacaggttttttgagaagactaccagagaggtcatatatcatatcatatattgtatcacggggtacatgataagaacatgatttaacactagtgatattaaccatgatcccttggttaaggtagtgtttgtcaggtttctccattataaatttactggttttcccttcttatttttggaagtgggtcaccacctccatcctgcactccaaaggagggaaattaagctcactccctgaaagggagaatacttgcatatactattggggattcttctgtaaggaagatttgtgtcttcttccccatttattttttatattcaatcatttatttatatcagtatggactcatgtatacttaatattttatgctttgagttacaatctaatactgcgttgtttattttgttgctcaaaattttacagcatcagccactgagagctttttggggttggctttggtatctcttggatatgccccaatccttttgttttttgagcacttccttactttctggcactacagaatgctccaggctcatcttgttctttccttgacctaaaattagctatttctttattttgatgctcaaatggtcttagatttggccaacgggagtcccttcagactgactcctgtgcttttgatatgcccccattcatccatctcttttttttttttttgcccctccttatttaatttctagctcaacaagatgtttcagattcattttgtagtttccttgccataatcctaaaatcagccatttcttcagtaagtcttaattcttttttatggaaaacagtatttagcaactgtaaaatctgggcactaagtggctcattgctacaggaatatcattacttctaggccctatttcagtagacagagttcagaaataaaattttaaaaatacacaaacatgagttcatatataaacctccaattccaatcaaactccacagagttcttcctggcttcccctattccatgcaggacttccccttccacagtgagaactcaggcttccaacagcattaatatattttacttatttgctcagtcctacaatacatatacagtagtttcagaattgctatactcataccaatatgaaaaataaacctactggccgggcatggtggctcaagcctataatccccgcactttgggaggccgaggcgggtggatcacttgaggtcagaagtttgagaccagcctggccaacatggtgaaaccccgtctctaccaaaaatacaaaaattagccaggtgtgttggcatgcgcccgtaatcccagctacttgggaggctgaggcaggagaattgcttgagcccgggaggcggaggttgcagtgagccgagatcgtgccagtgtactccagcctaggtgacagagtgagactctgtctcaaataaataaataaataaataaatttaaaaacctactaagaagaatttaagatttgtttgcaatttttttttagactaatagtatatagtcaaagtacagtgttcttaagttgtttccctctgcccccgccttcactgtggttatattattcctttgaaatacatttgtgttaattggtttctgtattctttccattttagcgatcttttttgacaccatccttgttaacttttgttttttgaatatgtagaacattgacataattccaaaaatcagaactatataaatggtatactcagagaagtatcaatccctcccctatctcttctaccccttacttattccacatgtactccctcccagcccttctaaatggaccaagcacgtatgtgcatgtttgtttctcctcctttctagcacaaaacataacatatttattcttttgcagtttgctcttttcagtaactgtatatcctggaaattactccatacggtccctagagatcattctttctttctttctttcttcctttttttttttttttgagacagagtcttgctctgccacccaggctggagtgcaatggtgcgatctcggctcactgcaacctctgcctcccaggttcaagcgattcttctgcctcagcctcccaagtaactggtactacaggcgagcgccaccacacctggctaatctttgcattttttagtagacacggggtttcgccatgttggccaggctggtctcgacctcctgacctcgtgatctacccgccttggcctcccaaagtgctgggattacaggtgtgagctactgtgcccggccaatcattatttcttaaagcagcatagtgctgccttgtgaatatgtgccatagtttcttcaactatgtacctatgtgtaggcatttaagtagtttccagtatcttgctattgcaaattgtgctgcacagaatactgttatatgtggccttttgtattttggatatgtattttcaaggtaaatttcctagaagttggactgctagattgaagggtaaatgcatactgtatgtagttttgttaaatgttgacgaaatcccctccaaaagagcttgtaccattttatattccatcagcgattcggcataacttttggatctgcaacagctaggagattaagtctaatggctgggcgtggtggctcacacttgtaatcccagcactttgggaggcctaggtgggaggttcacttgaggtcaggagctcaagaccagcctggccaacatggtgaaaccccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcaaaaaaaaaaaaaaagattaaatctaacaagttaacaagtcatgcagtaacaagtcacagccatgattaactccctgaaggaccccaactctttgaggtctccaataaagaccacaccaaaccaatatcctcctggaacggcctgagagcacctagaagtagttcaggaattatcctaccttgccagaatgttgtagatacccagaggaagagtattatttggagagtattaatggcaagtcctaaaacaactagccaaaattcagggtgagccaaacatgtattataaagacaattgaaaggaatatttgaaattagaactattccagaaaatctggactgcctaggttggcccctttgtcggtagaaacttaataaaagttttttcacctgttatccatgggttttaaaaaaccctttgtttcttgcctggtggtcctgataaaaagaaaaaaaaaatcaaaaaacctttgtcctcgtggttatttacatcttaaaacaggatttgatgttgcagtttgcctaattcttccctgaaaaccaaaaggatagttgctgatcacttcagaaatggcgttattcttcagcaaggaacttatgctatgtatttgagctttttgaagcatacgtatataagtatgcatagtatatttatttgttcttttagtacatttactctttagttaaatttccttcacacagccaatctgtgggtttcctttttccgccaagaagattgctgttaccagtttagatcaatggagggccaagagaaaggccagagcagtctgaattagtaacaaaatccaattattgcatattttacaagaaatatggaataactttaaccgttaagagacttctttgtacacctgctgttaggaatagtccacaataatttcttgttatcaccattttctatttaatgggttcttctagtctagaaaacaaaaaaatccttgtttttaaaatttctgttacaaattggaaaccctgacacgttttcagtggcttcctgctctttggtcctgctcttgtactttttgtggctattataactgcagctgccaaaaacgttcagttaaatgggagattaaaatacattccacaaaattattgaggctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatgattaattcatgttatctgaaattatgggtttattatattcatttttttaaagaagaaaattagattctttgggacagccctagatagtaaatttaataacatttatattctctttgtgtgagtagttacttgctttagacacttacaaaaatcttaactggtaacaattgccaactaggtttttttccattaattaaaagaaactttttatatagtgaaggaaatgatcatcttgatatattctactatattattatttgctttatacttgtttttattgaaattatctttctactttgctttttggggaatattgccttgtcagacacagtctactaatacctaagaattatgattgcaaacctagctgtagaatatttttacttcccttttgtgatatagatttattttttaatatgacatatgattccaaaactcagaaataaaattttttgctgctaaagtatacagcatattctaggtatcctacaatgaatatctgtatggggagaggagagagacaggagaagatagtggtctttagcattaggaacttatgtatttttaactaaaatatttattaacatatgaaatgttatgagaactataaacttggaactccactatcagaagctttactataatttgttaattgaagataattctgatgaattttccctttaccttttgctttccccttttttcccgctgcttcctctgaagtctccttccaaatggttttggaaactggttccagtaagtttgctcagctacttcagtttgctctccagaattgtaattgtagaatggtattgtttatgtcttgctgttaaagtcatttcatgtaattctgttagtcattgaatagagattggattttaaggtcatgtaaaatggaaagataaaagatacagccaaggtttagatcagaagttctaaaaataatttaaagggtaaacatcctgttgctaatcttgtcagtattcacagactatcagtaagtaggttaaaaaaaaaaaacttatgggccaggtgcggtggctcacacctgtaatcccagcactttgggaggccaaggtgggcagatcatgaggtcaggaggtcgagaccagcctgaccaacatggaaaaaccccatctctactaaaaatacaaaattagctgggcgtggtggcgcatgcctgtaatcccagctactcgggaggctgaggcaggagaatcgcttgaaccagggaggcagaggttgcagtgagccgagatcgcgccattgcactccagcctgggcaacaagagtgaaaccgtctcaaaaacaaaaacaaaaacaaaaatcttactatgtagcttctcattaatttaaataattttagtaaatattaatttgaattgcatgaataaattgcctgcatttaaaaatcatctttgtggctgagcatggtggctcacgcttataatcctagtactttgagaggccaaggtgggaggactgcttgagcccaggagttcaagaccatcttggacaacatattgaacccccatctctatttttaaaaaattatctttttgacagacctagttccttttcagcttgaattatagatgacacttcactttttgtgtgattaagaaagcagaaggttttctgtgacctcaccagtagcggaccaaaaccatattaaattctgatttgacttaaagattgatctttcagatttaaatatggggatgggtgtgttaaaccacttaagaactattttacatcctcgataataaaactctaatttagaaatataccataatggccgggtgcggtggctcacgcgcataatcccacactttgagaggccaaggcaggtggatcctttgatcccaggagtttgagaccagcctgggcaacttggcaaaacctcatctctacaaaaaatagaaaaatgaggcaggcataatggtacacatttgtggtttcacctactcaaaaggctgaggtgggagaatcacctgagaccaggaggtcgaggctgcagtgagccatgattgtgccactgcactccagcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacataccttgtacaaaagtgctactttgcaggagggagtagaacaaatcacataattcaattctttgttgcatgaccctgggtgcttggcttagtccaattcaggtcataggctgaaaacaaactactagtcccagcccaattttgaggatgtccaagaggcagactgtttttatcccagataaccaaagaaaagcatgtaaggatctggaacagatactaattgtgagaacggtagcttaagcctagaagataccgctgtactggttgatttcttttttctttcttccttcctcttccctccccatggttgattttaagctgtttcttagctgcaaagtgaggaattttctaagaattatgttaaaatcagaatcaattaaagaatccatatagtacctgcaagtaatttttttctgaatatagttaccccctgaattagggatgtactcttaaatacggagtctattatgcactaattaacaagaaccttcagaaatctttaagaggaaaacatgttccatgaattttgtccttgggtagccagtgagagaaatccaggaataagtatctccttcttcattaatgctgatgcttttctgagagatagcattgaaaagaaatctaacttcactaccaaatgttgtgttctctttcagtaaatttttatttttctatttttattctcacaaaagtgttttatcttataattatattttaattctaaactatagagatgaccaatttagatggaattagaagaaaaaatagtttgataaccttaaaaaaactaccagtaatttatgttatatattttgctagcaaaatactttcgtgtgtacattcactaaatcttcagcattattttacttggctttagaagagttaacagctaataatagctaacctttattgattgcttgctgtgtgcccagcaggatgcatagcactttgtgtccatcatcttacttaatcttccagtggttctatgaagtgggtactattattacgccagtttacagatgggaaaatgagaaatgagagtttaagtaacttgtccaagatcacaaaactagtaagtggcagaaccaggatctgaaccaggatctgaatttgttctcttaactattacagcatgtctcattttttagagatctatttttaaaaattctatctagccacaccaaacaatctttaggaaacaaaggtttcttctctttttctgagggggagcaagaacccgtatacttgctcaattattaatgaaatctaagttggaagggtttttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaactttggtaatacctagcgttatttagaaaaaaagaaatattggtgagtggtctcatttctcatgatttattttattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagagggtaagtgttccattgtaatacttctgaactgtagacagatagtaaccaatatttaagacagtattattttgcactccagcctaggtgactgagtgggaccctgtctcaaaaaaaagacaatattatttaataagtactgaagacttttttttaaaaataaagaacatttatatataattctgagggaggtagttcaaaaaaaaatagtgctcggtttctaagtcttaatgtataatgactactatatttataaatgtatgtttgttaaccagaattgtgtatttgtactaattacaagatggatatgaaatatttattatcaaattaatccaaagtcaccaccttgctcttttcttatttgaagatatttgtttgaaagaaactatgtctttggctgatagcctgtataatctgcagctgattcaagaattttgccaagaatacttgaaccagtgttgccatttcactctggaagatatgctctatgctgcttcatccataaaggtaaattaaattattctttttttccctttgctttgttaaaatatgtttttttaaaaaacaaacaaaaacaccgggaacagtggctcatgcctgtaatcccagtactttgggaggacaaggtgggaggattgcttaagcctgggaggttgaggcttcagtgagcgatgatcgtgccactgcactccagcctgggcaacagagcaagaccctgtctcacaaaataaataaataaaattttaaaaataaaaaataaaccatagaacaagatatataaatgacctagcaactttaagcttatagattaactatattagtcaaaagaacttttgaagaaagtttttaatttttttctccttattttgttttttaatatactataagctacaagtttcttttatagtgcaaagccaaacttaaagtcatgtacaaaattggccagttgtagtgactcgtgcctgtaatcccagcactttgggaggaggaggtgggcagatagcttgagctcaggagttcaagaccagactgggcaacatggtgaaaccccatccctacaataaatacaaaaattagctgggagtggtggcatgtgcctgtgttcccagctactcgaaggctgaggtaggaggattgcttgagtctggaaggcagaggttgcggtgagctgagatcgcgccactgcaccctagcctgggcagcagagccaggccctgtctcaaaaaaagaaaaaaaaaagtcatgtacaaaattgatctattgtcttaatgtttgcaaaatagagaataagccattaaatgtttcttacaaatagcaatgcttacaaatagtaagattctttataaataatgaagctttctttttcttaaagaatttttaatttttgaattaaaaaattaattgaaaagtaacattatgtactatttaactaccattatgcataaatatatgatatgtatagttaaatgatatggtatccttgcgtatttttatgtgtacaatgagtcattgagcattaaattgaaatttagtttgtttattctcactagattatatataattgttctgtagttaccagactgtttgaaatttgtcacgtttattgtcctttgactgtaggctaatgtatgctgtcagattgtgttaaaataataaaatttcacatgggtagtattattttcttaattttaagttgaatatattttatttacattgatgttaaatgttaaaaataataatcatggctgagcatggtggctcacacctgtaatctcagcactttgggaggctgaggtgggcagatcactgaggcgaggagttcgagaccagcctggccaacatggtgaaacctcacgtttactaaaaatacaaacactagccaggcgtagtggcacgcacctataatcccagctacttgggaggctgaggcaggagaatcacttgaacctgggaggcagaggttgcagtgagctgagatggcaccactgcattccagcctgggtgacagaataagactatgtctcaaaaaaaaaaaatcattattatcatcatcacgaatagatttttgaaaatcattccattccattcccaagtttgaaaattaagttgtgttatgaatactgttatttttaatacttcaagaattatgtcttatcctccagatgttattttagtaatgttagtgttgtactttatgtgagtcaataatataaagtcaattcagaaatcagaaatgttttctagttgagtcatattaatttatgaaatactgaactacaatataaaaacttcaggcctggtgcggtggctcatgcctataatcccagcactttgggaggacaaggcaggaggatcgcttcagtccaggagtttgagaccggcctgggcaacatagtgagacctttgtctttacagaaaataaagttagccaggcgtgatggcacacatgtgtagtaccagctactcaggaggttgatattggaggattgcttgaacctaggaggctgagactgcagtgagccctgattgcatgactgcactccaaacttagtgacaaaccaagaccctgtcaccaaaaacaaaacaaaaaccataggggctttctcttttaatttttaaaggttaaaaaagagtgtttaaaatagtaattatttgaagttcaagatttgctgttgttaaaaacatggtgggaatcatatacatgctatataaacacaggcaacccccatgtatgcagttttagttctggtaaaccatttggaagcagactggggaaacgaactgggtacacctttgcttttgaagaattttaggatttgtttgcagctactctaggttaccaagtgtcacatgtgcatcattagaacaaagccctaatttaagacactgaagaactacagaatgcaagtgtgtaaaagttattaagatgaaaagaaaggagcgttaaacaagtttgtcagcaaaatgtaaaatggcaaaatttggagattattataacttttagaacattgcaggacccacactaatgtttgaaaaatattttagcgagagactattatatgctagacactgtactgagcctggggatttggtcatttattcattcatcggcagatatttactgagtatctccatgtgccagacactattcttagctttggaggtaaagcagagaacgaaatggcagggtaaactataaagccagtggtaaagacatttctaaaataagccactgctcctgctgacccaaagttgtacccagtctcttgtgtctgacacatcaaaaaaaatttttttctaattgatgttgaaggtttacacccttgccattcatatcagaatgaaaggtaatatcatttccatatatatcttgtaatgctttttctggtattttcaggtaataacagaaatattaatttctgttagtaccagaaaaggcatcaacatgatatctacattgtcagctaaaaatttaaatgctacttctgtaatctcaaaggaaaaaaactgtctcactaaatacatggagatataagattgcatttgtttaagttggtataccttggacttccaatacataatatacagtcctgatgtttatatcaactttgtctgggtacgacccatataaagatattttcttaaattaggtatatttaaactatgattttctacagaaagggctttggtcactttctatgttctttacttattactaccacagctttgacttcatttgaatctttttttttttaattcaatcttattttaaacttttagcttaagctcaagggtacatatgcaggtttgttacataggtaaacttgtgtcatgggagtttgtggtacagatttttatttcgtcacccaggtattaaccttaatacccatcagttatttctcctgatcctctccctcctttcaccttccactcgtggatagtttgcagtttctgttgttctctttctgtccctgtgttttcgtcacataagtgagagcatgtggtgtgtggttttgtttctgcattagtttgctaaggataatgacctccagctccatctgtgttcctacaaaggacatgatcttgttcttttttatggctgcatagtattccatagtgtatatgtaccccattttctttatccagtctagcgtcaatgggcatttaggatgattccatgtcttggctattgttaatagtgctgcagtgaacatacacatgcatgtgtctttttggtggaatgatttatgttcctttgggatatacccagtaatgggattgctgggttcagtagtatttctgtttttaggtctttgaggaattaccacactgttttccacattggttgaactagtttacactcctaccaacagtgtgtaaatgttcctttttctctgcaactttgtcaacacctattattttttgactttttagtaagagccattctaaccggtgtgagatggtatctcattgtggttttgatttgcatttctctaatgatcagtgatattgggctttttttcatatgcttgttggccgcgtgtatgtctatgtcttttgaaaagtgtctgttcatgtcctttgcccacttcttaatgagattatttttatcttgtaaatatgtttaagtcccttatagatgctggatatgagaccttggtcagatgcatagtccgaaaaattttctcccattctataagctctctgttcacactgttgatagtttcttttgctgtgcagaagctttgtagtttaattagatcctatttgtcaatttttgcttttgttgcaacttcttttggcacctttgtcatgaaatctttgcccattcctatgtccagaatggtactgcctagattttcttccagggtttttatagttttgggtttatatttaattctttaatccatcttgagttaatttttttatatagtgtaaggaaagtgtctgttttccatcttctgagtatggctagaccgttatcccagcaccatttgttgaatagggagtccttccccattgtttgctttggtcagctttttcaaagatcagatggttgtagatatgtggccttatttctgggctctctgttctgttccatttttgtaccagtaccatgctgttttggttactgtagccctgtaatatagtttgcagtcaggtaacatgatgcctcctgctttgttctttttgcttaagattgccttgggtattcaggttcttttttggttcaatatgatttttaaaatagttttttttagttctatgaagaatatcattggtagtttaataagaatagcattgaatctatacattgatttgggcagtatggctattttaacaatattgattcttcctgtccatgagcatggaatgtttttccatttgtttgtatcatctctgatttctttgagcagtgtattgtagttctccttgtagagatctttcacttccctggttagctgtattcctaggtattttattctttttgtgccagttgtgaatgggattgcattcctgatttggctcttggcttaactgttgttggtgtataggaatgttagtgatttttgtacattaattttgtatcctgagactttgctgaagttgtttatcagcttaaggagcttttgggacaagagtatgtagccttatgaccatcttaactaaaagaaggaaagaagaagcttttaaatgaattaatctggcatcattcctgaaatatggtgacagatttattgctgtttaatcgtcatgaactcagaaagacataatcttcataagttttaattactgggaaaattatttcttactctactgacatcttgtggccaaatagtacaattaatgttattaggatggctatcttaccaaagtccttaaaatattaacttattttctgttcaacagataattattgagcacttaagcagtattttttcaaaatataatcagctttcagttaactaggctagtaaaatggaacctagcaccagtacttaaaaaccaattttatactttggctttagaaagtataccataaagataagtataaagaagaaatataaatcacaataatcttactaatcagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagtaaaagtgatgaaatggaaaatgtcagtagaggcctgctcctaaaagaagtttgtgaagaggtaaaaagatggtgggaatgaggagaaactagagaatagttattgagtaaaggttttgtttcatttattttgatgggagggatttgagcatgtttaaaagccaaataggaaggattctgttgacaggggaaggatacatatgtaggagagaaaagtaggattaagaatataatggcattcacagcaatttggatggaattggagaccattattctaagtgaagtaactcaggaatggaaaaccaaacatcatatgttctcactcataagtgggagctaagccataaggatgcaaaggcataagaatgatacagtggactttggggactcagggaaaaaagcaggagggaggtgagggataaaagaccacacattgggtacagtgtacactgcttgggtgatgggtgcaccagaatctcagaaattacttaaagaacttattcatgtaaccaaacaccacctgttcccctaaacacctattaaaataagaaataaattttttaaaactgtaaagtttctgagaagtcaagcagggatgagagccactgcatagcctttacggattataagcattcttattactttttttagtcacaaattttaatggctgcttcaattagtatgtatctgtatatcaacattctaaaattctgagaatttacagtaaaagcaaacatgaaggtaaagtagaaacctaccaaatgctcttcaccactgtgcattatcttctgtaatactccagactcttacactcagccacctacaagacaggtccacttaaatgtccagtgaacatctcaaacaatgactctagattcctttcattacctgtttctcccagtcctttctatctcactattagttgctcgagacaaaaacctaagagtcatcactcttgattcttctcttttcatcactttctttttatttttttttagagacagggtctcactctgtcacccaggctggagtgcagtggcacaatcagccaaatcctgggctcaagctgtattcctgccctagcctcccaagcagctaggatgacaggcacgtgccaccatgcatagctaatttttaaaatttttatagaggcaagctatgttgcccaggctggtctcaacctccaggcctcaagcagtccttcctcctcagcctcctcaagcactgggattacaggcatgagccactgcgcccagcctcttttcttcactttctacatacacgatagccttccagaactatcagatgagagatgatatttgaaagtcaccaacttaaatatgagaaaaccaagagaacgcatgagttctagtggagagcatatagagtttaaggattattcataattagcaagtaggaagaaggcaagacattagaaaataaccatatccaggataatcttaaaaactttaatatgaaataagaccttattaaacattaataaatttgatagtaactattttattaaatgccaaacacccaaaatttagaaaacatattattttaaatagttatgaaaacagattttgtagtttttaaaaatttaccgaatgcctaaaattgaaataattcttcatgcttacagcttttattttatatgcattttaaaatataaacttgtagtagaaatgtgcttttgaggacccttaatcctttctcttaattttaagccatttaaaaaattatttacattttaaaatagtaataataaaaggtaacattgttgacttattgataacttttcaaagttaggtagatacattcattgtataaataatgttttgtacatttcaaaattattaaaaattagctataaaaatttagttttggtgttatttagcacctgtattactggtgagtttaacattactgagcacatacatataactttttttgtttaagacggagtcttgccctgtcacccaggctggagtgcaatggcatgatcttggctcactgcaacctctgtgtcttgggttcaagctattctcctacctcagcctctcaagtagctaggattacaggcacgcgccaccacacccggctagttttttgtatctttagtagagacggggtttcaccttgttggccaggctggtctcaaactcctgacctcgtgatctgcccaccttggcctcccaaagtgctggggttacaggcgtgagtcaccacgcccggccaaataaagtatttttttaacactacatccagttacgttttggagaaatttctagggatctgagtagagcttagttatgttttgaaagtgataacccctctttagagtgtcagatgattgaataactttttaagttgcttatatttactttggaatgaaagtgccttatatattatctcagtgttctacacagttagaggtattcatgcctgctagatcaattggaccaccattttagaactatagagcaaatgatcagcaagaggttttgaatagttataatttttacccacaagagttaatattccatcccatgtttaatagcctactatagtgaatatactccagtgatgaatgaatgagatttaaacctatattttaaaacaataaaattctgtttatcatgaagttttacctaatgtaggctttctcttaaatttcctatatagagtaattatttggtgttcatggcggaactgttctggtggtttgaagtggtgaagccgtcttttgtacagcctcgtgttgttcgtccacaaggaggtaatcaatctttttaattttaaatgttcctatgaacagaaaaaaatggaatgttgatataaccttacctggttacatttttagaaatcagcctattattttttttttagatttcagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaaaaggtttgtatggatttttaaacctagtggattttatgactattatatcatgaactattgattgtacataataagaataaaattagtaagaaataagggggttactgtaaagacccctagatataaggaacaaaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaaaaaagaaaaaaaaaaaaaactagaggtttatttctatagggggaaaaatgatcttaaattataagcttagcccactaaagaactttcttccagcataacttatggaaacatttctgtctgctaccaatagctgccctacccaacgcaacacatgatcattgtgcatcccaactacttagcagctttccttggctccaaagtttgttatttttgtaactgctaccgttacctgcacctccccgctaaacccccaaaaaataaaagaagagaaagtgatcaggaaggaggaaaaacatatgtagccaaaggggaggcatagtctagtgagtacaatgaggttacttcaggcagcccaccgcatctcaggcaaaaatctgtgaaataagcaataattagagtattgctaagcttcttaaggcagattctgaatatcgagtcactatataacattatataacttctttacatgcctataaaaaaattgagatgctcccctaagtccattgaatgaagtcagatattcttagtaattttcataaccaatatttgtataatttttaaaaattattaacagggttttcactacattgctttctgtgatttcacctgtgaagctcactattcaaaataccaacagctgttgcatcagatctcaaagtcaaaaagtaaattgagtcttcctccagagttacttacaaaaataaaagtataccagcaggtttaattattttctaaagaaattctgtttttctctaattgaccaaaataccagctgtttcataaagaagcagagctgaccatatgtatctgaagttctatgaaagctttcacaaaactaaacgctcaaacttatttttgttttttttttgtttgtttgtttttgttttgttttgttttgttttgtttttgagatggagtctcgctctgttgcccaggctggagtgcagtggcacaatctcggctcactgcaggctccatctcccaggttcacgccattctcctgcctcagcctcctgagtagctgggacaacaggcgcctgccaccacgcccggctaattttttgtatttttagtagaggtggggtttcaccatgttagccaggatggtctcaatctcctgacctcgtgatccaccggcctcagcctcccagagtactgggattacaggcgtgaaccaccacacccagccacttatttttgttttaaatacatgtatttattttatgttaggctttttccccctaattatccttaatcagatgaattttttaatttaagaaatttttggctgggcgtggtggcttacgcctgtaatcccagcactttgggaggttgaggcgggcagatcacaaggtcaagagttcgagaccagcctggccaatatggtgaaaccctgtctctactaaaaattcaaaaattagctgagcgtggtggcgggtgcctgtagtcccagctgcttgggaggctgaggcaggagaattgcttgaacccaagaggtggaggttgcagtgagctgagatcgcgccattgcactccagcctgggtgacagagcgagactccgtctaaaaaaaaagaaagaaaattttttttaattttgaaattaagtctgaatacttcaaaaagatcttaaagaaacttgaccctttgaaaattatttaagaagaaaactttatgctatgatttctcaatacgtagaaagggaaatagaagttaaattttgttataaatttgcttatggtccagaatttttcatagaaatatgctaatttgagggtgtttttaaaaatcttttattccagctgaacctgtaaaagatatgccttcaattcctgtcttgaatgctgccaaaagaaatgtcttagatagtagttctgacttcccttcaaggtaaactccacaatgactttattttcaccatttctattctatttactaattaaattacataatattatattacattaaataaggtttttaagaatttcagttggattttgaactgttataattagcttaccctattaaagcctgttttaacttaaatataaattgaaatatacactgaaatgaatgtttatgtaccacactgaaaagatgggacaatatattctaagttcccaataaccaacctaaaaccaaacttttgatgcataacttgttcataattgagaactgtctaataggtaactcttaggccttggagggaaattttgaaattctattaggacttttacatattttattattttaaaaatctttgaaggtttttcctgctttttttttttcttgttaggatagctattgagagatcacagtgttacccacacaacgggtgggtttggtctcttggcagatgacagtccaaagccacaaccaaggaggatttaacaagacgaggattttattacttgcagcaagtaaggaggacaccgggaataattccccaaagcagtgcctcctcaagcagaggtgaaaatagggcttttagtaggctggttaactgtatcattgtgtgtagaggtggagtaaaggcagtaaaggcacagtcatcagtcatgcttctgcatactggcatgtatagaaaatgcggaataagctcctccttggatgggatttttagtgtggtaatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaattgaagtatttttacccttcctgggaataatgtagccacatctcaaatgttagtgaacctaaataatgattttatgagaaagaaaaaaacaaaggacgaagacagacaaagcaaaagatgttttcagcagctactccacacacttggctaccagctgttggagatatacaaacaggtccgtgagcagagaggctgtcaaggtattttactagggtttattatacctatagtttttagagattagatttgaccaaagtatttcaaattggtgagtttcattttacttttttatatatcagtttttatgtttataaaaatgaaaataattcatatctcacaaagacattgagatgtatatgaaagtacttcaagttgtttggctaaaagacataaaatatatatagatacatactgtaatcacagccattctttggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgctataagttaatttttttacatgatttcaatggctttttcttttttgcatttgaaggaggaattagaaggtcttcatctatgtcttatgttgatggcttcatagggacatggcccaaagagaaaaggtaaacaaagagaattacttttagtgtattcagattattaagaaatgcaaattgcatctgtgtctctcttttattgataaccaaattgctaaaacttttaattagttcctaaatttgaaaaaggcagtataggcagatgatagagatgtaaaagaggctaactttaaaaagtagctagatagccctccccttaccttgaagacagtatgattatgagaactggggaaagaaaggaaatgtaatttcaaataattcttgttaaatgatactaaaaatcatttctaggatttttaaaggatttttctctttaacttttttttagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatattttttttttcagttgacatgcttgcttctttcagtagcagtcccttttgatacaagttcatccccattaactatagtaacattcaagcacactgtggtttccagtatggactcaaagctgtaataaatccttttatcacatgtttagatgtattccttggttttgctcctctactgctctttctcactcacaaaagccttttaaaaattaagctactcagatctcttcagagaatgattccattttgtctcttaatcatgtaacactgccattttttttaacagaatgctactgtagacactaatagatattaaaatttactgcctagagactctgttccttgcagaggaagggaaacaaaggggaagaaaatcattagtataaaacaggcagtacctctgttgcttcatttctattccatttatttacacatcttcaccaccccattactcatctgttggactatggttacagcttcttgactgggctgtctgtctccaatcatgccattccagtcttcatactgctactaaaggtgatagttccaagagcatagctccaattgagtctctttctagtcaaaaatcttgcctgttgaataaagttcaaaccctttagcacaacattcagggactttcacagatgaacctaaatctttttgtctagcttcttccccataattttattttgtattgttctttaagattaacttcaagcttcatctaaagccttttataattccttcagtcgaggtcaaatgtttcatcatttgtgtatctattgtatccttaaatatactcatacctgtcctgtgtcccggagttttcaactgttttgtatgatttgctttgtctcttagaccatgacctcctagaggtgctgcatctttttatttttatttatttatttatttattttttgagacagagcttcgctcttgttgcccaggctggagtacaatggcgcaatctcggcttaccacaacctccgcctcctgggttcaggcgattctcctgccacagcctccctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagtttcactttgattttgctgattctacttactcagaacagagtaaagaaaaaggtgttttttaagaaaaaagagatctgataacaaaactataaaataatcgtcatgcctaattatatacctgaagaaatatctggttagtagacataaatgtggttttctagcttgggacctttttgataggttctgtaacttcagagcacagctatatttccacaatatttccagtactttaattttcagaaataaaaatatttaacccggccgggcgcggtggctcacgcctgtaatcccagcactttgggaggccgaagtgggcggatcacgaggtcaggggatcgagaccatcctggctaacatggtgaaaccccgtctctactaaaaatacaaaaaaaattagccaggcctggtagcgggcacctgtagtcacagctacttgggaggctgagacaggagaatggcatgaacccgggaggcagagcttgcagtgagccgagattgcaccactgcactccagcctgggcgacagagcgagactccgtctcaaaaaaaaaaaaaaaaaaaaccctaagacccaggcaacattagaaaaatgtacacaatgccaggtatggtggtggctcatgcctataatcccagcacttcgggaggccaaggcaggcagatcacttgaggtcaggagttttgagaccagcctggccaacacggcgaaaccctgtctctactaaaaaataaaaattagccaggcatggtggcatacgcctgtaatcccaggtactcaggaacatgaggcagaaaaattgcttgaacccaggaggcggaggttgctgtgagccaagatcgcacctctgcagtccagcctgggtgacagagtgaggctgtgtctcaaaaaaaaaaaaaaaaaaaaaaaaagtgtacacaaaccctagagcccccacacaataagaatgtgttgccttatgactgaaattgatacttcttaactagggcagaggaaaatattctgtagtgaataggaacaaacacctttatttcatgatctgtctacacagaaagatgataataaaattcagcaaaggaaatgtagctgtaatgttatgacctaggaattggctattggagaaacacatctataaaatgagtgtgaaattctgtcgtcccttagaagtatatagatgcttaagaaataggtatcttctcaaaagaaacaaatgagatattaatgattttgcctaatttgatgggggtgggggaagtacacagattggtatgtcagagttgctcttcaaataaggagatctagaatctagtttcagtcacttcctttttgcccctgtgggcatgtaggtcttctagcaactcaaggccacatgcttagacaacacagattagttttgtacatgtgtttaaatcactgtggtgatatgtgtcacaacaacagctaaaatcagataactttattccatctacagtggcttatttatgtcaggaaaatagggggcaattattttccatcaaagaggtgaaaagcaaattaagaaatgttttaagacccactaaggtttttttttttttttttttttggggacacattaagcaaagccaccatggtaccttaggctactaatgcatttgattcttcttaaccccaacctgttgttttaggtgattgaacctgtgattcagccttcagtaggtgttagaggcatccaacacaggtggcaagtatcgtctacagcacctctacttcacagttacattcagctgctgtgattcctggccgaccctattattcatacttcagggtttgtgtgtttatatagaaaaggaaatgtggctctcaacccgagatcgcgctgctgcacttcaacctgggtgacagagtgagactcagtctcaaaaaaaaaaaaaattgctttataatttaaaagattctttgctttgctttctcttttaacttactgctgcctgggaggaggtgagcatttacgtctccattctacagatgaggaagatgaggctttaaaaggttagtagctgtcccagggactcaaagctagtaagtgacagcattacaagtggcacctaagccttctggtttcaaatccccttactgtgccatatggtacagtttcccactgcgttgtacatgttgtggaataagaataaggctcacagctgttactagttaataacgtattcaccattggtagaaaactcagaacttgtggttaaagtggattttgttctcttgcccaagactgttaaccatcatcaacacaacagctaaaatcagcctgttacgctcacctgctgtttaatatctagattcataaagatgagagaatggaaaaactgcaaaagtggtgaaaacaaattctgataataggttaatcagaattatctaggaaacagttattagatgaaaggggctaggtaggtcacaaaggtaagttctcttccatcaaggaactcttgaagtggatgccattagacctttacaaacaacggatataccgtgtgctgtattagaggtatggaaccgaaagtaaaggacagatgcgcccttgtcttgtcaacagtaagagcctcttgtccatcaagagaattcatgtactttatagggtactaactctactaaaactaactctataaagaacttaagactgctcttcctggggaacttgtctacaggcactcagaatggtccagcatttgacatactgtcataggctttcctacaatacagcctctaacaaaactacgcgaacccctggtaatagaattgtttacctttataccaagaaggttgggaaagcatcaaaatctgcgtgtggcgtgtgcccaggcagactttgaagggtttgtgctgtaagacctaaagttcttatgaggttgtccaaaacaaagaaacatgtcagcagggcctatgttggttccatgtgtgctaaatgtgtttgtgacaggatcaagcgtgctttccttatcaaggagcagaaaattgttgtgaaagtgttgaaggcacaagcagagtcagaaagctaaataaaaaatgaagcttttttgagtaataaaaatgaaaagacttgctgtatggaaaaaaaaaaagactatcttacgttgtcagccaacaggataccacattaattctttaaatactgaattttgccgggcgcggtggctcacgcctgtaatcccagcactttgggaggctgaggcgggcagatcacgaggtcaggagatcgagaccatcctggttaacacggtgaaaccccgtctctactaaaaatacaaaactttagccgggtgtggtggcgggctcctgtagtcctagctactcaggaggctgaggcagaagaatggcgtcaacccaggaggcggagcttgcagctagctgagatcgctctgctgcactccagcctgggcaacagagcgagactccatctctaaaaaaataaataaatagtgaattttgaattgcagagacatcagttctgttgatagggccttgaggtcctcatttatgatgagaacaaaactaactaaactgcatcctctttcttagccagaggctaagtacagatatttttgtatacattacgaaatgagtttgtacttggattctttatccttatagtctcaacacaatcggtattcaataaatattcgtcaaatgaatacatgaagggaggactatgcagtcctggcccaaaattcaaaatcaaattcaaaacatgttctgatttcttctaggtcacccttcatttcttactatagatatttttgcccccaaaatacaaacccaaagttggcttttctgctctgactccccctggttcatgccatttcaaaggacccaggtgcagcttgaaaatctgacctattggtcaccgtgacacaatgatgtactgttcctttttacctctctccagctcctctcacaaattatgggccagtctcaaggctcagttattcatgttctgctgtctccactctttccaagaagggcttcaatatcagctttgactgacacctccattcagaatctacatctccagccctgaaagcttcctctgggcccactcatgcatctaactgccatctcaacattttcacctgggagttccaaagtcatcctcaacttaatctgtttaaaaaccaaaagtcaacctgattttacaacttccttataaaagcaactctccttcctgaaagccagccaccaagactgaaaggtcttatcccttgtctaacacagaagacagcctcatgcacagacagccaccaaatcctatcaaatatttttactttgaaactgctcctcatccctgctgccaccagcttcaagtccaggcaccaaaagcttatgcctaactgcaagaaccttcaagtggtcttaccctaattcgatttcaccctccaaagtgtcttgcaaaatctaactttcttagacttatcttaaaagttcaacattgtttttattttgaattgcggggaggatgggggtggggtgttgaggtggtggtaatctgttcagtgcttggaaccactaaaggtcttgatcctgtttttcaggcggctcctatacacagacctttttcttcagaaaagctgacctgcttcaatcttgatagaagtcaggatatcacaatctgccttatatcaaagttatttgtacattatagctaatctccaataatgtgtaagcttcctgtaaggatgcaccatgtcacattctttgtatctgttacattacccaataacagtgcttgccccacagtaagaaggggctgtttacaaagtcaactggaatcaaatgtgatattaagaattggttttggcccgggcgcagtggctcacgcctataatcccagcactttgggaggctgaggtggacagatcacttgaggtcaggagttcaagaccagtctggccagcatggtgaagccttgtctctactaaaaatacaaaaactagctgggcatggtgttgcacgcctctaatcccagctattcaggaggctgatgcaggagaatcactcgaacccaggaggcagaggctgcaatgagccgagattgcaccactgcaccctagcctgggtgacagagcaggactccatctcaaaaaaaaaaaagaattggtttcactgatcagtagcaggatcacagcactgtagagggaccctctaccaatgccaagggaatgctgccaaattcctcctgcaaatacttggaaatttacactaactctctgtgaaatcactgaaaagtaatggcaaatcataggttagaagctcctgtgggcagaataattgctacaaagagaaaacgttactttctttccaaacaaattctggggccatttttatattggggatgtccctattgcttgtcttttaagtttctgatggttttttttttacctttaaaaaacgttcgagctacaggaacctgcagtggaagaaaggagtctcactttccttgaaagctacactcttctcctccagcctcccctcccttccctgaccccctcccccatgtcccctaagaggcatcaatgatgtccggggtagatggggggccctgggacaatcacacagctgcaggccacaaggctttcacattgagtcatctccttagcagtgtgggctgaagccgagtctcatgtctaactcagatgatgccctttcccagctaccccgtatttagtacctgaaagtttctgaagtaaatgaacatctgaaacattctgcagggcctctggcatccagggtggggctcctcatctggtgtgtgccagccctcccttagatgttgagggtgcagggtaggggcaagagctattactgtcttctgtcctctaataccctgtccctaccaccctccccgccccccgccccccaccccactcacacacacggcctcagggctatgtggtctatgggaaacctcatcttggtagccagtcagtaatagtgaataaaatagaggactccccattcccagttcagtgtttatcgagagaggttgtaaaaacaaagagatgtggctttgcaagattttcctcacactcaggactcaagttactgttaacctctccgtcatccgcaactgacttggcataaggccacctgtctgtgcttgggtcctgtcagcagtttctctgcagcatccagactgtcaccttgtagaaatcaccattaggataataccaggcaccagacactgtggtggtcaaatcttgaagagtcaaatcttgggagtctctctttatagattcccaatccaatccccaaaacatttacttaccacccactatgtggaaagaaagcactgtgacctggagggtaggagaagcagcgcaagcagctgagtctagcagcaggaccaccagaaactagagccattcttcacgatgctgccagccagggaacggagtgagcccatgagctccgacccagcatgggcagcaccttccacaaagggtgcctcatttgatcttcacaacacccctatcgggtagatactatcatgcctattttaagatgtggaaactggagcccaagatcacacagctatcaagttataaagctgacatttaacctggactctgaccactaataatctgatctgcgtgttcactgatcagaaacagacaaaatgacatataagaaattgatattggccgggcacagtggctcacacttgtaatcccagcattttgggaggccaaggtgagaggatcgcttgaagccaggaatttgagatcagcctgggcaatataatgaaactgtgtctctacaaaaggtaaaaaataacattagccaggcatggtgctgtgcacctgtagtcccagcttctcaggaggctgatgcaggaggattgcctgagctgaagaatttgaggctgcagtgagctatgatcacactgggctacactgcagcctgggcaacagaacaagcccctgtctattaaaaaaaaaaaaaaagaaatgcatataataaaaaaaagaaatgcatataataaattctatgtcacaacacagagcaaggttttaaaaatatatattttaaatttaataaatgatgttaggaaagctggatagaaatatgaaaacatcgattacacaccaggtaaattttaaaatactaatgaaaattattttttaatgacagactgaatcttcttacattgtcaaagagaaagtaacattctaaactctgaaattgctaatagcaacaaatttgactatatgaaaatgtcaaactaaaataaataatagctaagaaaagaatttggaaaaatatttgaatcaagtggaataaatcatgactcatcctaaatatatagtttgtacaaattaataagaaatacatagattataataaatatgtgaaggacatgattagaatggttcacttaggaaataaatagattttccatcttatttataaacaagtgcaaattgaaatgaggtaccattttacctcactgcctattacaatggaaaatatatgttaccgatgaacatctctaagaagactgtgttgaaccttatactctcatacaatgccagtgacattctaaactgctaatcactgtaaacatttgtatcaagcaataaaaattttcattgcctttgttacaaaatttgtatttataacgtgttttacaacatatttatataaatgttatatttatacatatttatataaatatgttatatttgtacatatttatatgtatataaatacatatttatatgtacttatacaagagcatttatgttataaaaacaatataaaaaagtcataagtgcaattattcattacaaatttctataacagttaaaaatactagaaacatcctaaatatccatatttaagggtttagaaaattaagcaacatagactcatgtggatttatatgatattaattgagaatactgtgtacactctaattacagatacgactttgaaacacctgtgtaaaaaatgtgaagaatatctgaaatggaatatttaaaaatagaaaatctaaaaataatgagattacaaataaatacttttgaaaatgtccttcactggctaagtttggttgtgtaggggtagcaggtccaagatgacgactacttctttattctgtaatgtattagatggcttttatgattaaacataaaaaggcaaatacaatttacttaaaatgttaagattctttgtacagaaaaattaaaattagaaaaaataagttataagaacttaaatataacctgtaaaggggcagaaataaacctactctcgaaaacaatttagcccgaagcattggatatttatttaaagtatctcctctgttttcaggcttgtgctaatcaccctgatgagtagaaagaagctccccctcgccctgagaagttcataatcccatgggcaaggcaagacggagccacgtaacagttgccctggctccagcagtgcagagagaggaagtcctcttagggatggaggttagagaaggctcccaggggtgggatggaggaagagggaagacttcttctgctttgtccacacctgttagagagcatggccaggattcccagcctgtaagggtgagtgtttctattagttgacttgtgtgtaatcctgtggggagtcctcctgaagggtgaaagagcagtcttgtgaagttggccttggtcactgaaaccgggctgggcaccccaggagaccgggcctaaggcagtgtccctggctctgacctttgctgtttcttctcatccagacaagttcagtaaggcccatggacagcacccaggcctcagcagagaaaattcagcatatgctctgggccacagacttcccttgggtatgagatgatggcccaggaagcaagtagctctgtgatttttaaaataacctacttctacttcccctcaacccccttcctatattcccctcttggtctgcttgccccattctttgttttcacccggcggcttctctgctgttcatctctagctttcaggatcactcacactctctgagcccgcagactgaggtgtgcctgaaggggtgaagtccagcaacactgggtctgtctctgatggtctctgggctctggcaggcaagcactgcccctgctagccttctaggggaggaggctgcagccccctactccaccccggatgtgggcaccgctcaccagcaaccacatgctcagacattagaaaagcggctctggggtgggtcttcaggggaaaaccaagcccggaggctgaaaagccagtgaagggaaggtccagaccattcattccctaggctcttctcttccctgcccatcttgtaattggtgtgggagaaattcttgacaggagcagcctaaacactgcatacccaaccctctgtgagctctaggaccattttctttttgagatggagtctcgctctttcacccaggctggagtgcagtggcttgatctcagctcactgcaacctttgctcctgggttcaagcgattctcccacctcagcctcctgagtagctgggacttgcgcgtaccgtgcccggctaatttttgcatttttagtagagacagggtttcaccatgttggccaggctggtctcgagctcctgacttgaagtgatctacccacctcggcctcccaaagtgctgggattagatgtgagccactgcgcccggcctctaagaccattttccaaatccttcctggggatctccgtgtgccagagggaccctgagcgagggtgaccttatgtcccagtttgcccaaaatagtcctggtttacggcccaggttaattctgatagtgcccctttcactctcagaaacatcctggttagatgataaattatttcatgaccccacttcaacatcaaactgaacacatacacacatgtgcctctctgtgttcttggcagttaaggggacagcgtccatatagtccctaagcagagaaaccccaggcttatctttgactcctctttgtgagacctatgatgttacaattatctcttgaatataccctcccatttctgtccccactgctcatgatctatttcagacacaaataattacaacctactatggggtctccctggcttgagcctctcccttctccatagttctgccagcgatcttttcaaaacacagatcgatgcctcctggctccccatgacctatagattgaaatccaaatcccctcatgatcctttcctgcttcatctcctgcccccaccttcctaccctgggctctggcagactgcttgtcccctgaaaagcccacattcctactcattttggtatacttgttccctttactccctcctccgagtctgaccctttcttctcttttctgctgctcttatttgactttcagctccttcctgggactgatctcaagtgtcatctcctcgaaggccttttctgattcagccctcccgtcaaaaataatcactccccctccactaaaccctaagagggcttggtttttaacatttactacaatttggcccctgcataagattacataagattctgcttatgtaaccatctctcctgcctatgcaacaaactgcgaaggccaagaatggcatctcttgcagtgcctgaaacagtgcctgcttcatggaggagttcattgttaacaagtcttaatcgaacaaaattgataatccacctcaaattttccacaccgggttgcccggcacatcagccactcatacctgggaacactggggacagactcagagggcactgtgacatcagttctaccacaatatcttgtggaagggatatctgctaagaagaattcagatgtaagtggctgcatgcctccttcaggagaaagagcaagctttccctcacccatcctctcctccttaggtcccactgcctcctcagggtcagacttcattccccctcgtctttatgaatcctccccttactctcagtttctcagttcagaagggatcttgctgcctccaagctcctgactcataatttaggacaactaatctggtgtttcattaggtgtcatcttttgaactgagcttacatctgtgtctggcttgacaggttttttaggataggagaagacagggaagaggcagatgtgaatcccaggtttcacccctttccagcaggatgatctgactacaccccttcctcgctgccttaaaaccctttcgcgtggcttcatgaggacctgactgggtcagagaagccactcatagggtgaagacatgagccccacatctcaggacgctaacaactgcttgactgcccagggcgggctcccccacccacccagatctgctgtgtcccggcagtggagtctttcctagggaacaggtggatttggggtggggcgtgccttaggccccatactcataaaatcccggggctctgtcttctcacctctaaaacagagaagacagcagccggtgggtgcaggtgggaaggggtgaagtggaggctgagaagaggttagggctctcgggcacccaccacctcttgcaacgcgaccctgagacagtggggcaagtatcccgatttcacgaacaaagaaactgagcaactaatagaggaatgggccacgctcctactgggaggccgggcaggtctcccagccctgaagacttttcctcccaagatttagatgtgaagccccttttgcctgtccctgcccttacccctcgggtcagccccaaatcggaggccaccatctctctcacagaagcctgcccctcccaccccatcccctcctccctcccctctttcctgcccacccatttgcctccggcttgggtggcaggaagggaggtgcagggccgggcgtgaagagcaaaccccctcctgctcagagctgctgccgcctgcgcccagggctgcactccgcgcaggcctcatagccaggccatggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtagctgccccgggccgctggaggtgggcggcagcggagcatcgagaggaggccagaggtcccggaggggactgagctccccagacgcgcctgttctggcggcagcaagctgctcgggccggcatcgcatttcctcgcgcgctgcctggactcccaaggcctcctccatcggtttccccggaacctcagaacaattgaactcccctaaaccaggctcctgtgactagctgttccctctcagcctgcagggtacctgagctaattttgtccagtccaagataggtgctatgagatgtagcagacagcaactcggagacccgcagattcaccaagtagacagaagggaagtgggtttccttctctgtcccatcgggaagagaacccaccagaatatctaacccagacccccaaatgccattctgatttctggctgtgctttctcccgtctcccacaatagccgttgctttcagagaaataccttctccaagtcagaccccctgcccttctcactcacaaaacccttgcattgaatctggtgacacttctccccctgtgaagcggcaggactcacctggaagttgttctggtctttccctctggacagaaggtcctgaaatcgctcaccaggcgttttttgaggtctccatcactcagccaggaacctcaaaatctctgtgaattcatctttctcaataaacactcttgctagccctgtcttgacaaccgtctttgcttgagcagtgggagtgaaatgcatatcaggaggcgggtcgtacactgggtgagacaaaactcaacacagtagttgaggttgatctcaggatgatgaggatttggggtggtgtctgggagcatgagagctggctgcactctgcaggtgcagtaatcccacaggaggaagcaagtcatttattcttatttttaaggacatttcacattttgaaaattaccgaaagaaaatatatttatataagggcatctgccagccaagtgtcacttccaagagaagatgtgtcattttggattttcaaatatataccaggccccccctttttttttctatcttttttcagaccttccagtacaaacttggaggattagccattttctgactctgtcatttctcatttgaggtttctgtagggtttggaaattcactgtttatacttttgatttaagaggatttggcctaaagacatttcagtcagtgcacatcctagccagatccccacaggccagtcttgatgttgcaagctctgggggaacgggtgggtgtgcacgcacatcagcacctcagcactaggttgggtctgaaggctggcattctgtcgcaggctatccatcccatccccccatcaaatacccctgtattctcttcagcatttggagctgcttggattgaacatcggctctcctaggtcagcctgccaaaaagtgcatctctgcatgttcctaccatatactccaagagaggcaagccttgcagcctgtgaggtcacctctgccagcaggacacatttcaggcacttcggtgtttgagagttcagttaagtcttggcccttcctatcctcacgattgctctccgaggcaagaaattattttttcatggggctgagaccccagaattttcagggcagggaagctgattctcatctgggtttgtgtgtgacaagatctcagagtacagaggaggcacttttctaggctattgggactgagcccccacctccacccctgccaagttgctgcttctgacttactgactagttgagttccctgaaaacagacaggaagaaagaagacttctccatgccctggtgggttttcgtctcccctcctgcagtagctattgaaactcagcattcccctcctgctgtggaactctgcaatgtggagagacagtttccgccctttgtttgagtagatcacggaactggtctaccatgtgtcctttggaaattttcccttaaattcagacaaaaatgaaagaggatcagtgagctcccatctcccactggggaagatgaggctcagattcatcgaggaactggttaaacgagcattcccacatatgtggctggtgagagtagattcctttagaaagcaattgtcaatcttcatcaagagctttagaacttttcatatcctgtttatttaaaatgtttatacccttcgaccctgtagttttgcttctgccactctcttctaatgcaacagtactaaatttaaacgattctgcactgagttatagaagtttttttgttttgttttcgttttttgtttttttgagatgggatcttgctctgttgcccaggctggagtgcagtggtgtgatctcggctcactgcaacctccacctcctgggttcaagcgattctcctgcctcagcctcccaagtagctgggaatacaggtgtgcaccaccacgcccggctaattttttgtacttttagtagagacagggtttcaccatgttagccagaatggtctcagtctcttgacctcgtgatccacccaccttggcctcctgaagtgccgggactacaggcatgaggcagtgcaccctgcggctgagttagagaagtttttaaagagttaaacctgaaaggaaacaacaatgtccaacaacagtgtaatgtttttattaagatgaatgactattatgcaaatttaagatgctctttaaagagagactgaaaaatgttgacggataacttaaaagggaaaaaaaggtaaaattgtgtctgttaaacacacccacacacttcaagtctggaggatgtaacatggttagcactggttttgttaagtaaaacataacatgcttcatagtccttttgatgaaaacgatcttttgctcttttatttctcatagctcaagctttgaacactataggtatatctcttttatctaggtgctaactaatggaatgctgtcgatttatttcttcgtttcttgcttgtccctcctgtcaggatgcaagctccatgcatgcagacggttttgtctgttggttcaaggctgtgttcccagtgcctggagcatgcctgcacatctcaggcactcactaactacctgttgaatgaatgatcatcaggaccatgtcatgatatgaaataatgtcatagaatgtgaagagtaaaaggaaggctattgcattttatgtgtaacagctatggattgttaaaggacttgcaaaaaaaggctaggaagaaatacaataatcattaatgataatgattgtgtatgattgtgttagagtaagtggattttagatcctttttcccctccatttctttacttttaaatgttctatgagctttttttttttttttaaagagacagtcttcctgtgcaatcatagcttgctgcagcctccacctcctggcctcaagtgatccccccaccttggcctcccaaggtttgctaggattacaggcatgaaccactgtgcctgggtttataagcttcttttttttttttgagacagagtcatgctctgtcacccaggctggagtacaatgatgggatctcagctcactgcaacctcctcctccctggttcaaacaattctcctgcctcagcctcccaagtagctgggattacaggctcccgccaattttttaatatttttagtagagatggggtttcaccatgttggccaggctggtcttgaactcctgaccttaggtgatccacccaccttagccacccaaagtgctgagattacaggcgtgagccaccatgcctggcccctataagcttcttttaaagggcagttaacaaatagcaacgaagctaccaaagcactggagctcataacaagctgcctgtccttggccacctcgcttacctttcttgagactcactttcttcatctaaaggatgaagatgataatatctcctcaggctgcctcacagatcaaaggaaataatcttgaaagtactttgtaagctgtggtgttttagacaaacatactgcaggagttttagacaacataccctcaggattagcttgttccaggccgggctaccccatcccaatccttgtagccatggagaggagatggggtggagccactctgggttttcaaaaggtcagcatctaggctaaggctgggcacactggctgtgtgtgattctgatttgcttcttgtgactaattctgggcttcctcctcacctctctcaaccccttgggtgctttcttggggcacagtgtgggaacccagggcacttgggttgatgagtgatttggggagttcagcagaatggcagagctccaggggtggcacttggtgatatgactcagccccacaccactctgaaggcagagtgaggactctggacacttgtgagtacgtcttgcttgttagagcttactggggctaactccctgtcctacctgggccgagtggccacaagacatacttatcccatcacccccaaatgatggggcaaaaggtgcaaatgatgaaaagaccaggaaatgcttgggatgtgagaggaaaggagaaagcaatgatgtgaaatcacccctcctcttcatcatcatgaacatcaaaaagtatttattgagtgtgtaagtacatcttccatgaaagtgggcactgcctgagattcatatttacatccatcacagtgctttaaggacagaagctcattttgtccattctgagaacgaggagactgagggccagaaatgggggtcacttaaggtaataatcaccacttatacctgtgtagcatattaagaaaaaattctttttttgagacagagtctcactctgtcacccaggctggagtgcagtgacacgatctcagcttacttcaacctccacctcctgggttcaagtgattctcctacctcagccttccaagtagctgggattacaggcacgcgccaccatgtccagctaatttttgtatttttagtagagacggagtttcaccatgttggccaggctggtctcaaactcctgagctcaagtgatccacccacctcggtttcccaaagtgttgggattacaggcatgagccaccacacccagctgcaaatgttttaaaagcagcctgggcatgggtagctcacatctgtaatcctagcactttgggaggccgaggtgggaagatcgcttgagcccagcagttcgagactggtctgggcatcatagtgagactctgtctctaaaaaaattaaaaatggccaggtgcagtggctcatgcctgtaatcccagcactttgggaggccaaggcaggcagatcacctgaggccaggagtacaagatcagcctggccaacatggtgaaaccccgactctactaaaaatacaaaaaaattagcggggtgtggtgtcgggcacctgtaatcccagctacttgggaggctgaggcaggagaattgcttgaggcggggaggcggaggttgcagtgagctgagatcacaccactgcactccagcctgggcaacaagagcaaaactctgcctgaaaaaaaaaaaaagacaaaacaaaaaaaaatttgtcagtttggtgtctgcccaacttaaaaagaaaatatttactatcttgttatattatttcaaagacaaaagccttttatacataatatctcattacaatatccctctgaagtagatgtcaagataatagctaatatttactgagcgcagttgagaggctctgagctaaagttcttactttatatatatatttatataatattattaatcctcacaataactttatggggtatataatattattgtttctattctacagattaaaaaaatgagttctggagagtttatataactttcccaaagtatcttgcctaaagaacctgtgttattatccccattttagataggagagttagaactccaagagctcagttgacttgccaggatcacacacacacagggcagggctgaaaattgtggcttcatgggccacagctcaacccaccttccaacttccaccagttttctagtgcccgctaaccctgtttctcactaattggtactaaaccaagtgtgccagagtcaaggctgttgcccagcatggaaattaccccgcttttgttctcaaaaaaatcagaatccctgtcctacggacatggacagtaaattgttggggcattggattgagagagaaatggggctcttcccaggggtgataggggcaggactggggagaaacccacaaaccccagggttgcctggtagtcccagcagtgaatgagagagctggggaaagacgggcagggcttcaatgggcttcgatggacctcagacaacagctgccagtgtctggatggagactgtggtttgcctcagggagatgtgctagacaaggggtgattaattgctgccctgctctgaaaatgactgtcttcatgctgtgcatgcaaccatttctttctattcatcatctctgcttctgaataaccttaagcaagcaggttgtgccatgggctgctcttattctgggtcccacaaacacagagtggcaggataaggaaggtcacagggcactctgaattccgtttctttgtaggcaaagtcttattctttatatagccaattgtcccaaatcttcgtaggtttctttttcctttcttttctttttctaagaaatggggtcttgctttgttgcccaggctggagtgcagtggcacaatcatagctcactgcagcctcgaaatcccaggcttaagccatcctcctgcctcagcccaagtagctgggaccacaggcacacacaccatcactcctggctaattatttaaaaatttgttttgtagagatggggtctgtccattttgcccaggctggtctcaaactccggggctcaagctatcctcccatcttggcctcccaaagtgctgggattacgggtgtgagccaccgtgtcgagccttctcaggtttcaatttctaaaattattattatcataaagagagaaaatataatatcaagagtgaactaactcaagatcctgcaccctaattgcaataattttcatttttgcccatcctcttaacccttctccacatggtcacattttacattgctgagatcgtgtcgtgtccagctttattattttgcagaacatattataaacattttcctgtgccactatatagatttcatagttgtcatttttaaaggcgtcattcagtgtatagaccacagtataactaaccattcttccatgattagacatttatgttgctcaggagcctctgcttttataaatataccataacaaacatcatttctatctaatttgggactaattttgagtgtctgtttcaaactgaaaaaattcccctgcatccatcaccctcttttgggttcttccccctcaccaccctgtgtgattctctcgcctgttatgttctccttcaaaagattgaaacctcctcaaaagcagtagctgtggacttgtggaaaacgcactttgaaaagaaatagagcacactaggccagttgcggtggctcatgcctgtaatcccagcactttgggaggctgaggcgggcagaccacaaggtcaggagatcgagaccatccaggctaacatggtaaaacctcgtctctactaaaaaaatacaaaaaattagccaggtgtggtggcaggcgcctgtagtcccagctactcgggaggctgaggcaggagaatggtgtgaacccaggaggtggagtttgcagtgagctgagatcgtgccactgcactccagcctgggtgacagagcgagactctgtctcaaaaaaaaaaaaaaaaaaaaagagcatactaatgagtgtaagtgctttttagtaaccatatatagacgttcagggcacaaactccagtgccactagctgggttcaagttccagctctgcttcttactgtctttgagatcttgggtatgttactcacttacttttccccttgggatcctcctcagatcacaggaggaggagatgatacttcttaagtcacagagtttgtgagagggtgaaatgtgttgactatgactatctggcacatattaagcattctatgtttgctataattttaagagtaaaattgaattctaccatggttgtggatttctcttctctctctctctctctttttttttttttgagaccgtgtctcactctgttgcccaggctggagtgtagtggcacgatcttagctcactgcaacctctgcctcccaggttcaagcaattctcctgcctcagcctcctgagaagctgggattatagccgcccaccaccacgcccggctaattttttgtatttttagtagagtcggggtttcactgtgttggccaggctggtcttaaactcctgacctcaggtgatccgcctgccttggcctcccaaagtgctgagattaaaggtgtgagtcactgcacctggccggatttctcttcttaaattcaatgtttcaagaaactttcattttgcattactactgtgccaggtaggatatgcaagactgtggggctacagaaatgaaaaagacggccgggcatggtggcttacccctgtaatcccagcactttgggaggctgaggcgggcggatcacaaggtcaggagttcaagaccagcctgaccaatatggtgaaaccccgtctctattaaaaatacaaaaattagccaggtgtggtggtatgcgattgtagtcccagctactcaggaggctgagacaggagaattgctggaacccgggatgtggaggttgcagtgagccgagatcgtgccactgaactccagcctgggtgacagagacagcctccatctcaaaaaaaaaaaaaaaaaaaaaaaaaaaagaaagaaaaaaaagaaaagagaaaagaaatgaaaaagactcccagctctcctgcagagcaaccatgaataatttgtctccatcccacaccaaaaaagaaatggaaaatgtgggcttgtgtggatcttttgttttgggtaaaatgttatttttcctttcctatctctttttcttgaaattaaaaaccatacaaagaattccatgctgtgaatcggttgcttttgtatatctttgatttttggagatcagttggtcagtgtgtccccacagtgaaagactgtgaaagactttgtctctctgtctgggaatttcctgccagagcccagagtggtctctgaaatgagtgaggctgtgtgtttaatccacagcgacagttttgtagcggtgccatctatctacagacaaggccccagcactgggtggggattggataaggagacctctctgatccctgtcagccctaagatccccaaatcctttgactgtaggcctaagcctgttctctagaggcttgtctagtttattgcttaaaattattttttaacatttaataaaatggacccatcaaaaggctagaagcagacaatcatcaattaaaaatcaaataatcagatcaaacaatcaggcaaaacaattttaaaaacccatccattactatgaacaaccccatcaataggagaccaaagaaagagaaataactgacagcacttagcgagtaaaatacacttatcagcccacttaatacacactttgtgacatgtaagagcctgattctatgtggtcctgtaccaagagagatatgtgcacacatactttatgcattctcagaggttatggtctaaggaagacaacagagcagagttggcagagggctctccagaatgcggtactaacaaacagggaagttatttttaatacgtaatcaatcaatacgggtgtctttatgggattctcttatatcacaagctgaatttggaagctagatcggtaagaagctgattgatcacattttatgaagtttattgctttttaacagtaaaactcattttagtagaaatagcaaatcgccttttgcaacctctaataaaataattgattcaggcaaaaatcatcaatggctgctaaaacctttgggtgagaggcttctggggagctagactattgcaagatgtcaacatgttgccccacagattctctcccagtgagaagggggaaaatgcaagatgatgatggaggggtcaggctgtcaacatctgaacccactgatgtacttagcattgctaaaagaggacaaacagacatgacatgcttcagaataggagcaggatgaagcacccagcattacctgtgaggtacttgccagaaaatgataaacctgaatgtttgcaagcctttggtgctaatttccatgttttaggaaatataggggttaggaggagttaaatgacaatgtgaggacacagacagataaaacagaatttaggacatttcatgagacaactgacccgatttctttaaacaagtcactgacatgattttaaaagttgggggatgcagggcagggaacaataccagattaaaagagccaaatgccatgtgtagatcttactggatttagatacaaacaaaccaaaattttattttatttttttgagacagggcctcactctgttacacaggctggagtgcagtggtgggatctcagctcactgtaacctcgacctccctgggctcaggtgatcctcccacctcagtctcccaggtaactggaattataggagtgtggtaccacacccggctaagttttgtatttttcgtagagacagggtttctccatattgcccaggctggtcttgaagtcctgagctcaagcatggaggccagcccaggcctcccaaagtgctgggattacaggtgtgagccactgttcccgggctaaccaactttaaaagacagtatgaggacaactggagaacttggaatataacttggtattaggtgagattaagaagtgattgtgataatggtcaagcgatcatataagaaaaatgtccaattattttcagagatacattctgaaacatttattagtcatatgtcaccatgcctgggattttctttaagatatttcactaaagaaaaaaatagtcccggtgcagtggctcacacctgtaatcccagcactttgggaggccgaggcaaatggattgcttgagctcggaagttcgagagcggcctaggcaacaaagtgagaccctatctctacaaaaaatataaaaattagccgggcatggtggcgcatgcctgtggtcctagctactcaggaggctgaggtgggaggatggcttgagcctgggaggcagaagttgaagtgagctgagattgtgccactctactctagcctgggcagcagagccagatcctgtctcaaaaaaaaaaaaaaaaaaaaaaaaaaccaagaaaaatgaaaggtaataaagaaaaaaaaactataaaaaagaaaaaatcatatagggaaatgttaatctttactaaatatactagatgtaggtgatgggtaaatgggagttcattccatagaactgactttcctactgagccctgtctcaccactgcccgagcccacagggctgtgagagcacccacaacgctttggtgcacacatttttgaacaaacgaatgaaactgcattgacctaaatgaaccaattgcagaggggtgtggacgagtgtgggttgggggcagagctctgaggagagatggggaggaggtcacacgtagctgggtttatggaccatttcaatggatttagacagcatctgacctcaattaaaaccctcctttcttcaaaaacacactcctttctcatctctttgagtattttaagacaaggcaaaggtataaggtcctaatttgtttttatataacccatgccaaggccataggcccaggcctgatcacagggggagattggtcttttgaagccccaagttgttaaaccacaggaagtggaacttggtcaccagtaaacaggtctggaccattaaatttgtaattatcatgagtaaatactatcttgtttttcctgggggttgggtgtgaggaagaagaaaaactttaaaaaaaaaagataatttggaaaacatcttctttaaaaaaccctgccattttattgggtgcttactatgtgcaaagcacaatgctcaaaagcattttatctgcatgatttcattatcctcaccacagtcacgtgagtgggccttctcatgcccattttacagatgaagaaactgaggcgatctgactacaaaacacatattttaaaagtttcccccaaattatgtacctgagccacgcacttaacattcacaggataaattgataaaaagccccaaattgttcaggtgctatttatttatttatttatttatttatatttttatttttagatagagtcttgctctgtcgcccaggctggagtgcagtggcacaatcttgggctcactgcaacctccacctcccaggttcagtgattcttgtgctaatttttgtatttttagtagagacgaggtttcaccatgttggccaggctggtctcgaactcctgacctcaggtgatctgctcgccttggcctcccaaagtgctgggattacaggcgtgagccactgtgcccggtctgtcaggtgctattttagagggcacctccagcccaaggtctttgaaaaatgcaactgctattagtggtattaaacaaaatttattggaggtcattgatttggactgacctcctgctctaggcttaacagaacaaaccaaaatggtgtcacttatgctaaagtttgatgtcaccaaactgaaactaagttgtttatctgaccttccaagaaaacaggagagagagaaagataatagccaaatccccagataggccagttttagccagcatgataagaagtcccctctgctttaacctttacaaagaaagttaactgaagttacctgatgctaactggttgctttttgttctgattctgctttcttcagcccttttctgcctgtaaagccaacctcctctgctcagctcattggagcactttttctcagtttttagagaaaaatgctacccagcttcataagtcacaaataaaagccaattacatcatttaactaaatttgtcataattttgtgttttgacagaggggtaataatcatccagccctcagacccccgacacggtgtcttcacctcctgccagtgtttcaggcttcctgaggtgcagcccagctgggacgtggaaattcccgaccctacacaccaccgcccgcggggaaggaaacatggacctgcaccaaagtgtctttactgtgtgccatctgattgcaaacagaactgggctttccaagagaaactgaggacagtggagagcttttatcttgaacccgggaggtggaggttgtagtgagccgagatcgcgccactgcactccagcctggcgacagagcgagactctgtctcaaaaaaaaaaaaaagagcgagagaatggccacagaggcccgggcattagggcttactggaccagggatgctgcagggggcttgggcttgcggttagagaggggccaggttttgctctccccaaagcaggggtccaagtctccccaaagcaggggtccaagtctccccaagtggggccacagaaagcagggggctccaggttaaattagagcctccaggccaccccacaccccgctctctaccccccagcactttcacccttaggttttcttcctccagggcacacagaagagcagatttctggcaactgtcagaaatctgaccccccaggggtccagcccaggagagcgagttacaagaagggcagaggtcggggaaagcgtgtcaggggccagtgctctccatgtgcagtgcgaggtcactgtcctgtggtccctgaaatcttctgggagcccaggcagccaggatagaagagctgtagaggaagggggaggaggaaagagagagaacaaagggaaaaaaaagtgaagaaagagaggaggcggggaaggtaggaagaggaccctaacttcctggagaggacctgggaacattgagaaaccagcccaggattgctggccaggaggatgctggtgtgtctctggggagcaggctcctttcccatctcatgcaactcaagagtctgagccccagtgatgggcttgcccctctcctccaagcagctctctagattcagtatcctggacccatttgggggtttttcttcctttgaagcactttgaagcagctgagtgaggccccctggctggacctcctaagtcagctgtatgcgtttcgcatagctactcacccgcctgcagcccagcctgcacccgatcagttgagagggatctggtccacagaggctgaggccaatagaggacagtgccccttctgcacctgcctctggctgtgagctgcaggatgtggtcaggagaggaagcgaggcctaggcccaagtcattctggggtttccagagagcttctcacccagggcattgacagggcactgtctgggtctaggcacgcctccctctcctcatccggcccctggagcaagggtcgggggaaagggagagtggggaagttcagcctcctccccctcttcctctgcctggccagagagcctgaggattgtgaaattggaccaggatagctccctccgggcagggagaggactcagtgagtccctctactgcgtatgggggaggatggtgcttcagggtgcgagcagctgcccagctaccatgcagcttttagaagctcagctaaggacatccaactttgcttccctttctcctgcctagcaagaactcaaaggttttccccacttcccttccacttcccagaaaaccccatctgatggagaatgcttgccccttcagccaaagtgggaaggagagagagctgatgggggcttagcgacctcttccaaatcgcacctccttccttcccctacatgggctgagcagtcagtttccaatgaggactctggtttctgcttccatggtgcctgcttctgaggcccttgacctcttccctctgcctttcacccactctctcccctctgccacaacaggagtctaggcgccatcgccctcgcctgcattcctgcctgcctatgctttctccccactccaaccactcacatgccactcatcttctaaaggtcagtttgcccagttcatctcctgggtcaacgtttttcagcagtgtgatggttaattttacgtgtcaacttggctaggcccagtgcccagatatttggttaaacattttttcagatgtttctagacggtgttttgttgttttgtgtgtgtgtgtgtgtgtgtttttagatgagattaacattgaaattaatagactttgagtaaagcagattaccctccaatctgtggaagtcctggttggaacaaagtctgatctccctggagcaagaatgaatcctgccagcaggttgcttcgaacttgaactccagctcttccctggatctccagcctgagagtctatcctgcagattctggatatgccagctttcacaatccaatgagccagttccttaaaatcaatcaatctctctcttgcattctctctctctagatatagctatctatacatacacatcttactggttctgtttctcagagagtgctgattaattcaagtagcttctcttcaacttcagtataaaaatcttaaatcctcacctagcccacaaggctcttagtcatcttacctcatataatgcctttgtacaaattagaaaaagccaccctctctaggcagatacagctctgaccaaacatagggcgaggtgggtggagaatggtgaaccttccctcttagtatagtgcacaacctggacaaccacatggagttgccttacttttgtttgtttgtttgttgtgtgtgtgtgtttttaattgagacagagtctcgctctgtcacccaggctggagtgcaatggagtgatcttggctcactgcaacctctgctgcatgggttcaagtgattctcatgcctcagcctcctgagtaactgggactacaggctcccagcaccatgctcgctaattttttttgtattttaagtagagatggggttttgccatgttgcccaggccattcttgaactcccgacctcaggcgatccgtccgtattggcctccgaaagtgctgggattacaagcgtgagccaccgcgcctggccgttcgttgtgggttttttgttgttgttgttgttttgagacaaggtcttgccctgtctcccaggccggagtgtagtctcgggatattggctcactgcaacctccgcctccctgctcaagtgatcttcccacctcagcctcccaagtagctgggactacaggtgcgtgccaccactcctggccaatttctttattttttggtagagacaggttttcacaatgttgcccaggctgatctccaactcctgacctcagtcgatcctctggcctgggcctcccaaagtgctgggattataggcgtgagcctctgcgtctggctgccctgcttctggatgagccactgactgacgaattagcctcgtctctcttccatgttctttccctttactccttcctcatcccaaaccctaacctccctgcagctcctggaacctgctgtgctcccttgctgctgtgcttttgtacacctgtcactgctgtttcaagtccctctcttattttctggtattgcttcctctggccaagttttgccgaggctcagcctgggtcagccttccctcttcttgcccggggtcctagcccttacttcaggtactgtgctgcttcatcactcgtctagattggagaatcctccagtgaatggggcttgagctttgatccatcgtgctgggcactagtaggtgctcaataaatgtttattgaacaactgaaaaccgggaagtgaatgaatggatgaacggggacacagcagctcgcagcgggcagcaggaggcgctcgccgggagggtgctccttcccttcagccagccggagttcagccagcgggcccggcgggaggagtgggagtgggccggggccagggccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcgggtacgtcgtcactcccgcgtgcggccccgtcccgactcttggatcggactcttcagtcccttcttgcgtcttcccctctttcctctgggccttggtatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacaggtaagcgggaaaacttcggggcacccagtgcgggtgaactggggcgggggatcgggcccctgaacccacggtcttcagccttagcggagggtgccctacagggaatggggtaattttttcaaaggggcaggaattctgagttcctaccaaaaatgcacatttccagtccctcaacctttctccttcgaccttcttcgtgcctgtggatcttcctggccaggttccgggaagccagaaagcagccaaacaaaaggagcaaagtctcgggccagcctggatgtggagggcgcagtgggggaggggagcagggtggacaggacaaaggggctttttagagaaagcctagaggtctcatttcagggcgcattccaagctggcttggagttcccctgtcccagcccacttcacctttgcttagtggaggcgaacacctttcctagtgagcagggagcagacgcgagtaagaaaacagtgaaggaaccatctcctacccctcttgcctggagggtcccgggctatttcacttcttccttttttcactgttgtctctagcgctggccattgattccttaattcttgaagtaagattttagcagtgcctgagactactttgctgggggctgttggggatgtgaagatggtaggacgaggcccttgctttaaagaacttccaatctggtgttatcagaagaccctaaaagaaggaacttttttttaaaaaaaatggagagtggatggctacagcgctggggaagagttttctgactcgggacttttcctcaggaaacgaaaacactgaagaggtccagtttctcttccctggggaagggctcttgtctgcaaagatcagattccaagtactataatgttttgcaaggaaataccacttcctcaccaactggtggtctggacggcactctggggtttggggctggggcatcagtcccctgactccccggcctgactggagtggggagctgtttcagattcccagctggcctctggagtgcccacctcccccattggtattttgaattgaatgacatggccatcagagagctccaaggatggctccccggggttcttggcaggaggtttggttagccagctcccttccaaacctcagattctgcaaggttgggaaatattgagcgtgaatttgggggagcaaggtgtttttgagaattccaaaggatcaatgcaaacagtgagattgagcatctgtactaacctcccctgaagtcagagatggaggattacctgagggcagggattcttaactgggttcattggcattaggcatctgtagatggaattcagaggatgtgtaaactaggtgaggcaaaaaaagatatcattgtttttcaccaacctttaacagattttaacatcacctttagttatgaagacaacaaatcacagtagcattggcagtacctgtgactttgccattaatagaattcatagtttcatatcacactgcagtcacagcagtcttgaaatgttgtttacactcagcccttgtgtgaaattacccactgctagaccctgcttaatgttaataaagaagcatatatattgctatgtttttatatttttagaactttatttcatataattgacttttttagtgatcttcttaattttattttatgctcaagaaatgtgaactgtgagccaattcacagctggtagaaacttccaccaacccccacctggagctggagatgggcaaggtggaggaagggccgcttatgcccagagtcaacccctctctgtttgactttgtaagaaagtgccaagcctctatggggagggacggtgtgtcacggaggactggggaagggcagggctgcaggctctttgggagacccagagaacaagctcccaatggggcggggggaggaagaactgtcccctcttagggcccctcagcctcagcctgggcagaaaatgaggtggtcagcctggagcactctggggctagcattgtttggaaaaagggtgtgtacaggaatgtgaaggtgtgctgggtgtgtgtaccggagcagtgggggatgctgggggactccagccccatgagttccgctccacaggagatgcctggtgaaagcaaacttcctctgtcatccctgcacttgggggtagggagtggggacaggactttttaggggctgggggaggggaagcaatccagacatgtattgaggcactggaatctgggtcgggggaatggtgggaagatcagagagtggggggaaagggaggtggtaagatgaagacttgaggggtgcagcctgctggggacaggccaggcaacagtcagcgttagctctgcttccgccttgaaataggctagattccagtttcccatttgcttgggggtcggtgggatgggagatcttgaggcttattttttataggaaataagttccattttggtctctggctccttgcatttggggagtggacttagggtctggggtcacagtggacctcctgtggagtaggaaacaggacttgggctcaggtcagtgcctgtcagtgccccatgaacatgcgttgctgggggatggatgtaaataatcaacagagaagtgatggcctcgatacccttgggggacaatgtctgggataaaaagaacagcctgatcctctctctctaggattctagaacttctgcatattggaattccagctgccttgcctgaggttttaaaatcctcactcgggagagataaaacccaggccttggtcttcatttccatatgtggggaagagcagtgacccatccctgtcagtttgtaaatgtcctgcttgttttttccatggacagtggacatttcaccttgcttccggggtgcttaacaggcctcaatttctggaaagagaaactgaggtcaaaggaaggcagggagagccagggtcaggacaggagggcacgcaggtacctcacagctcagaatgttgtactagggtctcttgaggccatgaagacatgactcttgttgttgtcttctttggggattcctccatgggagcccctttttccctgctaccctcctgccccccggaagtgcagaggcccaggagctgcctgctggcaccagttgcacgggattagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgagctggggatgagggattttttatttttatttatttttattttttggtgtgtgtgtgtgtgtgtgtgtgtgtgtgtgtgcgcgcgcgcgcgcgccaggtttccccgagcagaggctgagcccggccccctgggctgcccgccaaggtggccaagttgcccggcccctccagctggtctggccaggtccctggggagctggtgtgatgggttgggtggtagagggaggctctcagattctctgcttccggggcagggtggaagccagcacaacccctgtcaaggctccttacagcctcttcagcttgaggagctggcctgtgggagtcacttccccaaggacagggcactggccaggcagagggtagagatgggtggctcagcgcctccaagccattcctggagctttgactgcccggagcccaggctcatgagaaacagccccttccccatacctggaagactgggacccctccttggggtggtgaggaggcggggctctccgcaggcccctcccccatcggcaagagtgcccacagcccctccgctgcctggggtcccactgaggccaggggcggggagcgccaccttggacacttccgtgcttgccctgcagggaccgctccagggccccggagcacagcgccccctggagaggctgtgcccggacctgaggcgccggcgtgtcaggtaaaggggtcccccttcccgccagttccctccacagccaaggaaggggcggggaagggccccggccctcgctgcccaaggggcgcctccagccttgcctgggtgcggccctgggggccgcggggatctgtgggcctcaggggtctggggcactccattcttggggaaggtaggggaggggagacggctccagggtctctggagaagttgtggggtatcctgatctcagacctgagcgcttcgacctattatttgtggggaatggggcgctggattctgtattttagacgatggtgagttaggcccggggaaaacagggtgagcaagttcccaggggatgacctgtccaaggggcagctcccaacaacaggacagagaccagctaagaggggggatacaaaagagacggacacaggggcagagcaaggccctttaaggcagtgagcgatgggacgcgcccgtttggggacccgaagtgcagggcggtgagagaaccaggttgcacagcagtttcttcctggtccaccagcaggcttccctgggccatgtctgggaggggcagacatgtgggggctcttagctcccctaccatagggcagaagtaaggttatgaattagggggtggggacagaagcctctgggaagaggggacctcgggattttagcagcaagactcccagaggcaatttggcctggaggcagagggatggccactgtgacctaggagcccacctgtgagtctgagattctctatgctggaagatcccagaatggaagactactaggcaaatcaggagggaccagggcccttcagagggtcccgaatcttcccatggggaagaaatgggaagctgaccctggaacccggcactggccctactcaaccaattccttttgtggtaaatgggcagggtctgcctcctgcagcttccccctggagtgagtgcagaggctgtatccctaggaaggagtatcttacaccaggcctgcccactgttctcatcgcaagctgcaggctgctgccccaagtgtacagatgaatccgagttctaacaagcgaaaaccaaacagagtaacctttgaaccatcgacattacaaatctcttggaagtccagcttaccgggtgagcagttggttctgtctctcaattaactgtgggtgctcagaagtggtggtgattgcacaagccctcgcttgaggtgtacctaatgggcacacatctgcccacttctggctacccctgtcacagctctagtctctgcatgcctgtgctttttcaggcctgcctccctgagaagcctggagctgagccaggaacaagacattgcctgagactttcagtgacacctcctctagctgacagctgttcaggagagccagaacgctctctctctctctctctctctctctctctctctctctctatatatatatatatatatatatatatatataatttttttttcttttgagacatggtcgcattctgtcacccaggctagaacgcagtggcaccatcatacctctctgcagaggtatgacctgggctcaagcagtcctcccacctcagcctcccaagtagctgggagtacaggtgcgtgccaccatgtccagctaatttttggttatttgtagagatgaggtctcactatgttgcccaggctgttctcgaactcctgggcttaagtgattctcctactttggcctaccaaagtgctaggattacaggcatgagccactgcacccaggcagagaaatctttagataacatctacatgccaacaattcccaaattggtatctgcagtccagatctgcagttctggaattccaggctcttacatccgactgcctattgatatctccactttgatgcctagtagacatctcaaaattaatatattccaaactgaactcttaactttattcccaactgcaaatttgttctgttccccacatcagttaatgggaactcaatctttccagtgtctcaaggccaaaattcttgacttctctctctcatactcacatctagccatcaactattcctattggttctaccctcaacatggatacagaatctgatcatttgcatctaaccacctcccttggtgtgaaccaccgtctcacctctgtattattgtcataacctcccagttggtctcttgcttctgcccacaccccatgccattctccacctctactcctgatctattctcagctgaacagccagagtgctgttgttaatcaaagtcagaccacttttattcaaaacctgcccagggctcctgtccccagagccaattgtctttacaataagctacgagtccctcatgatctgccccattactgctttaccttcacctcccaccactcttccctgctcctcccattccagacacccaggcttccttgctgttccttgagctttccaggcacgatcctgcctctgggccttcacacttgctgttgccttggcttagaatgctttcttaccagatatataaatggcttgccattcacgttcttcaagcccacttaaattcaatgagattttctttgacctctgtgtatatacaaacccaaatgggcaaatacaaaataaaaattcttttagaagggtagttcctatgaaggaactccctggtgtgtaagaagctctgtgacagcaaagattattgtctcttttgttccctgatgtgtctaggagagtccttttacatagtaggtgctcaataaatgtatgctaaagaatgcactcattgatttcctactatatgccaggaagcattctaattttttttcacatattaatttatttaaatccacaacaataatagatactgtgatgatcatccccaggttaagatgtcagaactgaagcttgggggattttagtttgctcaaggtcacttcttacatgtattaagactcattgttcatttaatcctcaaataataacagatagtatcatcttccctgtcatacagatggggaaggtaaagttgacagagtttaatttgctggagatcacagagctgatgaagcagaggagctgaacttggaactcatgcagtttggtgccagggtcattgtgtgcagctcccgtgctttgggtccaagtcctattctgagaggcttttcttgcagggcagtgtgagagggcagcagcaacttgaactcaggcctgtgtcccatgctgctttggagcccagtggtgtcaccagctccttcctcttgctttaccttctcccgacttcacttggggcaaacaggctgtattcctggcctcaaccctcaggctcagagaggcatgccctgaaggctgtgccagtctagttggcaaagaagcctcccaggctgacttggggtttcaagtccattcgcaatcaaaactttcaaagtcagtctaggacagccctagaaatttgtggccactgggagtgacttaaaggtctcctcccaattgtttttccatcccgggccattgggccatacctgatgcagaaagtcttttttttcttttctttctttctttcttttttttttggagatggagtctcactctgttgcccaggctggagtgcagtagtgcgatcttggctcactgcaacctctgcttcctgggttcaagcgattctcctgttctcctgcctcagcctcctgagtagctaggactacaggtgcatgccaccacactcggctaattttttatttttagtagagatggggtttaaccatgttggccaggctggtctcgaactcctgaccttgggtgatccacccacctcggcctcccaaagtgctgggattacaggcatgagccactgcacccggctgaaaatctcttatctaatccccacatgatggcctttccactttggcttccattggcctagagaagctggttctggggaccctggtagcttctgggccttcttggtgggcaggaagggagggggaggatgactctggcttcctgttccatctggtggaatcagctaaactcccccaactacatcccttttcaggattgcgccaatcagaaagagaagcctatgagttcatagtggactttctagaagaagaacatatggtaagaaagttctctggacctttgtgtgaactgaggcggaaagtagaaaaaaataagagggcttatgcctccttgggttttgagtaccagccctggcttggaagccaccagatactcagcccattgttgcctcgtgactgggcagatctttggtggctaggccactggacagggtgtctagggcttagatcttgcagttcccttcctgtaggaaggatctttgtcagagatccttagccccactgtcctccagagccctacacaggtggccagacattggtgagcagcagtcctggggacagggacattgcactgagaaaatcaagtgagcaatccatcctttggcctagttgatgggaatctgggctgggtgtgaggagcaggggtggggtgtaggtctcaggtgctgcctgtgggcagagcctaagggctgaagcccagcttatgggcagcaatctgtgtattgtgtcctagtctgagttcaccaagctgaagttcctgagagctgtggaaaccttgagtagtgctgtgcatggccaagcagacggcaatatggacgattactatcccaaagccatcctggccaagaaaattgaggtgagaaagacccaagctcttctgggagttggtcattcagggatgaggatgacaagtcccggacctgagggctggcatctctctctgaggggggttcttgttttttttgttgttgttgtttgtttgtttcctggcctttctagatactaattcttgaagaatccactgagattttgatgggcaacatgcgtcagcaagccatgctctgcatcgtggcgctgaggtgcctttcctgctcttaccccctcagagcgcctgggtctcttgtgctcagaacatttgggttgggaggaagggcaaggtttggggacttaaattttggcctgtgggtggcatagcccccgtgtctgccactttatctgcctgcatccttgggtggagggggtgttctccaattgtacttttggaagcctattaagacgtccagtgagggaagcttccctagcaacccaggccctccttccctggaggagaggctattagaaagtgtttgggggctcagatccccactgtttcctgcatctcagaaacagcagcagagcacattctcccagagggtcccagtctctcccagggaccccaaagccgcttgtcattccctgcctctccctgcagtcaggtgaatccaccattccacttgtcccagaaactggatctggtaaatgtgggcgtctccagcctgttctctctgccgcctatcgtgcccagcctgtaccgaagagacaatgcgagtctctacctccaggtaatccccacctcttcatggagagctccacggggaggttttgtctttggagtcacctcttgccctttaactctccctcctttctcctgctctgacctctctgcagagctcttggccccatgttcctggggctgctaagaagcactccagctgtcgtaccctcacctgtctttccagggattggcccatgctcccaccctatccatgtccttgttcactaaggctcacagcagcctcagtcacgggaggagacagtctgataataaaacccacagatactgtggagcaactgaccagtagactgccaaatcttcccaggggcctctaattttttatttcatttttaatttttaaattttgagacggggtctcactctgttgcccaggctggagtatagtggtgcaatcatagctcactgcagcctcaacctccggggctcaagctatcttcccacctcagcctttgtagttttaaaaatagatgtgtcctggacctagcggaatgaatctaatgcggagagtcccacgggatctggctttcttggggagaatggcccaatgcctacatttcaccaatgggctcacaatttgggctggacctggtccagtcttcattgagaccaagaaaagtcagcaccaaggaagatcagagtgtggctggccatgagagagagactgccgggggtggcagagccaggctggccccacttccttcctccagaggtaggggacaaggagatggagtgcccccagggagccgagctggcactgtggcagtctgttctggacactccctgtctcttcacttgtcagagggtccaggccttagacaacatgttgcaggctcttgtgatggacaggatgaaccctaacatgctcatactacaaaacttcctggaggtaagtggctgtggaaatcaaggaaactgaaagtccatattaattctagtatgtttgggaggaaaggaaaagaatatcaggatagcctaggtgtcattctagtccaaagaccatcggttctcaagcctcagcatgcataaacatcacttgaagacaaatttctgtatctcccacgaaataccattttgaggatcacagttttggaaacatagcccactaagctgaggacccatttctgcccaggacttggacatattggggcttcgatggtaataacatttatatctgtgccagactttaatcttcaaagtattttccccttttgcagcatctgccattgctctgtgataaagaagacctcagtgcttaaccacaggctactcttatatcccttaatgtaatccccaccagagactcattgtacttctttaactgtctttagagcttcagagcgtttcaaatattcttagttatgacaaattgttatctcctgagggtagttgagttggggaaacagccaagaatcacttgaaaccgactttcatgaacacgatggtaatcaattacggtaataaaattttgcataaagcattaggtgtgactacaaagaaggagacaagattgcccaggcatcttataaaaagaccttgacaaggccaggtgcagtggctcacgcctgtaatcccagcactttgggaggccgaggcgggtggatcacttgaggtcaggtgtttgtgaccagcctggccaacatggtgaaaccccgtctctactaaaaatacaaaaaaattagctgggcgtggtggtgggcacctgtaatcccagctactcgggaggctgaggcaggagaatctcttgaacccaggaagaggaggttgcagtgagctgagatcaggccattgcactccagcctgggcaacaagagtgaaactccgtctcaaaaaaaaccccccaaaaacccaaaaagaccttgacaagggctttagctagagggaaatttgtccacatttggatgagtgacatagttcttttggaatgtatcatctctggtatgtttgttgagaaggatttttgtgctttttaggcaaccttgctataaatgtaagaacaaatgttctgttgttcttggagtctgtgggggaacagagatgcaaaactttggtcctggtcagggtacagtcttcaagagatccattactggggttctcattatccaaagataaatgatgccctgcaaaattaccacctgaaacaggttccaacattttgtataaaatagtggaggaatcaatttatcttgataaataaaattaaaagtataaaaataagttatttttatgcgaacaaaatgtatttttgctactttgaggtaattctcagtcaagtgtgtatatattttagacatatttttcctacaaaatgacatgatagcataatacaacatcatttatttcacatttgactttgcagagctggatcagaaaggtcgaatttgagggctatatggttttcttaagggccctcctttttcttttgtcttctttttttccgttttaaaattaaggtataatttacatatagtataattcagcttttagtgtgtagatctgtgggttttgacaaatgcatgcagtcctgtaactacagccacaattaagctatagaacagttctatcacccccccaattcccccatgactctatggtcaaccccttccccattccccatccctggcaatggctgatttgtttcctgtccctatagttttgccttttctaaaatgtcatctaggtgcagtggttcatgcctatagtcccagcacttcaggagggcgaggtagggggatcacctaagccaaggagtttgagaccagcctgggcaacatatgagaccccatctctactaaaaataaaagaaatatattagctgggcatgtggtgtgtgcctgttgtctcagctacttgggaggctgtggtgaggggatcgcctgaagcctagaggttgaggctgcagtgagctgtgatcatgctaccgcactccagactgggcaacaaagctagaccctgtctcgaaaataattaattcattaattaagataattaaaaatgttatctaaggctgagtactccagcctggggaacaaagtgagaccctatctcaaaactaaataaataaaataattaaaatgttatctaaggctgagtacagtggctcatgcctgtaattccagcactttgggaggatcacttgagcccaggagatcaagaccagcctgggcaacagtgagacccccatctctacaaataataaaaaaattatccaggcgtggtggtatgtacctgtggtcccagctacttgggaggctgaggtgggaagatcacctgagcccaggaggtcgaggctgcagtaagctgtgacagtgccactgcactccagcctgggcaatatacagggagaccttgtctcaaaaaaaaaaaaaaaaaaaaaaaaaaagacatctaagtagaattatccagtaggcagtctctggagtctgtcttctttcatttagcataatgcatttgagatttattcatgttgttatgtgtatcagtattttgtttctttttattttttaattgagtagatggatcacagtttgtgcattaattttccagttgaggaactttggggttgtttccagactgggatgattacaaatgaatcttctataaatctttgtgtgcaggcttttgtatgaacataggtttgtatttcacttgagtaaatttcttggagtgggactgctgtgttttatggcatgtggatgtttcactttataagatacttcccagcccagcgtggtggctcacgcctgtaatcccagcccttggggaggccgaggagggtggatcacctgaggttgggagtttgagaccagcctgaccaacatgaagaaaccccatctctactgaaaatacaaaattagccgggcgtggtggcacatgcctgtaatcccagctatttgggaggctgaggcaggagaatcgctggaacctaggaggcggagattgctgtgagccgagattgcgccattgcaccttagcctgggcaacaagagcaaaactccctctcaaaaaaaaaaaaggaggggggatacttccaaagtgttttcccaagtggccattttccacttccactagcaatgtgtaagagtcccagttgctctgcatccctgccagcatgtggtattgctagtgtttccttttagtcattcttatagatgtgtagtggtatctctttgtggttttaacttgcgtttcctagtgactaatgttgggcacgttttcatagtcttatttgccatctacatatctgctttgatgaagcgtctatttaaatcttttgcccatttttttattgggttgttttcttatttgggggtttgagggttattttattttattttattttattttattttattttattttattttattttattttatttgagatagaatctcactctgttgcccaggctggagagcagtgacaccatcactactcactgcagcctcgaacctccccgagagaccttcccacctcaggctcctgagtagctaggaccataggtgtgcgccaccatgctccactaatttttgaatgttatgggccaggcacagtggctcatgcctgcagtcccagcactttgagaggctgaggcgggtggatcacttgaggtcaggagttcaagatcagcctggccaatgtggcagaaccccatctctactaaaaatacaaaacttagccaggtgtggtggcatatgcctgtaatcccagctactgaggtggctgaggcaggataatctcttgaacctggggggagaaggttgcggtgagccaagatcatgccactgcactccagcctgggcgacagagcgagaatccgtctcaaaaaaaaaaaaaagaaaaagtttatgtagagctatggtctccctatgttgcccatactggtctcgagctccagggtgcaagcaatcctcctgccttggcctcccaaagtgctggtattacaagtgtgtgagccaccacgcccagccttgagagctctttgtatattctggatataaatattttgtcagatatgtgatttgcagacattttctcccattttgtggcctgattttatacagtgtcttttttttttttttttttttttttgagacggagtctcactctgtcgcccaggctggagtgcagtggcatgatctcagctcactaaacctctgcctccccggttcaagcaattctcctgcctcagcttcctgaataacagggattacaggcatgtgccaccacacccagctaattttcgtatttttagcagagacaggatttcaccatattggctgggcattcattgaatgcccacatcgtgttgaactcctaacctcaggtgacgcacccacctcagccgccgaaagtgttgggattacaggcgtgagccactgcacccagccctggccactcttaacagtatcttttgaagagcaggtagttattcattttgatgaagtccaagtcattatttttttttatggttataggaatttttgcctcccttaagtattttctcattttcttctagaatcttatcattctagattttaagtctgtggtcaattctgaattaacttgtgtattggacggtcaggtacacgttgtagttcatttttctttttttggcacatggatgtccatgatggggttcaatgctctgggagaaaggctaccctgaaggacacctgtccagcagctatgatacgggacacactttcccaaaagtttgtagcaagcaggacacaggcctgtcttccctggtgggatctcaacctagtgtggtaataataacacttacagggaagtgttgttatgggaggatagagtgcattattctattcagaatacttacctgtgtcactatgattattaacctccagaaatgaatggctctgaatctcatccttcagagaccactttaccccttcccctggcctagcaggtaggggtttgcatggatatgccaccaagagagccctgtctccccatcttatcccattcctgcttacccactgctttgtaattctacatctaaggcacagcactgtctttaaacattcctgtcagaagagacccagaaggtagcaggtgaagccccggagacttttttttttgagacagaatctcactctgttgcccaggctggagcgcagtagtgcgatctcagctcaccgcaacctccgcctcccaggttcaagccattctgctgcctcagtctcccgagtagctgggaccacaggcatgtaccaccacacccagctaattttttgtatagccccggagactcctaaacccacctttgctttgccaagttcatggggccgtgtgctctggtgcctggcacaactccctcctttttgtctttttagcagtcagagatgtggaattgagaaggaagggagcagcactcccacagaaggggttcacaaggtctctttactccttttccggatcatcataccttggtcattactgtcagacaaagtgtatgaacagatgcgggccttgggcactatttcctggctgctgaggtttatttgcaattttcccgaactgtcagtgagtgcttggagtggggggaaaggctgacccagtgggccctgcttctctgcacatggggtacctgagagtctgtggttctgcagggggttactggggggtgggtggtcagagtgtccctctttttttgcattagtgccttttctgttcctatgggggaagaggcttaacttgtttgcttggtttgcccttggccaagtgagtttcaattggctggacacatctcagccttgttgggggaccttggcctaaacagctgggttgggtccacagcttcccactggctaacatattttagggatctggctgccccatttccctgggtgctgctttgaaaggttttcttgggcagggaaagagtgtggagctggtgtggtgaggggatacctgcaggcaaatgatttagtggtgtagaggggtggggaggttggagagggatggtggccacagtatggggaatttccttttggggtgatggggagttaaccagtttcctcttctgggcagcacatggaggaattctcaatgagtgggaaactgatgagcatcttcggcctgttcgtcatgggctgcaaccacgagatcagcatagaggcatcagaggcgttgcattacctgttcaaaatccttgtgtttcagagaagtaagcaacatgagcctgagtggccactgggctacagccgtggggacccatgaataacaagagcatataagcaccattcactgaatgcccacattgtgtcaggcacacgatgaagggcagttccttctcatgagggcaatggagtaaatatgctatgatgccccaagatgagggatccccattacaagtagatctggaaactttatctggatgagctccaaccccattgctgatgcaatgccctcttgtaagagattctaagagattctcggggaaaaggggagctaggcttgcagccacctgtggaatcaacttggatactcaatatttctcagtggtctcagccttactgctaggcctaagactgggaaaatgaacatcttttcttagggaacaaatttgggagtgccagattgagaccctctttgctcaaggaaaacaaaaaatacaaagagtcacacacgcttacagaggtgccagaaggatttgcaaatatccctaaaaggagtttcagaaactctgacttctcatggttcaacagggcatacttcttataagggcatttgctcagcacccacgggtagaacagtccacattctggcacggcgcaggaacagctgcaaggaccagactgagtccccagccacattctccctccacccattggcctggtgctggggaactcttcccattctgttgagcaaatgttatttcacccatttcactctgttgatcttctctgaggtttggaggggaaataaagaagggtgtgttcctatttccctgttaaggccctgccccttaattgttgtttttggattgaaggtgtgaaacaaaagacagagactatcctgaaggatttgcagaagcatttccatggagcatggcttgccagcctccaggatctaacactggtaaccctcactctccacagtgcatgaaatgcccagatggggagccatgacagggaagaaagagagctggggtggggagattgtagagggcctgggtggggccacagaggagtactccttcacccaggggagtgtctccaaagctcaaggtctcatggacagcaggctggaggggtaagactcattccctagctgcacttgagttgactgaggcttgaggtcactgagagagttcttttttttttgaaatagagtctttctctgtcacccaggctggagtggcacgatctcagcttactgcaacctctgactcctgggttcaaatgattctgtagcctcagcctcccgagtagctgggattacaggtgcgtgccaccacgcccagctaatttttgtattttttagtagagatggggtttcaccatgttggccaggctggtctcagactcctgacttcaggtgatccacccgcgctggcctcccaaagtgctaggattacaggcatgagccactgcacctggccaagagagttctttaaaagacgtatagtcaaccctattctcctcctacagattgtgcccttgtaccttatttgtagcctagccttaatttttttaattcagtaaagatgtattggttgtcttagccgggtgtggtggctcatgcctgtaatcccagcattttgggaggccgaggcaggtggatcacgaggtcaggagatcgagaccatcctggctaacatggtgaaaccccatctccactaaaaatacaaaaaaaaaattagccgggcatggtggtgggcgcctgtagtcccagctacttgggaggctgaggcaggggaatggcgtgaacctgggagatggagcttgcagtgagccgagatcgagtcactgcactccagcctgggcgacagggcgagactccatctcaaaaaacacaaaaagatatattggttgtcttagatatggtgtctccaggctcaatcaactcaaatcactacagtcagaaatccaggagtcatcccttgctctttcctctccctcactcttcacatccaattcaacaccaggtttgttcattctgcctcctggatagctcttgaatttgtccactctgctccagccccactgtggggcccccagcatctcttgcctgggtcactccagcagccccttactgagcatcctgtttccaactgtgcttcttgtcacatcactttctatgctacagtcagagaactgcatttctaaaatgcaaatgctgagatgtattattccctttcagactgcattgaatccccactgtcctcattctaaagtccaaacttgttcacttgacccacaagacccttcatgatctggtccctgctgtaactgtcctgcctcatcttgtcttagtctcctttttccatctggcccaggtctcccttgcaggacacagtagttaggctgaacttccttccactccaggcctttgcatattctgttccctctgcctggaactctgtccttctttttccttgggtctgaatcatggcagtaggggaaccaaacacatccttcttcacatggcagtaggaaggagaagtgctgagcaaaggagaaaacatcccttataaaaccatcagatcttgtgagagctcactcactatcacaagaacagcatgagggtaaccaccttgacacatgaggattatgggaactacaattcaagatgagatttgggtgggaatacagccaaactgtatcactgacattgcactataactgcctgtttacttgccctgacttgatggtaaattccttgagggtaaaggcattgtatgtcttagtcacagttgtcctgagctcccagcaatagaaccaggcacagagctgggcctcaatattgtttgagtgaatgagcttcacgtggatatgcaggtgcaggctcagaggcatgaggcatgtctgctgtacataatagcactcctacttgctttggaatgctgcaagctcactaaacatcagaactaatttccaatggactcacttgcttgcattccacatggaagtagaaatgccttttgcattgtcttctgtatcaagttgtcaggaccattgctccttcctggagacttcagagctggtggcactctgaggcttggcttacaccacggaatagccagatgctgaccaggggctgcctccactggcccctggttgattagtctctttggaagccagaggctttggggcagacccaagttgggatgctgacattgtggagacagctgttcttctttcttcagttcttcaagaaatacctgaaccctgagaagagagcagatatgatcatggtgagcatggaggccatgaccaacaccagcaggcgtgacatctctgcagcttccaagatgttaaagatgatcctgaagtacacgattccagagatcgggaaggtagcagctctgggcaacctaatggttcaaggtcaatttaaggattcttcctttctgttctgttttgggtcttgttctatctcctaccagtttgagtttaaagaatcacatgcttcaacccagaggagaaaaggctaaatgaggagttgtgattgtggaaaagactcttctttgggaagggttgaccatctggcttccatctccaccaggatgggaagaagaattgagtcaaagctatagcagactactaggacctgctaggaccaggaaagaccacagtcattcttcctgcttccagacagtatttgatatgttagatctataggtgccttcttgtttattcaggagggataattcaggggtgtgtgtgtatataaatataaatataatatatatccataaacttgtgacacactaacataaatagagatgaaatacagagactcctttatgagacctgggactggttctcagtaaaattaagacagcgtagggctgggcgtagtggcttacacctgtaatcctagcactttgggaggctgaggtagggggatcacttgagcctaggagtttgaaaccagcctgggcaatatagcaagaccccatctcttaaaaacattaataaaaaaattaagacagcacagtttagctgtcctttttattatagtattttaaaatatctgatggactgatggagtccctcttcttttaatggcctaacccacttctctaactcacttatgacctctccactataggtcctatgagcagttccaggatcttacattttccacttctctggcctggattgccttttgattgaatgcctcagagcagaccactgataagttgaaggggaccccaaaggtcaactactctaactccccacttgatgcttgtaatctctttttaaggttttaaatctattttgtatggaatgcttcacgaatttacatgtcatccttgtgcaggggccatgctaatcttctctgtgttattccaattttagtatctgtgaagcgagcacaatgctcgtaatctcttcgagagcaccccagaccactggacacccagacggtgctgaaagcaatcttgaggccctcgctaccttaaaccatagctcatttgtatttgtaaatgactttcttttttaaaaaaaataatttttaatttaccaaaaggatatatatttatggcatacaacatgatattttgaaatatgtatacattgtggaatggctaaaccaagctaattaacatatcgattaactcacatactttttttttgtagtgagaacattgaaaatctactgtcttagcaaatttcaagtatagaatagtcaccatgttgtacaatagatctgaacttatttctcctgtttaaatggaattttgtatcctttgaccaatatctccccaatcctcctcacctccagcccctggtaaccaccattgtactctctgcttctatgagtttgacttttttagattccacatctaagtgagatcacccagtatttgtttttctatacctggcttgttttgtttttcaaaacaaaacaggttcatgtatactgttaaatgacagggtttccttcatttttaagggtgaatagcattccattgtgtatatgccacattttctttatccatttatctgttgttggaagcttaggttctttccctatcatggctattacaaaaaacgctgcaatgaacaggggagtgcagatatctcttccagacactggcttcattttctttggctatatacccttaagtggtattggtagttttacttttagttttttgaataacctccataatgttggaattttccataatggttgtgctaatttacattctaccaacagtgtataagggtgaaccactttccttatctaaaagttctaacttacagcacactgaagtctgcatccccatagtttctagtccctggcccaagtttaccttcttgggttatgcagaattcaattaatattcaagtgttactaatgctaggtgctatatactgtgctagtttcttttacatattcttgtattgaattcttacaacatatctgttgtaagaattattttctctttagaaacgagaaggccaggtgcagtggctcacacctgtaatcccagcactttgggaggcctaggaaggaggatcgcttgagtttgggagttcaagaccagcctgggcaatatagtgagacctcatttctactaaaaatcaaaagcattagttgcgcatggtggcacacacttgtagtcccaactactagggaggttgagatgagaggatagcttgaactcacgggatggaggctgcagggagctataattgcgccactgcaccccagctaggacaccagagctagaccctgtctcgaaagaaaaacaaaacgagaaaaggctcaaagacgccatgagccttaattactgaagtttcgccagcagttactaggtaacagacactgttccaaccaattcagatgcattaactcagaactgttgatgtgggtaaaatcgtcctcatattttgcgtgaggaaatagagcgcagaggatgaaaagctttcccaagctcacacagttggcaagtggggaggtgaaattcacatccaggtagtatgactttagagttcatgcggaccactacctgttgcctccaccccacatggccagtaaacagcaaggactgactcttctctccctccataatagtcttgagaccatttggaggcagcaatcgtatgccctccggcttcctctctctaagttactcatccttagattcttccttcattcttcatgacatggtttccagacatggttctggtctcccctggctgctctctattttgtccctcttaaaatatggggtctgttccgtggtgggcaggtctgtataaagctacccttaaaatccaaggaagctgagaggtcaaagaaagaggttgatgaatccagtttctgagaaagaaactactccggaggcagaggcaggagaattgcttgaacccaggaggcggaggttgcagtgagcccagattgcgccaccgcactccagcctgggaggcagaaggaaactccgtctcaaaaaaaaaaaagacccggcgtggtggctcacgcctgttatcccagcactttggggggctgagggaggtggatcacctgaggtcaggagtttgagatcagcctgaccaacatggcaaaaccacatctctactaaagatacaaaaattagccgggcgtggtggcatgtgcctgtagtcccagctacttgggaggctgaggaaggaggatcaaaccggggggtggaggttgcagtaagctgagattgcgccactgcattccagcctgggcgaccgagccagactccgtctgaaacaaaacaaaaaacaaaacagaagccatgtcccaggaggctgcgagatgagatggtggaccccccagccatcacccaccatggcccagggcttctatacaataggagtcggacatggtgggtgtgcctctagtcccagctactgggaggctgaggtgggagaatcactggagcccaggacatcaagtctgcagtgagctatgagcatgccactaccctgtctctaagaaactaacaaatataccttagagaaggaatgtgttgggcaattaaaatcaacccctcaggaaaaagcaagaatgctacgcaaatctgccctaagggcaggatttatggtaagggttgtttcgacctaaggactggatttacagcaacaatagataaagtaagtccgggcacggtggctcacgcctgtaatcccagcactttgggaggccgaggcgagtggatcaggaggtcaggagatcgagaccatcctggccaacatagtgaaaccctgtctctactaaaaatacaaaaattagctgggcgtggtggtgagtgcctatagtcccagcaattcgggagactgaagcaggagaatctcttgaactcagaaggtggaggttgcagtgagctgagatggtgctactgcactccagcctggcgatagagcaagactctgtctaaaaaaaaaaaaaaaaaaaaatagatcaagtagaaatcttagaggtattctgggaaccgagattaatcagaagtcaatatggtgaccaaaacgaaaagaaaaggaaaaaattaaacaaaaagaaaaaaaagaagtcaatattgtaggccaggcgctgtggctcatgcctgtgaccctagcactttgggaggccgaggtgggcagactgcctgagcccaggagttcaagaccagcgtgggcaacatggtaaaatcctgtctccaataaaaacacaaaaaaaatcagccgggagaggtgatgtgcacctgtaatcccagctactcgggaggctgaggcacgataaaacccaggaggtggaggttgcagtgagctgagatctcaccactgcactccagttgcatgggcgacacagcgagactctgtctcaaaaaaaaaaaaaaaacaaaaaaaagtcaatatggtggattagcatccaacatggggttgcttcaggccccatagggtccaaaacagtccacagtcctgagggtatggcctgaccagagcagagtgcagtgggacggtgacttttttggtctgggcatgctatgtatgcatcatgtgcagctctacaggtgaagtgggtgcctagttatgtggatgctggtgatctggtgttgaatgtctggaaagaacctccttttccctcatttcaggtgctggaaatcatccagtacattcactaccacatgaacagcattacagaaaccacagcccaaaagaccattaagaagatcctgtatctgctgtcccagtactacactgaagttatcctgacagtattgaagatagaagatcagtcacaaaagtaggtgactttcgatcccacaagtacatgcccccaatagtctgtttgcttcttcttaaaacatattcaggacctgagcaggggctcacttctgtaatcccagcactttgggaggcccaggtggacagatcacctgggagtcaggagttcgagactagcctggctgacatggtgaaaccccgcctctactaaaaatacaaaaaattagccaggcgtggtggcgggtgcctgtaatcccagctattcaggaggctgagtcaggagaattgcttgaacttgggaggcagaggttgcagtgagccgagatcacgccattgaactccagcctgggcaacaagaacgaaactccatctccaaaaaaaaaaggaaaaaagtagcggctgggcacggtgactcacgcctgtaatttcagcactttgggaggccgaggtcggtggatcatctggggtcaggagttcaagaccatcctggccaatatggtgaaaccccatctctactaaaaatacaaaaattagccaggcgtggtggcgggggcctgtaatcccagctactcaggaggctgaggcaggagaatcgcttgaacctgggaggcggaggttgcagtgagccgagatcgtgccactgcactcccgcctgggagatagagtgagatgctgtctaatatatatatatagatatagatagataggtagctgttctaacaagtgtgtggtagcctctcattgtggttttaatttgcatttccctaattcaattgcaactaatgatgatgggcatcgtttcatgtctttctttgccattcatatatcttctttagtcaagtatccaaatctttaacccatttcattgttgggtcgtttgttttcttattggtgagttttgagagttctttatatattctgtatacaagtcttttgtcagatatacaattttcatgtatatctcccattttgtggattgtcttttcattctcttaagagttcaaaagtttgtaatttgatgaaatccagtgttttgtttcttatggatcatatttagagtcataggtatttctttccatgatttcttctagaagttttaacttttgtgttttatatttatatttcacttttactttttagaaagcgtgaggaatgggactaggttcagtttgttgcatatagaagtctaattgttccagcaccatttgttgcagagattatcatttctccactgaattgtctttgcacatttatcaaaaatcaattgacggctgggcgtggtggctcacgcctgtaatcctagcacttttggaagccaaggtgggcagatcacttgaggtcaggagttcgagaccagtctggccaacatggcaaaaccccatctctactaaaaatacaaaaattagccggggatggttgcttgcacctgttatcccagctacttgggaggctaaggcatgagaatcacttgaactggggaggtggaggttgcagtgagccaagatcgcgccactgcactccagccagggtgacagagtgagaccctgcctaaaaaaaaaaaaaaaaaaaaaaaaaaaaaaaatcagttgacagtatttgtgtgcctctaattatgggctgtcttctgatccattaagctatatgtcagttctttcatcaataccgtactgtctctaatagtgtagttttattttaagtattaaatcaggtaggatgagttcttcaattttattacttttttttttttttttttttttgagatagagtctgactgtcacccaggctggagtgcagtggtgcaatcatagctcactgcagcgttgaacttttgggctgaagcaatcctcccacttccacttcctgagtagctggaaccacaggcacatgccacctcacccagcctttttttttttttttttttggtagaaacggggtctcaccatgttgcatggctggtctcaaaactcctgagctcaaatgattctcccgcctcagcccaagtgctgggattacagggtgtgagcagttgcacctggcctataactctttctcaaaattgttttgactattttattttgcttttccatataattttttttttttgagacagagtctcactctgtcacccaggctggagtgcaatggcatggtcttggctcactgcaaactgcatatcccaggttcaagtgattctctcacctcagcctcccaagtagctgggaatacaggtgtgtgagcagttgcacctggcctataactctttctcaaaattgttttgactattttattttgcttttccatataatttttttttttttgagacagagtctcactctgtcacccaggctggagtgcaatggcatggtcttggctcactgcaaactgcacatcccaggttcaagtgattctctcacctcagcctcccaagtagctgggactacaggtgtgtgccaccacacccggctaatttttgtgtttttagtgaagatggggtttcactatgttggccaggctggtctcaaactcctgatctcatgatttgcctgtgtcggcctcccaaagtgctgggattacaggcatgagccgccacgcctggcctgcttttccgtataaattttataatttaaatagaatatttatttatttaaaaatatgctggtgatatttttattgggattatgttgcatctatagataagtataaggagaattgacaacttcacaatattgagtttctggtccatgaacatagcgtatctcatttatttaggtctttaatttctttcatcagtcttttgtatttttcaacacacagatcttgtgaatattttgttagttttatacctaagtatttttgtgcaattgtaaatggtacataaatcttttttaaatttttaattgtttactactgctacatagaaataacatcaatttttgtatattgactttcattgactttatatcctgcaataagtgaggtttcacttattagttcttggagctttttaatagattcactggagttttctacataaaccatcatatcatctgtaaatagaagcagtttatagtgtttctttttcttccaaatttgtgtttctttttcttgctttattacactggctgggactcctagcataatgctgagtatgggtgatgacagtggacatctttgctttattcccaatcttagaggaaaaactttcagtctttcaccattaagtatggtgctagatggtagggttttgttgttgttgatgttagatgtcctttatcaagtttagaaagtttccttctatttctagtttgttgcgagtgtttaccactaatggagattatcacaaatgttttaactacatctattgagataattgtgtggtttttcttttgtattctgttaatataataaattgcatttttgactgtggaggcagtcttgcattcccaggataaaccccatttggttgtgatgtattatctttttaacatattgctggattcgatttgctaatattttgttgaggacttttgtgtctatttggttgaggatttttttcatgggagatatttggtctgtagttttttctttcattcatttattctttctcttttttcttgtactgtcttgggtttttgtgccaagataatgctgaactcaaaagattgttttgggagtattttctttttctttatcttttttttgtttttttttgagagacagtcttgctctgtcgcccaggcaggagtgcagtgggacgatcttggctcactgcaacctccacctcccaggttccagtgattctcctgccttagcctcctgagtagctgggactacaggcatgtgccaccacacccagctaatttttgtattttttagtagacaaggttttcaccatattggccaggctgtcatcaaactcctgacatcatgatctgtctacttcggcctcccaaagtgctgggattaatggagtgagccaccgtgtccagcctattttcttattttctattttttggaggaaattgtgtaaaattggtattactttttttctaaacatttagtggaattcaatactgaaaccatctggatctagagttgtatttgttggaagttttaaaactatggattgaatttatttattagttagggtcattcagattatctattaatttgctcatcttctagtcacttaaggtggaaatgtaaattactaatttgagaactttcttcttttttaaaataagcatttttatgctatgaatgttcccctaagcatagttttacctgcatctaacaaattttgatatattgtattttcattttcatttagttcaaaaattttttctaattttccttgagtctttttctctcacccatgaattacttagaagtattgttaatttccaaatatttgtggattgtccaggtatatttctgttactgatttctagtttaaatttattaaggccagataacatactttatgggattccttttctataaaatttgctcaggtttgttttgtagcccagaatgtggtatattatggggaatgctcatgtgcacctacaaagcatgtgtattctggccaggcgcagtggctcatggctgtaatcccagaactttgggaggtcaaggtggctgcatcacctgagtccaggagttcaagaccagcctggccaacatggtgaaaacctgtctctactaaatatacaaaaattaacgagggacggtggtgcgcgcctgtatacccagctactcaggaggttgaggcaggagaatcacttgaacctagggggtggaggttgcagtgagctgagatcctaccactgcactccagcctggtgacaaagtgagagcctgtctcaaaaaaaaaaaaaaaaaagaatgtgtattctgctgttgttgcctggagtgttctgtaagttaggttatagaacaacacagtgttgttcaggacttttataaccttgctgaatttctgtctacatattctgtcaattactgagagaggagtgttgaagtctcccaatatgcttatggatttatctatttgttccttcggttttatcattttttgcttcatgtatttcattaggtgtatatacatttaagattgctacatcttcttgatgaattgactgttctaccattaattaatgtccctctttgtccctggtaatactctttgttctgaagttccctttgtctgatgttagtatggccatttttgcttttcaaacagtttgtatttgtgtggtatatctttttccattcttttaactaatatgtataattatatttaaaatgtttttttaatatagcatatggttggacttgtgtttttatctaacctaacaatctctaccttttagtttgcgtatttaaatcatttataattaaagtaattaataatatgtttggatttaagtctaccattttatgatttattttgtttttcccctttgttttttattcctgtgttcccctttcctgcattctttcaaattgtttgaatttttttaagcattctattttaacttgtctattagattttgattctttgtaccaatttttagtggattcctgggcatttatatgcctaaagttttatagtctacttacatacctaaatttccatagtctgcttagagttagtatttcacaattttgagaaaatgtagaagctttcactatacagcttcttttaccttacttttttttgagacagagtcttgtaggctggagcacagtggcacgatctcggtcactgcaacttccgcctcctgggttcaagcgattctcctgcctcagcctcccaagtagctgggattacaggcgcacgtcaccatacccagctaatttttctatttttagtagagatggggtttcactatgttggccatgctggtcttgaactccttgaacctcaagtgatccgcccgcctcagcctcccaaagtgctgggattacaggtgtaagccaccttgcccggcctaatttttgctttcgatagtcatacatatttttaaacttaagaggagaagaacggtctgttacatttactcatatatttgccattcctgttgctttatcttcattgttaaaatttcaactttcactctgatacaatttcttttctgcttgaagaacttcattagcatttaatttagagcatgtctttgagtgataaattcttagttttcttccatatgagaatgtttcaattttaccttcttttttttttttttttgaggcagagtttcgctcttgtcaccagctcttggcacccaggctggagtgcaatggcgtgatctctgctcactccaacctctgcctcctgggttcaagtgattctcctgtctcagcctcctgagtagctgggattacaggagcccaccaccatacccagctaatttttttgtatttttagtagagacggggttttgccatgttggccaggctggtctcgaactctgggcctcaagtgatctgcctgccttggcctcccaaagtgctgggattacaggcgtgagccactgtgcccagccaataaatttctgtttattataaattacccagtctatgagattttgtgatagcagcacaatacaaactgagacaatggcaaaggggctttttcagctaagaatcttgagaaagggagattattgtgaattactcaagtgggctcttaatgtaatcacaatgtgtcttgtgattgatgtatcttgttcgaacttcactgcacttcttgaatctgtaaatgtatgtctctcaccaaatttgggaagttttaggtcattatttcttcagatatttttttctgtacaagtctctttttctttttataagatttcaatgacatgaatattcgactttttaatggtgtcctataagtccctgaagctctgttaatttttttctaatttcttagttcttcagattggtataatttttattgattcatctgcaagttcatgaacccttctctctgcaatctccattttcctcttgatctcatccagtgaatttttgtttcagatattgtgtttttcagttctaaaatttccatttggtttttttaaaaaatagcttattcctcagctaagaacatgagaaaatccgtctttccacttctttctttgtttctttgcttctctctctctctctctttctttagttcttttttgagacagagtctttctctgttgccccaggtagggtgcagtggcatgatcatagcttattgcagactcaacctccgaggttaaagctatcctcccatctcagcctcctgagtagctgggatcacagggatatggcaccatacccagctaattttttaaactttttgtagagacagggtctctctatgttgcccaggctagtcttgaactcctgggctcaagtgatctcccgcctcagcctcgcaaagtgctgggattacaagtgtgatccaccactccagacctttccatttatttcagttatgtacatctttacctcatgcagcatgattaaaatgtctacttaaagtataattattattatttttagacagggtcgtgctctgttactcgggctagagtgcagtgacgtgatcatagctcactgcaacctagaactcctgggctcaagtgatcctcctgcctcagccctcaagtagctaggactacaggcatgtgccaccatgcccgctattttttaaattcattttttagagaatggatctcactatgttgctcaggctggtcttgaactcctggcctcaaggggtccttctgccttggccttccaaagtgttgggattatgggtgtgagccagtgcacccggccatctctcagagttttagctgcctgtgctgctacagctgcacaactggatctggcttcagggtgatgaaatgagaaaaaagagagagagagaaaaaaatagcgcttcccccacccctacactcagtgggccacagtgccctgtgttaggtgcttttgttgctgccccaactgcttccactgtgcagctctgcatctggactcactctcgggacagagcttgggagaggaaagagacaaagaaagaaagaaacaaagattccacccatacttctccaactcacaaggacccattttcccagtcctctggccagagagacagagttttactaagagattttgttgcctgtgcctgctgcatagttcagcactcgggtcaccttcgggtcaaagctggaagataatagagaaaaaagaattctgggaaactcactcaaatgttgtttttccagtgttgggaggtagttgctttttgtatttgtccagtgtttttagttttaactggtgcgagagctgggctggagtggacttgctctgtcctagcagattgtgtagactctcttactagggaaattaggattgcttgttgttaatttcctttatcatgagaaggaagtgtctttctagtctatatctgctgagtattttttttccactcatgtggaattgtttaataaaaggttgatatcatataattagagtgttttcttttgggtcgggggtggtttgagacagagtctcgctcggtagcccaggctggagtgcagtggtgcaatcttggttcactgcaacctctgtctcccgggttcaagcgatttgcctgcctcccgaggagttgggattacaagcctgtaccaccatgcatggctaatttttgaattttcagtagagatgagatttcatcatgttggccaggccggtctcaaactcctgacctcaggtgatctgcctgccttggcctcccgaagtgctgggattacagggtgagccactgcacccggctggacaaagttataatctgataggaagaaaaagttctggcatagtagagtgactgtggtcaacagtaaggtatcatatattacaaaacagccagaggagaggcttttgaatgctttcaacacaaagaaatggtaaaatctgctgagtttttttgaaaaataaaaattaggctttgaaataccaaatgcccttacaacatctaatgacatatttatacaaatgtatacaggtttctttctttaaccttttaatttccaagtggttagatattttgatcatctttttctagttttattggatgataactggaaaacatgatctaaatgtcttctccttttgagaatgtgttgaggggttcttttgtgtgtatagaccaggaagattaatgttatcaattttactatatgtttaatggctatttgaaataaatttatattctctactgcatgcaaagtcatctattagaccaggcttgtttatttatttattttccttttttgtatatttttaaagtacagatgggtctcaccatgtcacccaggctggtcttgagctcctgggctcaagcaatcctccctcctcggcctcccaaagtgctgggattgcaggtgtgagccacctcactcagccagaccaagcttatttaattgttttataatatctcattgtacaataactacaaacttattttacccatttttttaatgactatttgttgtttccagcttcttgctattattaacagtgctgttatgctcattcttactctaatattgtgtttgatttataggcatatttaccattttatttgctcaccatcccttgcacctcaaactttccttaggaaattatttttcttttccctaaatgggaaagagaaaacaatacctctaaaggtattatttaggagtttatcctctagcgaggctctattgatcaaaccatctatttttgtttatctacaaataaagcaaatctgcattaaatgatagatttgctgggaacttgtgggttgatgtttatttttgttccacacttggaaggtttatcccactgtcttctgctctccactgtttctgtggagaagttggctgtcagtctcattgccattctttcactgacgactcattttttctctcttgtttttgtccccagagcatgcgtgtattgtttgccagctgtgaaagtctgtcttcaccttttatctcaccttcatttcctcaatgctttctcctcctgtttcaaaaaggccatgacttcttgaggacattaagcacattttcttaaaattttatgttatttgtagcaaatgcttttcagatatgtacttttcttctgagtgtgatttttccaggtaaaaatgagaggggagacatggtaggcaaagggaaaggcatgtgcccaatgatagaggagagagagcttgtgtatggggtgaggctgggggtgctgtgcggggctggtgatcagacctggcctgaagaggggtgtggtcatgctgggtattaaggatgacaggggaaagcctggaagacagatgcagtggtctgagggtgggtgggtagtgaaagcttggacaggccagagagaagggacccacagggaggctcttctcactgatctgacacattcaagtgtggtcaacaagctttggcctcagatattttctcaaaccaggttcatagaccaagtgaacatttccagatttgtgtgagatgacagagaacagggaggtctggaggtgatggcaagatgaaagaaatagaaggaaaaagagagaggggataatgaagagagagacaagaaaggaggaagaaaccaggggagctaggggcctgggcaaaggagcctagagtcgcctcccctggaagcactgtggagcctgtggagagtgggttacctggagtgggtaactgtgtccgtgggtttctgactctgcaggggggtttgcaaaccctgggaaatcctggcatccttccccaaaggctacgaaatgatcgtggactacctgcttcagaggctgactccacactggaggccaaaggaccaggagcccagccacagaacagagatctcaccattgattgtatggaaaggccagaagaggggggccggggtggggaaggggactccctgctgtcctgttctcggctgccttgggctctttggccttgaccttttaggtatcggtgtttggtagaacagtataatggcagtcttggagttgggttgcagggagggttttccagttaactttgctttgtcagggagatagaagaactggatttcccagctgctctttaactctcaaagatggtaagagactaaaacaaccaccatgattagaagagcgctttaaaacaatgacattctagaaattgccctttatttgtctggctcacactaacttagtcttcacttgctctagcagcacgggttttactgggcaagtctgtcatggtgatgggttgtggaaagagatttcctggtgacaggacctatgagtcgaagatacgataatgcttcactctcctcctccctccaaggccaccagggccatccatgagctcctgctggaacccagtcggcagatggaggtgcagtccttcttctcctccttgttcatggccctgctgttccagatctcctttttggtggttgaaggggacgctgaaacaagccgggatcagcaacacatagctgaatggatggaccccataaggtactttggtgtttgctagtgattatgctccagggaccatcagcttagcacctttgcctgacttggtgtcagcctactgagcctgaataccctctgtacaccctcctgccagggcatttaacatgttccccatgcatcatttcaagaagtgtccctgggcttaaaaaaattatattttattattttatttatttagagacagggtcttgctattttgcccaagctggtcttgaactcctggcctcaagccatcctcttctctcagcctgctgtgttgctgggattactggtgcgagtccagctgtctggactttttagaaaagactccttctttaaacctggcctactaggctgatgcagagattctgcaccaaaatgagatcaatactgtggataaaacacacatctggatccacagacctggattgcattcctacccttctgctggctcgctgtgtcaccttgcagatgccacatctctcttggcctcagttgcctcacttgtaaaatattagcctgggtctctggaggctgtcccaccaccagcagttcatgatcctgagaaagctttgggagtcgggcaggtggccagtgagggagaggagcgcagatggtgaatgacttcgtatctgttttcggccctttctccagttctaccatggaggccctgaagaccttgattcaaagttctggatatggggactgtgtgtcttctattcagagacatggggtctgggggctgcttgtcaatcctgaaagacactatggcggagtcactctgccggccaggtgagctgcacctgggtccatggctggagggctgtccattcacttggccctctcctgcggcccaggcctcacctgaacactgtgctcttgttgataggtccgttgtcatcaataactgttggcacaaccgccccctcttcagctccatcatcaggttcctccaggacccagacctgcaagaatcacttaacggcccttgtgttcctgacagaggtgactggctcttggcgggagggggcaggtgagggtgatccctctgtgagacagccacgtccaacagacacctcctgggaaggccactgattcactgctaggaagggttgggggacatggctaatggcacttgatttggttaccttgagccgggggctttggtgcctccttgaatctcatggcagtttgactctgccctgactttacagaagaacacagctctctccttcaaccacctcagccttgagcagccttttaaaattaatccttgcttagcgtccctgattgactcaatataattcagccacctgacagaaaaaaaataggaaatttagaaaatatggaaaagtatatcaaaaattataaagccatcactaagcataatccccagaggaaaccatattcattcaggtttttgcctgtatacaggtgtgtgtgtgtgcgtgtgtgctagttgaaatcattttctactaatattctgtatcctgctctattcaaatatctgtatatgtcattacatgttctttgtaacatacatttttaaattttgttttattttattttttgagacagggtctcactctcttggccaagctggagtgcagtggtgtgatcatggctcactgcagcctccatctcctgttctcaagtgattctcccacctcagccttctgagtagcgagatctacaggcatgtagcaccgcgcttggctaattaaaaaaaaattttttttttaatatggagaagtggtctcactatacttcccaggctggtcttgaactcctgggctcaagtgatcctctcatctcggcctcccaaagtgctgggattacagttgtgagccaccatgcctggcctataaacataaatgttaatggtgatataatgtttcatcacaaagatgatctgtaatttattcgacattctgtttccaattttacacaattataaataacagtttaatgaacatctctgcgaaagtttttgcccatattacagattatttccttaactattgaatataataagtggaactattggttcaaaaaatatgaatgtcttctataacttttaacaataatgccaaattgctttccagtagagctgtaccaatttagacttccaccaacagtgtttgggagaatttcagagtttctgacccactacagctttaaatgggatccttttaaaattcaagccacctgatttttttttttaacagaggctggactacttttgaacataaccacagagatagaagataatgcattactaatactaggatgtacactgatgttatcccagtgtgtcatcgtgtgcccttatgtggattacaggacactggtgtcttgttggaaggtgtccactgctagaggctgatctgtacatgttggtatggggtgctgagatacacattcaaggatatatgtcatgttggcagaacttttgctcagggtatgggaatgagacatgtaggattcagaaccctgactggaaggggatggctcagtccagtggatctcgataatttatgaacttcatatctcagggaagctgtttaaaatgcagattcctgggccctgtccccagagacttggattcaggaagtctggggtaaggccaagaagccttttttgctggtggtggtttttttttttttttgagatggagtctctctgtcacccaggctggagtgcagtggcatgatctcggctcactgcaacttttgcttcccaggttaagcaattctcctgcctcagactcctgagtagctgggactacaggcacgcaccattacgcccagctaatttttgtatttttagtagagagggggtttcactatgttggccaggctggtctcgaactcctggtctcaagggatccgcctgcctttgtgcccaccctccagaagtcttcattttctttttttctttttttttttttttgttgagacagagtcttgttctgttgcccaggctggagtacaatggcacgaacttggctcactgcagcctccatctcctgggttcatgtgactctcctgcctcagcctcccgagaagctgggactacaggcatgtgccaccaggcccgactaatttttgtacttttaatagagacagggtttcaccatgttggccaggctggtctcgaactcctgacctcaggtgatccgcctaccttggcctcccaaagtgctgggattacagacgtgagccaccacatccagacgaagtcttaattttctaaaagtactccagtggtggctgtgccacaggaaatgcttggacccagctttgggaaacagtacaaggcacaaacccgtgtggacaggaggccaccatgagatagctgccactctctttagagcagtaattgggaaccctggctgcgtatcagtatcctccctggaggtttcaaaaatgctaatgccaagcccccaccccgcccctcactctctgtcaaatttttctatttgaatcgatctgggatggggtctaggcatcagtttgttttagaagctcccaggtttaaagggatgctctaaaatacagctaggattgagaatcactctagaagttcccccaagtgtctgatacccagctgaaacaaggggacacacgatagagcgtttgctcatctgccactctgattggggtttcgggctgataacggggaggggaggtcagcatgcttgggaagaggctggaaggagcaccccagtagcgagatgggtgaaccccattcttagcaatcagagagagaagcagtagattctaaagtggaaagccaatggggttttaggtaccagctaagtaagtaagtcaagatctgttaagtgagagaccatggctaagaaagctttctaatatttcacagcctttgtcactccctgtttgttgcttcattatctttattcatttccttgagatgatcacaagtagaaacgtttaaaacagaaaaggtcgtatgcttttcttcagtgtactcaagaaacagcagagctctgttattttaattctctctaattctgtgaaaagggtgttatttacctctattttgtagagcacgaaagtgaggctcagagaatttaagaagttacttactcaactagagggtaaattagggtggtggatctgcctgactgccaatcaaagacagatgaaaactgctgagatgttaatgaagacttctttgccaaatgtacattcatatgtgcatgcatacatgcacactaaagcaagtacatatattttaaatgtatctgattgaattttgcctttttaaatgttattttattatttaaaagatattttctatatcacaagtcatcaagcaataaatgttatttaaaataatctatatacacatataatacgaataagtaaattaaaccatgcaaactgattatttttttattttattttattttttgagatggagttttgctcttgttgcccaagttggagtgtaatggcgcaacctcagctcactgcgacctccacctcccgggttcaagcaattctcctgccacagcctcctgagtagctgggattgcaggcgcctgccaccacacccagctaattttttgtatttttagtaaagacggggtttcactgttggccaggctggtctcaaactcctgacctcaggtgatccacccgcctcagcctcccaaagtgttgggattacaggtgtgagccactatgcccagcctatttatttattatttatttttgagaaggagtattgctctgttgcccaggctggagtgcagtggcatgatcttggctcactgcaacttccaccttccgggttcaagtgattctcctttctcagcctcctgagcagctgggattacagatgcctgccaccacgcctggctaatttttgtatttttagtagagacagggttttgccatgttgaccaggctggtctcaacttctgacctcaagtggtccacaaactgagttttgaagtgcagtctttttttttctcttctacttttgccttctcccctcctaccacattacgtctacacctccacctcttcatctcccaagtatctcagatgcaagcaaccaagtacgtacccttctgcatgctcaaataatcacacacacataatagatgttgacagattgttttccaaagaagcactaacaattcacatttatctcagggaagtgtgagagaacggtgtctctatctcttccaacaacaaagcttaactctttttagatgtttgtcctcctggcaggtataaagcaggggtgtccaatcttttggcttccctgggccatattggaagaagaattgtcttgggccacgcataaaatacactaacactaatggtaggtgatgagctaaaaaaaaaaaaaatcgcgaaaacctcataatgttttaagaaagtttacaaatttgtgttgggccacattcaaagctgtccagggctgcgtggggcctgtgggccgtgcgttggacagacttggtgtaaagcagtatctcattgctgctctggtttgcatatccctggcttctactgattttgaacattccgcatataattctgtgatttggattcgcctttctgtgaattccttcccatgtcctttgcccattgtcctattgaattgtttggctttttcttgtctacaagactaatttaacttctgattttccatttgcatgactacatgtgtttttccattgcaatgttttccatcacgtgcatgctagtctatttttaaacagagtgcatgccaggctggtttatccaggtgaatgtactgatatgtgtaagtctgagccagcctacctgtgcagactcaaggtgtccatctggcatgttcattccaaagcatgtgcacttagagcaggagttctcaaccctggatgcatattcatatctccaggagaacttacactaatacttgggtgccaactcagtacaattaactcagaatcttgggggtgacgtggggtccaagaatcagcatttttaatagctttgcaagtgacactaacatgcagccaaggctgactgcctaggagtcagcatcgcttttcgatatcacccagcagagcctggagtccccagtgctgttgaatgatcattacaaggatttctttctttttcttttttctttctttcttttgttttttgttttttgttgaggcagagtttcgctcttggtgcccaggctggagtgcaatgacacgatctcagctcactgcaacctccacctcctgggttcaagcgatcctcctgcctcagcctcctgagtagctgggattacaggcatgtgccaccacacccggctaattttgtatttttagtagagatggggtttctctatggtggtcaggctggtctcgaactcccgacctcaggtgatccgtctgcctcggcctcccaaagtgctaggattacaggcgtgagccactgcgcctggccgacaatgatttcttaataattctcctttttccccctccctttaaaaaagttactattctaggggactgtctttgacttttctcttttgctttttcagcacgtcagtaaatctgactaatacgtgctttgcagtgttcttcagggtcatcctttctccattcccactaccctggcctagtccagacccttattacctgtgcttgaagcaattattttaacttttttttagagacagggagtctcgctatgttgcccaggctggtccccaactcctggctttaagtgattgtcctgcctcaacctccagagtagttgggattacaggtgtgagccgccacagttgactagagcaactccaaaagataacatgctgatctctctcctcctaggaccttctgtcaacccaacacatttcccacgcccaacatttcttgccaatgggatcctcctctggagtcgggccagcacccagttgcccttccctcaactacattacgcttagcttatccctacatttcgcccttgttttgctatacccaccttttcccgttaaacacacacatgtttacgttcccctcccatctgctcattgaagttctctttattcaagttcagctcaagttttacctttctttttttttttttttaaattttttttggagacaaagtttcgctcttgtcccccaggttggagtacaatggcatgatcttggctcactgcaacctccgcctcccgggttcaagcgattctcctgcctcaacctcccgagtagttgggattacaggtgcctgccaccatgcccagctaatttttttatttttagtagagacgggctttcaccatattggccatgctggtctcgaactcctgacctcaggtgatccgcccacctcggcctcccaaagtgctgggattacaggcatgagccaccacacctggccaagttctacctctttcacaatcttttcctagatgaatcaacacctgtttataataattttttacttgcttttaatttgtgtagtattgttattgccttgaaatgttcactaggtcgttcatgtacctaagtcttgactctccagctgaattgctaggatctttgagggcagagtgcatttcttacttttatctcctgcagtttcccttatcaaaaatgcttaatgcggctggacgtggtggctcacacctgtaatcccagcactttgggaggttaggcgggtgaatcacctgaggtcaggagttcgagaccagcctggccaacatggtgacacccccctctctacaaaaaatacaaaattagccaggtatggtgacacatgcctgtggtcccagctgctcgggaggctgaggcaggagaatcgcttgaacccgggaggtggaggttgcagtgagccgagatcgtgccactgcactccagcctgggcgacagagtgagactccatctggaaaaaaaaaaaatgcttaaggggccaggtttgtggtggctcatgcctgtaatcccagcactttgggaggctaaggcgggtggatcacctgaggtcaggagttcaagatcagactggtcaacattctgaaaccccatctcaactaaaaaatacaaaaattaggtgggcatggtggcacatgcctgtagtcccagctactcaggaggctgaggcaagagaattgcttgaacccgggaggtggaggttgcagtgagccgagatcataccactgcactccggcctgggcgacagagcaagactccatctcaaaaaaagaaaatgcttaaggaaaacttggagaatgaataaatgacttctgggatgacaggtgcaaattcatccttaaagctttggcctctctaccaattctaaacccttaagaacatttccctactagtgagtaggaacctagtccaaagtcattgaggatttttttttctccttgcccacctgtctttcttggtctcccttccccagctgcttcagtgcccagatgtggcagccttagtggatgacttcaccacctgcattctggcaaactggttcaagagtgaggagccagccacagtgaagccattgctgcagatgctagaggtctttgcgaagcatgaaaacatggtaaaatggggcaggggctaagggtgtgcgctcaggagatgtaaccaggagaaggaacatctggtgtgtccagttatagatagggtgggacacactcttgggatcaaagagagcaaatcctcatgaggccagtacagcacagacaggagttggggcttgagccattcatgatttctccctcccaggaaaggtctcctgaggaagttttttcatgggtcatttcagagaatagaccaagctaaccccaggatctcacacgtcatccaggtcccttggagattgctgtcatcatcagggatgagaagcgcagtggcgatggaaacttacagtgtagtgggaggagggggcctcctctgttttctccccttccctcatgatggacacaaggtacctccccaaatgccctcctgggcagctcactccgatggccacccagatgctgggccagtcccagctctggaatgaaaaagcagtagagtgtggctctcaattgtggggctgaattgacttgaaatgagaattccttggcttggcaggagttatttccccagctccccattccctgagccactgtctcccgcaggtgaggcggctccgaatcctccagccctatgtgctgaactgctgctactcctcgaacagcgacatcgtactggagactttgctggtgctgaagaatctcctgagccacctcacctggcagcactcctcctccttcctgacccagctcaccttcacgctggtgcccttctttgaggaggtgaaggcctctctggggtcattttctttctttaggcatctgtaaaataagggagttggccgcgtgtggtggctcacacctgtaatcccagcacattgggaggccgaggcagtggatcacatgaggccaggagttcaagatcaacctgggcaacatagtgaggcctcattctaacaacaacaacaaaacaacaacaacaacaaattagctgagtccggtggtatgcgcttgtggccccagctatttgggaggctgaggcaggaggattgcttgagcccaggaggtcaaggctgcagtgagctgtgatcgtgccatgcactccagcctgggcgacagagcgagatcctgtctcaaacaaaacaaaaaacaaaacccctcacagagttggcagaatgattcaaggtcgttcaccttgaatacgatactgttctgtagggacttgattgctcctgccctccttgtatctttctgaaggggtgagatggagcaagagaacagagcacagcaggcgggggtcagagcaggtcatttgagggagcgaatggacacaggagtgtggggttggcgggggtggagctcagggacgtgatggcttctgcttccccacgcatgcgtgtcttctctcccaggtgtcagagcatctgcggttggcagcctttgagatctatgggagtctcttgaccaaggtcaagaagaggggccttgtcttccccttgaaacaccagatcctcaacttgctagtccccctggtgctccacctgagggacgtgaataccgatgtgtctctggtgagaggccaggccttggagcctggccttcagtccccgttttcatgggaggtaaatgctaaacatgttgagtgcttaggcagggctgtggcagtactggatggtgctgaaggagtcaactagtctctgaccttgcagagttttagtgagagactagagatgaacagacgcttgcactaaagtttttttttttatttttatactttaagttttggggtacatgtgcacaacatgcaggtttgttacatacgtatacatgtgccatgttggtgtgctgcacccattaactcgtcgtttaacattaggtatatctcctaatgctatccctcccccctcccccgaccccacaacaggccccggtgtgtgatgttccccttcctgtgtccatggcttgcactaaagttttctccagcttctggctccatctggttggccactgactcccagtggaatactgtgggtgtttctcctgggaggaaagtctcatcgacgggcagcagtccctctctctgcctccctgcctgtggctccagggggcccctctccatgctgctctctgcatactctctgcctgtgaatagagacagagttccctgggtcgggaagaccccgtgggaggcagtgtggtgggcagaatagagacggcctggaactggcctacatttcggaatgaatgagtccagctttgagcccaggagacccaggaacgtgaactgcagcttgaacacttgaagactggctgacttactctgtgacaggacaccttgtttccacagagcaggctactctgccgtcactgaggcctcttaggcgcatctgaggccggctgggcaagcgattgaatggggatattatctttgcgcgggggtgtcccaccggtgaactcagccgtggtattcctgacagagccagccctgatttagaacagtgaccacccagttgggggattaagacttcggggaaatttgttttcagagagactgttttgtggggcagggaggatgggggggcggcggcgtgggaagccatgtctctggtgaataaggctctgagctggatagttccagtgctccgggtcgcagtgtcacaccacaacaattgggaaaattgttagaactgtaatttttaaacttcttattagtgggaaaagggggttgtaagtagagccaagctgcctggacccctgcctttttcctaagccctggatccctgtcgattcaccagtgagatttccatcccatcgaggctgaatgtgatgccgcttgtctccgttttttgcacccctctgtgtccctgcccagtgccactccccagctcctcatgctgagcctccttgtctcccagatctgccggtctgccctctgccacactgctgccgtgctgggctggtcaaagctgaaagcagtatttgcagagaaagatgtgtggaacattcttggagccctggtaagccagcagcttgctcactgtctgcccctatgcgagggagggtggcatccccagcggtctaggtccttttcctgcagctctggggtttgcagcagtagtggcagcgggcagcagcaacagttcaacgatgagagactcattaagcacctactttatgctcagcacctagatatggttcctgccctccccttgtttcctgtctgaattggggagctaggcacacaagtagacaatcccagaatactttgggaaaggcaaaggaggggtacccagcacagtctgggagttgaaggaaggcttcctggaggaggtgtcatcttcagaaggagaaatagaaggcagggtaacacttaggcaaagggacggaatcaagagtgcaggccaaggtgatgctgtacacaggggtgtggagcaaagcactcactctgttccagggactttgcacacattatctggtatgatttgatcctcacaaccatcctgagaaataagggcagaagggcctggtgtgtggggagctattaatataagtgccttggaatcattagagcaggggcagaaaaggcaaatgcttacaaggccatgtgggaaacactaaccagaggtcagactgggtgggcccggaggagagatgtaggccccaaggcccagcacaggcagcctcctcagcatggccagaaaccacacaccgttgtcacagcacacatttagtgacaccaactttactctcctaaagtgaaattcgtaaataatatcctctacctttgcatatttccaaaataagtaatataatgccctaacgccaaaggagaagtgaaagtaatctacaacaaaataatctgtgtgaatatatggaacacaatacagcataacacaatataataatagaaaataaatactatatgtaaatgcttgggccaagttactttttatttatttatttatttatttgagacagagtctcactctgaagcccaggttggagtgcagtggtgcgatctcagatcactgcaacctctgcctcccgggttcaagcgattctcctgtctcaggctcccgagtagctgggattacaggtgcttgccaccaggcccggctaatttttgtatttttagtagagacggggtttctttttatttttgagacggagtttcatcatgttgaccaggctggtctcaaactcctgacctcaggtgacccgcccacctcagcctcccaaagggctgggattataggtatgagccactacgccctgccagggcccagttactttagaagaaaatgatgtgcatgaatccttgcccctctccatagaatcaatgtgaatggatctgctacaaatgcagaatgttataggagttggagactcataccacaagaagggtcaccgttggtgatgggacttccaaaatgattatattaatagctccccccacaccagggaagtctgattagaccagaaagtctgatgactttctgaacaagatgaagtatagtctttgatgtctattgcagatgcattcctagaaaatccagtatgtagttgaactgtgaaaaagttctctgttatctaaaaaagccaatttctaggcatggattattataagtaggtttttgagagacataaatgtgtaatgggatattagaaataggtgtacccccactcatcattttgaaaaccataaacatcccccagttccataattccctccacacagtacagtccccagttgagaacccaccaattgtttctaggaaagtggctcagggttgttaagagaagcaggaaatcgatgccaggtgcggtggctcacgtctgtgatcccagcacttggagaggccaaggtggctggatcacctgggaacaggagtttgaaacagcctggccaacatggggaaaccctgactctactaaaaatacaaaaattatccaggcgaggtggtggacgcctgtaatcccagttactcgggaggctgaggcgggagaatcgcttgaacccaggaggcggaggttgcagtgagctgagatcgcgccactgcactacagcctgggtgatagagcaagactctgtctcaaaaaaaaaaaaaaattaaaaaagaaagcaggaaatcctgattggggtgaaatttcccccattaatgttggcaaataatttaaaatgtaaaatgctgcgtagatcaaacaaaaaaaaatatcttcaggctggctttgctcatggactgtcagtgtgcagtccggtctgggcaggagacaccaagcaggaagcaggaggctgggccacactgtgctgtggaggtttgggcccagtgaggagcaggacttgaggctgtaggcaaggggagttgttgaagcgttttaagcaagtgggtagcatggttacagagctgtgcatttcacacaaatcacccaagctacagatcagagaaacattcccaagggacggaattggagcctgtgctggagagtgtctggggagaaatgatgaagtcaagaagacaaaggcatgggcgggattagctagttgtggagattgatttgatgtgaactgtggaagtaaaagttgcctcttggcttctgacatgggtgaatgctggtgtcctggactgaggtcagaaatacagagggaggaacaggtgtggaggggaaggtggtggcttgattttgggcatgttgagcttgtaaaatctgtgagaatgctagtacatctattccattggaagttagatatgtatcactgaagcttggagaacagggctgtgtttggtgaacgctgagcataccattgggtggtagatggagattgcaaccctaagcccagacatgctctcctaaggtaattgtgtggtgggaggagtatatgagtcaacactgagattccaggagacatcagttccaaggatcccacagaggagactagaaaaggaaaccaggcagaaagtcaaaggaggacaacaagagaggagagtcatggtcacctaggaaggaccatgaccagtttcaggaagcagtcaagggtacaaaaacccaagggtttctcgggtaacttcaaaagatgggagagatgagcaggcaggctaggctcagcctccccacctccttcaacccaagcagccccacttctccttctctttctccttctccttcttttttttgtagagacagggtcttgccatgttgcccaggctggtctccaactcctgagctcaagtgatcctcctgccttggctttccaaagtgctgggattacaggcgtgggccaccacacctgcccccccaccccttctgttagtttgggatattgggtttccagttaagatttctttttga

SEQ ID NO: 591 - DNA, 146664 bp, Homo sapiens
tttaaagcagttattattcttatatttcttatttttaatgtgcattgtttaatttccacatatttgtgggttttcttgatgatgccttttgaagcagaaaatcttttaaacagattttgatggaatcaaattatctatgttttcttttgttgcttgtgcttttcctgtatttctatgaatttttgtatgccttaggtcatgaataaccctattttttcttctaattgatttattacattagctcctataattagggcaatgatacattttgctttcttttttccttctggggtgaaataggagttcacattcattcttctgcatgtggctatgcagtcgcccctgcactgtgtaatgagaagactgtgctttccccagtgagttcctctacaccttgctgagtaggtgtattctataagcttaaaaaagttcagttgaacataaaatacataaaaataacaaaatattgcatcttatgattttaaacattgtaatgtatgaaataaaaatatactagataggattagtagcagtttagatgtgggaaataaaggattggtgaatgtgaagtgacagtaatggaaagtaccccaaacaacacatgtaaagaaaagagaataaataaacaaatcatcagtgggcagtgggcaacttctaggggactaattttctggtaattagagttacctaaaaaggggagcagagtaatcagaataataaattgaataaataatagccaaaaatcaaaaattaatttattagcaataaaatagttgaaattatttttatttcttttcaagtttcttagttgtttcttatctataaaatgattagtcatgtctgtagatctgtttggtacaaaaactttaaaaacatcactgaggcagatttattgtcattttgtagatttttttgataggtagatttatgggtagggattatataaaaatctctaatttgtttgtaattgacaaattcagatgcaaaataaaaattttcttccctcttcaaatttgtagtatggaataaacataatagcaagtagaaactcactagtgcactgttcttgagcatgatacatcaaggtttatgcccaagaatcatataatattaaaagccaattaatgaccagtgtcaacaatttacataggaataattctaaagaaactattcctgttttattatttcaaagagaagatttttcaaccgtatttatccttttatttaacactaaacagtactcttcactttattaattctttatttgcaaaagctttcatggttcttaaagttacttaatattcactaattttaatgtcaatgtttctaatgagaactttctaaaacaaaggcacagattttatttatttttattttttattttagtggatacatagtaggtgtatgtatttaggaagtacatgagaggttttgatacaggcatgcaatgtataataatcacatcatggaatggggtatccatcctctcaagcaaaattagtacaaccactgtggagaagagtgtggaagttcctcaaaaagctaaaaatagagccaccatatgatccagcgatcccattgctgggtataaacttatatttatccttttgaaaacctaaactctcaatgttttattttcatgttctttgaaagaaaatattgatagcaaggtaaataaagtgatctaattcaagcattagaagttctgtttgttcctgcaatgagtcagattttacctgtagccttacaattactccaacatcttccagctctgtctttccttcttacttacaacattcctcctacagatgctttgggactactaattgtctcagccccagagttacgctcacttcttggcctctcagttacccaagggtccctacctacatcagctgttactcactagactcaccaggattaatccagggaggaacactcaagagacagaactctgagtatgagctccaggaaattatcagtcatcttgttagcttaatgagtcccgtgactattgatcaatttcttcatttactgaaagttcacctacattccaaaaccttgcctcattactgcagccattaattcctcttcatgttttccctcagtattactcaactaatttgtgtagtgctttaattatgcccagtggggtgtgggagatacatggcctgaatgcaagttgtctgtatgtttccaagactggaaagacacagagatgtcagaatattcctaagtgtcccataagaagaaaacacccattagtaattcatttagatttatttagaaaattgaaatctaccttcactttttccaaattagtgtccattagaacacatagagaccaaggatattgaaggtgatgacaatgaagccacctcagaagatcaagttcttccgtaccaactgatgttatcagtcactaagaggcacatccaacgaaaaggtctttgtcttagatgagtgcaataattctacactagcacatgttcagataaaattactacagtgtagtcatatattttataagtggtcagctctaagaaaagtgggaaaagaatgaactttcaaaagtagtcatggagtttgtagagttacctaaattgattaacaagattatttttaagaaacatctttaagttttcagttttgtctaattattaaaactcttcttgtcctatttacataaatcattttcccatatttttcttgcttctattttttattattatgtatgcatttttgggaattatagaaacttaaattagattccaattatcttgtaatatttccatatattattgataggaattctttttcagtgagacctcaggttcatagttcctgagttgtgccccaactaggaagcagatgacgtgaactgtcatcagtgcaatacacacaggcccagtgaagggctccacaagaataagcctggaaagagaatacaaatgcaaatttattatttaatttctctacttcattctttctcttgacctctttcctatgcaaagcttcctcacagcctgttttaatcctctctaaatgaataaaatagtttgttatgacctctatttgcaatctccaattatctctcatctttttactccacccatgcattcctctacggagctctcaatcttcactcttctagtaaaacgtttctctttactttcacctacttctcttgctttgaggggtttagattctctgagggtaacatttattctcacctggcatccgttaatgtggcaaataccagttgctgaaatataggaaaccatccagaaagacaagttacctcataatctcacttctatgtggaatctaataaagtcaaatgcatagaagcagagtgtagaatggtggtttgattcccagggactggaagaggaggaatttgagggttattagttaaaagaaacaaaatttcaattaggcaggacaaataaattcaggaggtctattgtacaacatggtaaccataattaataacaatgcactgcatacttaaaaatcactgagagttcattttaagtgttctcaccacaaaaatatgataagcatgtgaagtgatgtatatattagtttaatttagccagtccatgatgtatatatacatattccaaaacatcgcattgtataccataaatatatacaattttgtcaattaaattgttttattaaaataattttaacgtttattttagattcaaggggtacatgtgccagtttgttacatgggtgtattgcatgatgctgagatttggaatatgaatgagcccatcacccagatagtgagcatggtacccaacagttagtttctcaacccttgcccagctctctccctccccgctctagcaggtcccagtgtctgttgttcccatctttgtgtccattattacccaatgtttagctcccagttatacatacatatatttcattgaatccataataagagaggttgatcaataatactgtaccctataatcccagtacaatacactacattttagcggaaatatgttggcaaataagacatattttgtaagtttttatttcattatttgtcttcattctttctaacttttgattcataactgaagtaagctttatctactgtaatcaactaattgttcatttaatgcagtgtaaccagcaccctattttatgcattacataaattaataaggttatgtatatgtttcaatgtttgatgtatgttttagccaaaaatctgtaataaaaatcaactccttgaaataagtcttttctgagctcatgtttcagaaaatatgttcagaaatagtattttatttctcttcattctttacttatgaaactaatgtctagagaatttaatataaacacttggtcaatcaatgaagaaacttttctaattatagcatttaaaaaagaattttcttccagtcctatcatttgctgactaaaattataataatcaaaaatcagaattttaaaaaattagaactttgctgaagttgcttatcagcttaaggagattttgggctgagacaatgggattttctagatatacaatcatgtagtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaaggttgttgaattttgtcaaaagccttttctgcatctattgagataatcatgtggtttttgtctttggttctatttatatgctagattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagcttacaaaatcaatgtgcaaaaatcataagcattcttatacaccaataacagacaaacagagagccacatcatgagtgaactcccattcacaattgcttcaaagagaataaaatacttaggaatccaacttacaatgaacgtgaaggagttcttcaaggagaactacaaaccactactcaatgaaataaaagaggatacaaagaaatggaagagcattccatgctcatgggaatcaatatcatgaaaatggccatactgcccaaggtaatttatagattcaatgccatccccatcaagctaccaatgactttcttcacagaattggaaaaaactactttaaagttcatatgcaaccaaaaaagagcccgcatcaccaagtcaatcctaagccaaaagaacaaagctggaggcatcacgctacctgacttcagactatactacacgactacagtaactaaaacagcatggtactggtaccaaaacagagagatagatcaatggaacagaacagagccctcagaaataacgctgcatatctacaactatctgatctttgacaaacctgagaaaaacaagcaatggggaaaggattccctatttaataaatggtgctgggaaaactcgctagccatatgtagaaagctgaaactggatcccttccttacaccttatacaaaaattaattcaggatggattaaagacttaaacgttagacctaaaaccataaaaaccctagaagaaaacctaggcattactattcaggacataggcatgggcaaggacttcatgtccaaaacaccaaaagcaatggcaacaaaaggcaaaattgacaaatgggatctaattaaactaaagagcttctgcacagcaaaagaaactaccatcagagtgaacaggcaacctacaaaatgggagaaaatttttgcaacctactcatctgacaaatggctaatatccagaatctacaatgaactcaaacaaatttacaagaaaaaaacaaccccatcaaaaagtgggcaaaggatatgaacagacacctctcaaaagaagacatttatgcagccaaaagacacatgaaagaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtacacccaaaggactatgaatcatgctgctataaagacacatgcacacgtatgtttattgcagcactattcacaatagcaaagacttggaaccaacccaaatgcccaacaatgatagactggattaagaaaatgtggcacatatacaccatggaatactatgcagccataaaaaatgatgagttcatgtcctttgtagggacatggatgaaattggaaatcatcattctcagcaaactattgctaggacaaaaaacgaaacaccgcatgttctcactcataggtgggaattgaacaatgagaacacatggacacaggaaggggaacatcacactctggggactgttgtggggtggggggaggggggagggatagcattaggagatatacctaattctaaatgacgagttaatgggtgccgcacaccagcacggcacgtgtatacatatgtaactaacctgcatattgtgcacatgtaccctaaaacttaaagtataataataataaaaaaattaaaacttattaaagtgtctgccttgtaaaaaatggaaggggtcaacaagcctttgatgtagttgttgaggaaattattaccggtcatcagttggatggacaatgctaactctgagctaaatattgataaaattctttcgtaagaggcactttctttcttgatatcttggatttggcaaacagttgctgataagagaaaatggaatgagaatgacaatgattttatgtctgttgcccatctcccaaaggctggaactctgacatattctaaagggaaataattccactgttgaaattggtttatttaatctgttccccccaattataagagacatcttggcactctttaatatatggaaatagagtatgaaaactgaactttacttagtaatgagtaatttccaacgctggaatacaatcaagagtctcaattattagtgagagggcattgaaagaacatatttacccaatcagttattgagatgttatagagaagaggccatgtacctagaattttcctagggactggttatctgactcttagtagatatagattgtcactttatattttctcataatcatagagtcatattttcttctgtagagttggactgcctagtcttattttctttggtaaatttagactagtaaatgcatgattctactgagggatattaatcaacccataacagatatggagatatgtaaaaggtaatttaacaaactaggcattggtttacttatattttgttataggtaaactgtctaataaagttggaatttaggaagtattcaataatagagagacttatgtgtacaaattctttgagactgagtgccacactaacacacatgaattgtggtgtctaaaataatcccagatccagttggtaaaaaaagttataggataatgtgataacagtttaaagcagtcatatattaaatatatatctatatgcacacatacacatgtatgtgggtatttctaaaattgtatcagacaaccaagacaaatatattcgatataatattcatatgatttgaatgtaaaattatgcaaatgtgtaatagaaattctgatcgttctgggaaaataatgatcaatgtgaaaattccactttgaaagtctcaaaatctgctgaaaaaattcatgtgcaagcacaatgatattataaaatataattaaaaattaaaaacataaactgtataaaaatattttcccattttatgttattttaatcattcaaataaaaatttttgagaatatttcaatattccagtatatccaataaatatataaaaatctcaactctattaatataataaagacggagtcagctttaatacaagtatcttttctggtacaataaaaaaattcatttcagtaatgtattatgaaccctcaaaacataggctagtaagtgacaaaatgctaccatatatttgaatattttattcagataacagactgtaattatggtggaaaatataaattaaaaaaattaaacatgaaaaataagatagctgagtccaaagctgtctaaataaggaatcagaaagttcaggttaaagttttatttatttatttattttttcctttaagttctaggatacatgtgcagaatgtgcaggtttgttacataggcatacatgtgccatggtggtttgctgcacacatcaacccgtgatctacattagatatttctcctaatgctgttcctccccttgccccacactgcccgaaaggccccagtgtgtgatgctttcctccctgtgtccatgtgttctccttattcaaatcccacttatgagtgagaaagtgcggtgtttgattttctgttcctgtgttagtttgctgagaatgatggtttccagcttcatccaagtccctgaaaaggacatgaactcattcttttttatggctgcatagtatccatggtatatatgtgccacattttctttatccagtctatcattgatgggcatttgggttggtcccgagtcttttctattgtgaatagtgctgcaataaacatacatgtgcatatgtctttatagtagaatgatttataatcctttgggtatataccagtaatgggattgctggatcaaatggtatttctggttctagatccttggggaattgccacactgtcttccacaatggtgaactgatttacactcccaccaatagtgtaaaagtgttcctattttcaagtgaaaataatttatattctgctgcattagccggtgtgttctacagatatcagtgctaagagtttactctgttacttaagtcttattattgtttattttccactgctgacaaatacaaattgtaaatatttatggtgtaaaacatgatgtttaaaatagtgaacattgtagaatggctaaaccagtctaatatgtgcattacctcacataattttcactttttatggtataaacacaaaatctactctgttcaaaattttgaaatatacattgttgttaactatagtcaccatgttaatagatctcttaagtttatttttcctgtctaactaaaattttatatcctttgaccaatatctctccaactcactggcaattgctattctactttttgcttcagtgaggtaaactatattttattccacgtataaatgagaaaatcttttatttcttattctgtgcctggcttatttcacctaacataatgttcttcagattcatccatgttgtcataaatgatggggtatccttctcttttttctggctgaatagtatcccattttgtaaatatatatgtatatatgtatatttgtatacatatatatgcacacatatatttgtatatatacacatgtatatttgtgcaatacacacatatacacatgtacacaaatgtatgtatgtgtatatacattaatatatgtacacacacattatttatccattcatctgttaatggaatcctaggtctatttcatttcttgggtaaggtgaataatactggaatgttcattggagtgcggatacagctttgacatactactgattccatttcctttagatacatgcacagcagtgggattgctagattacatggtagctctatttttacttttttgaggaaattctgtattttcttctatgatatataactaatttacattactgccaacagtgaacaagggttccctttctccacctccttgctaacactttttatctttcttctttctgataatggccattctaatggagtgaggtgacgtgtcattgtgatattagtttgtatttccctgatgattaatgatgtttagcatttttcttacacctgttagacacttctccgtcttcttttgagagatgactatttccatcctttcccattttttaatcagtatatctatttcctgcttttgagttcagttccttatatatttggcattttaacaccttatcagaagtatactttccaaatatatgatttcatatcataggttattatatatacacagatgctccttgccttatgatgggattatatcctctataaatccatcacaaattgaagatctataaaaataagattaaaatttcaaaaatttaaaaatttaataaaaataaaaattgtgctaaactattgcaaatattatataagatttgtattactatctttaaaataaagcctaattttaaaaattaaagaaattttaaatatcaattgtgcttgtatatgtaatctggctaaatctgaaccatcttactccctccacattcagaagtttccactctgaatctgaacacatctttctttagcaggaattaatgaaaatgtattctaattttatgtagaagaatacacaagaatatacagggaatgtatccaaaattgcagcactttaaaaaggaattattttaccagacaaattatattttttaaaaaatcaaattattaaaagaaattttaaaaattattagtaaaacaatataaaactcaaaaattgatattagtatatatgttgatttattatagaaaaaattattcatcagttcactggacaaaggcagattataattacttaatacaggaaaattgttgtctatctgaagggaaaaagtatctcatgtcacaaaataactgatcttaagtggattaaaaatgtaagctaaaaatgacataaattaagtaacatttaagagcttgaagaaagtggtttggaatctataagacagaaagtgttaatgtctatgctagatgaggattccttagaaattgaaagcaaagtaagtataaacgccatatgaaatagagacataatcaacattcaaaggagcataaaattcacagagaaataaatccagtacacagcaaatcaaaattaaataccaatgataatgtttatgtctaggaagctgtcaacagtcaaagactcactgttactaattctcacctgagaagtggcaaaaagggcccaatacatacttttggtatttaaacaaaatgatgggtttttatttggtttcattttgttttgctaaacaggctattgacaacacaactacctgttaccctagacccactaatctcattcctgggaatttatcatactgaagcgaaagccactgcatgtcactatatatgaggatgttcattacagcttccttcaaaggacaacgggatgacaaagaagtgtccaaaaaatataaagattgcacctaagaggtatttgagggacagtcagaacttgtgggcccttgttgtaaattggaaataatttggctgaaaatagagacatgcattacctggcttaggttttaaatattggtagctggggaagtgttcattgagtgtcagattctacatttgtgttgaattccaagccaccaaggtttgctgatgtggtatgagaaagaggagagacagagagcagtcaagaatctcatgtcctggaggtgggcaggattcctgaggaactttgtgttatgaacatcttgcctctttctatccctggtgggtgaaggtaaatggaaatgggtccccagagacctgcctgctttggaaggccactccctccctccaggaccatctgcttttagaagctgatcacaacacatagccttgtaaatctccaaatctatatatgtagctctgcatattcacttttatacccatttattactctccccaagtgctcaatattgtctcccatggcctctgtaacttatggtaattgcatgtttcccatagatcttcagtatctttgctcctctggaaacatggtgcctgcatgcttcccggcagccctctcacgatggtgatagacacgccctggaagaaggactcactgcccagctgcagtgaggtcctcagacaggttgaggctgtcagcatcttcagggactctttaaggaaggaggtcatgtccctcagggacagcccactggtgaatgagggatttagaggtggaggaataactggggtgggcaaagcttgctccccagccctgatcagggtgaagtatcctgaatcctctttctgtgcaatcctcctttctttcacttttccccacattcctaaagtgcattcaaatcactttcagtgtctgtgtccagagaactccacctgccacataggtggacactgatttctcttttgttctcttacatcactcagtctggagcagggcaaggtccaccttgctgtttctctaccagctctagatcacattctccccttcccctaaaagttgaccagttgttttgaattttattccaaggggctataccactctctgctgcttttgttgaaacatctaccactctaagatccatcatcctagatgaacatgcccaacttgccacagcgtccagttctcattatcctagacatagtgaaaatgaggaatgttgtgcgcctggttcaatggatctgtgaagtaatgatatgtatcctaatgttagttttaagctgatgttataaatgtgtgaattttttttgttttgttttgtttttgttttttattttattattattatactttaagtcttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccaagtgttctcattgttcaattcccacctatgagtgagaatatgcggtgtttggttttttgttcttgcaatagtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacagtaaacatatgtgtgcatgtgtcttcatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccatttgtcagatgagtaggttgcgaaaattttctcccattttgtaggttgcctgttcactctgatggtagtttcttttgctgtgcagaagctctttagtttaattagatctcatttgtcaattttggcttttgttgccattgcttttggtgttttagacatgaagtccttgcccatgcctatgtcctgaatggtaatacctaggttttcttctagggtttttatggttttaggtctaacgtttaaatctttaatccatcttgagttaatttttgtataaggtgtaaggaaaggatccagtttcagctttctacatatggctagcgagttttcccagcaccatttgttaaatagggaatcctctccccattgcttgtttttctcaggtttgtcaaagatcagataggtgtagatatgcagcgttatttctgagggctctgttctgttccattgatctatctctctgttttggtaccagtaccatgctgttttggttactgtagccttgtagtatagtttaaagtcaggtagcatgatgcctccagctttgttcttttggcttaggattgacttggcgatgcaggctcttttttggttgcacatgaactttaaagtagttttttccaattctgtgaagaaagtcattggtagcttgatggggatggcattgaatctatgaattaccttgggcagtatggccattttcacgatattgattcttcctacccatgagcatggaatgttcttccatttctttgtatcctcttttatttcattgagcagtggtttgtagttctccttgaagaggtccttcacgtcccttgtaagttggattcctaagtattttattctctttgaagcaattgtgagtgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcgtaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattgttttgagatacgtcccatcaatacctaatttattgagagtttttagcatgaaggttgttgaattttgtcaaaggccttttctgcatctattgagataatcatgtggtttttgtctttggttctgtttatatcctagtttacatttattgatttgcgtatattgaaccagccttgcatcccagggatgaagcccacttgatcatggtggatatgcttttaaattttaattctattattttaacatcatcttatattcatactttatacatcactacataaaagtttttgagatcttgattataacatgtgttggcataaatatgttagtataaattgttggtgtttccactctactcccaaccattttctttttttaaatttaattttattttatttatttattattattatactttaagttttagggtacatgtgcacaatgtgcaggttagttacatatgtatacgtgtgccatgttggtgtgctacacccactaacttgtcatctagcattaggtatatctctcagtgctatccttcccccctcccccgacctcacaacagtccccagagtgtgatgttccccttcctgtgtccatgtgttctcattgttcaattcccacctatgagtgagaatatgtggtgtttggtgttttgttcttgcgatagtttactgagagtgatgatttccaatttcatccatgtccctacaaaggacatgaactcatcattttttatggctgcatagtattccatggtgtatatgtgccacattttcttaaccattttcatagttaaaatctgaaaggagactctgttgctttgagaaaaccactttatttttcagtgatgtcaatgaacaggtatccagagcttataagaagaagtttgtgtgcctgaaataaaaaagaaattttcaattttatctttatctttttaaataagttataaagttaggattgtctgttcaaatttagttattttgtcacctaatttagatcatggattgacaacatacacgtataagaaaatatagttgcagaggtaaacggtaacttagattttctccaaattatcattctttatttttctgatttatttaattgcataaactacacattccttattgcattcaagccaacgaagcagattttgttttacttttctactttacaaagacaaaaatagagggaagttgttcactagtattggtttgacctcatagcaatcgaaatacatagtcagttcccagtttgtataagtaattgagatatttagaatcggagtaatgaaagaactcacactgttttgattatgctctgcttatgggatcatggtgaagaaaatccctcagccagtacccggtgctgcactgctctgattatataggacaaagcttaatgcacaaaagttattcagttgcatttaatccttgttagtttgttttcttttgagaaaatcatgtttgaagatcatcagttcatgtcacacagagcctcctatatagaatcttcataagtatattcagtataaatagtggtgtcaaccatggcaacaggccagtagtgaattctcaatgcaaatgagttaactaatggttatcaacttttgctgaagactcattattggcacatgcattaatgatgtaatccttgtaacaatcctgtgaatgcctattttaaaagattggcaacacgtggatattgtcacttgctctgtcaaagtgaagtcagaacagtggtgacattgcctacaaagcaaaaaacgcactgagtgttgaaattccctgtttgggaactggtttagctgaggtgattaagaatgaagcagcaaatggttttgtcttatactaactgctcactgggttttatgggccattgtgtcataactaaacatattattatgttcactttttactctgaaagaggcaatttgtcatttgtgttaattcattataataagaagggacttggttaataaatgttttttaacattcaagaagacattttctgcttttctttgtgtcttctgggaaaacgaaatctgtgtcattttgacctcagtgtacatgtgtccatctatgtcaaataaaaataacataaaaatatgtattgaatttgatgaattaatgacattatctatttgaagcaataaaaaatcacaaggaaacaatttcacaaatttaattccataattattaaaagcttgcattaaataaaaaataatatcagtataattaaagagaaaactggagatgaaaagtatttacatgtagtaggtgttagtgtctataactttacaaaagcacattcaagttaaacacaaatgttacgatggagtagataaataagcaaaatacatgaatagatgattgacttaaaaggtaaattagcacatttctctgcatgctgaacaaataataaatggaagcaatccctgtgtcacatttttattgaaaaaagcaccccatgcagttaatatacaaatataattataaaaattgaatggactcagtctttgttgaaaacatacacatagacatacacacacacacataattttaaatattttcatagacctaatatattatgaaatatttgaagacataattatgtgctccaaagacttgcctgagaaaaataccattgtcagtacacagctctacatttcacaaagagtaatttaagaaactggaaatttgtagtacagatgctgcagagaaaaataattcacatattcttccaagtttatttcacttaatagattacatgatagaagaaaaaatatctattagtagaagaaagattgagcaatgtatgagataactagaaggaagtccatctagcagaaaatctaatactgggcttccaaataccataataaagactaaggggaaacctcaaaataactataattaaaatgaatatctaaaatagtcaaagcctatatataatatatatatatatttaaatatgtatttaaatatacacatttaaaatgtatacatgggaaccttttaaaactatttatatactgatttgttttgtaactagagcattaggaaagccatgttagggttaataaaacatcaatacaaattaataattattttgacatctgccttcaatgacagttcctttatttctttgagtgctgatatctttctctggcaaaattcaattaatatgcattttctatttgaccttttaccaaaaatgcaaaatgaccatatagaagaaaagaaaacgtcccattcaaattaatttttgagtaagaccacttttttcattttattcttctcagtgacatttaaatagtcaagtcaatacaaggaataaatatggataatttgtcaaagaattctataagacttttttgttcagattgattaggtcataagagagtagaggtttgggttttgtattactgctgctgcttcttcaataagagtttttaagtgagatagtaagttctaaacaaacattctttcttacatcatattaaagataactagaaatcagcttatgtacaccacccaagaaggggtttgggaaatggctccatattgtaaaaattcagaattttacttaagaatagaaaaatgtaattaattgcccaaggaaattttctaataaaataattgctttcatttgtctttttaaatttttacttttaagaattagagataaaaatgaagaattaatgtgtgtacattataaatggtatctattattgaaagaagaaaagcaacagcttttactttttggtgagctttccctttatcaacatccccagagccacctttatggccttgtttctcaaactgtatataatgggattaaaggttgggggcagcatagtgtagaacacagaaattacagcatccaaaatagaaggagactctgaagctggcttcagataagcaatgaatccagtggaaagaaataacacaaccagcaagtgtggaaggcaaatagagtaggcttttgactggccttctgtggaagggatcttcttgactgtagagaagacgtggacataggtaatgatgatgacaataaaacagcagaaatccaaaactacattaataaggatgagtgcaatttctcttattaaattttctgagcaagaaatagctaataactggggaatgtcacagaagaactgatggaccatgttggacccacagtaggataaggagaaggtgccagctgtgtgcatcacagcaatcagacccccatacagccaagacacagtggctctttggacacaggtgctcctgtccatgatgacatcatagtgcagagggtgacatatagcagtatagcggtcaaaggacatcaccgtgaggaggagcagctctgcagatgctgaagaaagcaacaaaaagacctgggaaacacagccaaggaatgaaatggagttgttgtgtatcaaagaattggcgatagatttgggagccgtgactgaaataaggcagagatccaagaaagatagattcttcaagaagaaatacacgggggtgtggagatgatggtccaaagttgtgatcatgataatgaggacattccccatcagggcacacaaataaatcaacaagaagagaatcgaatgcaaaatgcacatatttttattggtagaaaaccccataaggataaattcagtcacgattgtgagatttgccattattgcaggagtaatctgcaggaaaaggagaagactgaagtaaaatatcaatgtccactctttaaatattaaatatatataacacatatattatttagcatactgaaacacacacacgtaccacacgtatggtaattccatgccaatttgccacaaaaaatactttcatctagttcttttttagtgcattgatcaccaagcatttcctgattaatttcatgttattgaggcaatttagttcacataaatgcagttataatattatccaaatatatcttatgaaatatactgaaagattaaaaattttctacggatgttatcaaaacttaaaaacaaagttttcctgcccatctctcttgaaaactcaaaccaacaaaccaatggctactacattgtaccatagtcttgctcttcctacatcttgtcccatgactaacaggacctcagtttcaacacaccttccaagaatttgaacaattaacaattctaaaaacaaaacttaactattacagacctccctcaagctattctacaaagtctttaacctacttactctctaaaaaactttgtttgcaggtattctcacatttgaaattttaataagagattgaactaatggtgcttttttaacaccataatttgcaatcttgtgcctatagtttcataggacacacacatggttactgtaggcaacagatcctataatatatgagctggccgggtgcggtggctcacgcctgtaatcccagcactttgagaggcccaggcaggtggatcgcctgacgtcaggagttcaagaccagccaggacaacatggcgagaccccatctctgctaaaaatacaaaaaattagctgggtgtggtggcgggcacctataatccctgctacttgggaggctgaggcagggtgaatcacttgaacctgggaggcggaggctgcagtgagccgagatcacactattgaactcctgcctgggcaacagagcgaggctctgtctcaaaacaaacaaataaataaatattttgttagccttatattaactgaattactcacttttcttttttaatcccccatctgccactttgacttttttctcatatttaataagttaaactatgttttctctttcaagcttttttctctttcatcatagccaagttgtacaacgacaatgcgtgaccttgcatatcacaatcttaatgtttttatgtccactgctttctctgttcccctctatcccttccaaaaaagtattgcaaattatggggcaggggagaaggatcgccacataatttgaacaaaattcagatggtcttactctgatggaaaactgtggttattcattcgtattgcagtgacatgtgggggctttctaattctacagattgtatacattgaccttaatgtaaatttagtaaaatattaaaactgtacttgacaattttcctcctgcactctcttctttggttctttcttttaaatattgtgcctgttctctctcaggagtgatagataaagaaaaatcacagtgtaaatgttgtttgctgaatttaggagagaagtgatataaactaattttaatctgttagaaaaaaaacccagacatttgaatgaacagttaaaaataaatgttaggatttattccagaaaaagaagtaaaaatattttgagtggtttttaaaaaatcattttaatgatgttcgatttgattaatctctgtggctgttcttgttaaaatattgtgacttcatcttacagcatcactaatagtccccgagtggttgagtaaaaaagcatatgattactaagacagatgtccatacgtgtctctttcttctagtatgagggaaacaaaatggtaagggaaaattgactcaaagacagtggtattgatgattctgtctgactgagctttcttcataatcgtttagaagctggaaagtatagcatgcctttttaagaagtacttcacattttttttttaagattagtcttaagtttcttgtttcatttatttctagttacctctcattaattttgtgatttcatttaacatttaatacactttcagcttagtgtggtaaatccaaaaatatatcactaagagttacaacatctgatattcataatacatactcctcaacgaagatactataatgtgccaaaagtattaaaaattataatcctattgtggaatacttaaaattaaaaagataaaaagtagtattttatcccatttctgtgtgtgaagttcactcacaggaaaagctaatactgctactttgaataatttgagcatcagagaaaaaatatatctttaggttttattagtttctattatttgtaaaataagaattttaattgttcccaaatccagacaaattttaaccccaaaatttttaaaatatgaaatgtgatttttatcatcagagaaatgcaagtaaaaactataatgatataatgatcttaccccaattaaaatggattttatccaaaagacaggcaataacaaatgctggggaggatgtagagaaaagggaattgtacactgttggagggaatgtaaattagaacagccactatggacaacagtatggaggtgcctccataaactaaaaataaaactaccatatgatccagcaatcccattgctaggtatataactgaatgaaaggaaatcagtatatcagagaggtatttgcacttgcatttttattcactgttcagaatagctaacagatgagtagattttaaaaatgttgtgcatatgcacaatggagtattatttacccacaaaaacaaatgaaatcctgtcatttgcaacaacatggatagaactagagggcattatgttaagtaaaataagccaggctcagaaggacaaattttgcatgttctcactctaattgggagctaaaaatcaaagcaattgaattcatgaagatagagagtagaatggtgtttcccagagactgagagggtagtaaggagtttggaggaaagtagcaatagttaatgggtgcaaaaatatcatttaaaatgtgaataagatttagtatttgatacacaacgaggtgactacaatcaacagtaatttattgtataattaaaaataagagaatggaattggaatgttcctaacacaaattataaatgcttgaggtgatgaatgccccaattaccctaatataatttttacacatcttatatctgaatcaaaacatcacaggtaccccataaatatacacatctctatgtacccacaaaagttaaaaataaaaaatttttaaaaataaaaaatataatgagttttcttttaaaaaatgacttactctatacctccaatctggcgcacgaagattccagatgtcttctgaggcttgttttcaatgcttctttattcatttatagagtgcttactaaaggccagatctttctgttggcaaacttcagtgaaaacaatgcagtgagtcaaattccaaaggtgtgtgggaagtcactttctcaaaacaccagcttctccatgttgtgcttagagagagggtgtgtgaggagcagaggaaagagctatcccaggagattgcgatgcgagtaatatcatgaagaacacaggtgggggtataacaggtgaggttcagagtttagcacagccccaggggagcagatttaaaaaaaaaagactaggagatgtgttacagaaaaaatggagagcaggatcaggcagacactgcaggtcatgggaagtagtttgtttactgtgagtgagagaaaaatctggatggttttgagtagaggagtagaatgatccgacttgaactttttgtcttattatctatttattttattgtatatatttaaagtgtataatatgttttgatatgaatgtagatagtgaaataataatacagtcaggcaatctaacatatccatcacctcacataattgccttttgtgtgtatttagtaagaacacctaaaatctgctctcagcaattttttagtttacgataaaatattatttgttatggtcctcatgctgtgcataaaatgccctgttgaataaaagtattgagagtgtccatccttgtcttgttcctgatcttagaggaaatgtttaaacttttcattcttgcaaatgatgttagcagtgggcttgtgatttatggctttatgattctgtacctaatttgtttagaattttcattatgaaaggaattgtattaaatgccttttcagaatctattgaaatattctatggtttggtccttcattctgttaatgtagtagatcacagttattgatttgcatattctaaacccacttgcatctgaaggaaaaatccagatttattatgatgaatgatctttttaatgtgctgttgaatttgatttgctagtatttcattgaagatttttgcatctgtgtttatctggaacacgggcctgtaatttttcttttcttgcagtatccttgtcaggattcagtatcagagtaatactggcctcataacatgattttagaagtgttccttcatcttcaatatttttgaaatgtgtaagggagaactggcattagttattctttaaagatttgatagaatttacccatgaagccaccagtgactgggtgtttttgttgttgctgttattgtttatgatttttaaaaaggggacttagttttgttgctattttctattgtctttctggacttcatttttatttttctctgcttttttctttgttatttcctttctcctactaatttttggcttagtttgctcttttttctctaggttcttgagcataatgttaggttttattaagatctttcttgggcccggcacggtcgtgcacacctgtaatcccagcactttgggaggccgaggtgtgtggatcacttgaggtcaggagttcgagtccagcctgactaatatggtgaaaccccatctctactaaatacaaaaaaaaaccccaaaaacaattacccaagcgtggtggtgcatgcccgtaatcccagctactggggaggctgaggcaggagaatcacttgaacttgggaggcggaggttgcagtgagccaagatagtgccattgcacttcagcctaagcaacaagagtaaagcaccgtctcaaaaaaaaaaaaaaaaatctttatttttcatgtaggcattggtgctgtaaattttcttattagaactgcatgactgcatctcataagtgtcaatatgttgtgttttcatgcttgtttgaatcaacatgttttttcatttcctttttaatttcttctttgaaccattagttgtttataagcatgttaatttcaacatatttgtgaagttttctgaaattccactattattgttatctagtttcataccatgtagtcagaaaagatacttgatatgatttcattcatcttaaacttgttaaaaatcacattgtggcctaacatttggtctatgctgaataatgttttatgtgcacttgagaggaacatatcttctgctgctattggatggaatgtttgggatgtgtctgttaggtccatctggtctaaagtgtagttcaagtccaatccttgttgattgactgctggatgattactaatacatcagttcatagttgaatgtggagtattgaaatcccctactattactttatcactatctctcttttcagataaagtatttgctttatatatttggtatgctgatgttacattcatatatatttgcaattgttatatcttcttgattgattaacccctttatcactatataataactttctttgtctatttttacagttttgacttaaagtctatcttatgtaagtatagctacctctgctctgtttgatacccatttggatggaatatcctgtcatccttatactttcaatctacatgtgtcctttatgatgatgtgactcacttgaaggcaaggtatattatctatgcacccactttatgtcttttgattggaacatttaattcatttgcagttgataaactgggtagtacttactgctgccattttgttaaatattttctggagttcttttgtgtgtttttaaaatagattctttgttcctttcttcaccttttgctgtcttcctttgtgattagattttctctagtggtgtgccttgattccttactttttatcctttttgtgtctactataggttttggcttttttggttagtatgataataacttaaaatgttttatacttataacaggctattttaaggtgttaacaatttaactttatccacattaaatttaaaaactctattactcctctcattttaagtctcttatatcacaatttatgttttttatgttgtaaacaaatttgttgctattattatcttaatagttttgtattttccatactgtggtagttaattttaggtgtcaaacttgactggattaacagaggcttaggtggctggtgaagctttgtttctggatgtgtctgtgagggtgtttccagaggagattaacatgtgagtccatgtactgagagaggaaggcctgcccttaatgcccttaatggggctggggtgtgtgtgtgtggcggggggggagggtggggatgctggcgaaaactaacagtaggcagaagggggattttttttctctctttctgttatctctgtcttcaggagtgagatgcctctcctcctctggccctcagacatcagactccagattcttcagcttttggactctgggacttgcaccaagggctcttgggcttttggccttggacttagggctgcaccatcagtttccctggttctgaggctttcaaactgaatcataataccagattctctgatcatccaactcgcacttggcctttctgggacctctctgcctctgtgattatgtgagccaattcccctgaataaatcccctctcatatatcctattggttatgcttatctgaaaactctaatataggtttaaaattactaatacatctttcaaattacagatttcacacaacatctaataatctgactaggctctcagttcataattaagagtgaggaagcttattgggtattctaggagcaaagactgaacttatcaatagctgaacttcatcaagaaaagatgcagaggttttgagggatctcaaacacaaattttttccagaattcagtttccccagaagggaagcatataaaatatttggccagctgaatgtaagactgtcacttgaattttgtaaaataaaattaagggtttcaaaatatataatgtctgtattctctaaaggaccctattgatttgtattccttattcccactaccctttgtggggtgcctgatatctctgaggcttatctctgcttcaacttctgcagaacctacattccactacttttaccaggagttggagtaatttcttaacttttgaggtgaagatctagagttgtgtcataatattaaaataaaataagccaggcacacagtggctcatgcctgtaatcccaatgttttgggaggcaaaggtggaaggatcacttgaggccatgagtttgagacaaacctgagcaacctggagagacccccatttctacaaaataaaaaaataaaaacattatctggttatggtgctgcacacctgtaatccttgctactcaggaggctgaggtgggaggatcctttgagcccaggaggttgaggctgcactcactgagccatgatcatgacactacactccagcctgggtgacagagcaagaccctgcctctaaaatattatgacaaaagatgataaaataaaatagttaccccaacatctagcatgacaattaaataataccgtaagtgctgcagtaggtcttcaagcatgcatacagaaaataaatataatatgggaaaaaatgtttttaggcagtggacatcagagcacaaaactgtcaattctgaatgaatattagtggaaaaatactatgcaactattttttactgggaaggatacgataaatatgtatttcctatttggaagcatccagaattggaggagacacccactcaaaagttaagcaccaatccaaaattcgaatttaaagttattaatatcataaaattgaattgaatttaaagcaaaaatataaaaataaataaaataatattcatattgttctaagtatcagtatatcatccagataagctgtaaaatttaataccgttccaacaatacctttacaattgaagtggtgtcactgtctggggtaaatatccaggattcactgtctcccacaaagaagatttaggacacggacacacaccaggagttcaggagcagaggtttaataggcaaaggaaagagaaaagaaaatagagctctctctagtaagaaacagggccttccgaaaggagggaccagccagcatcagagttcactggattttataggcaggcttggggaagtggtgtctgatttacatagggcccacaggtgtgacatttgcataatgccggggggaaggctggctacgtcaccttaatcttgttatgcaaatggactttacacttgaccagggcgtcttgtttgctttttactgtacacatggctggcaaacagaagcaaagatggagccaccattttgaacgtgcctggtcccaggtagctttctcccatctgcattcacctgtacaagcttccagcttgcttgtctatgtctgcagctcaattttataggctgctctttgttagaaaatgatttcagggctgctttacattaaaaagagaaactttatcaaggactcccataccctgcttatgtagtttcttatctcctatatcataattatgtcatcattaaaatctgtatctattctatatctgtatctttgtctatgtctaaatctacatatttaaaattcagtacaacaatctcacattgcatttaactgtcatgtccttttattctccattaatctggagtagtttatcaatctctgtgtgttcatgagtttgacattctgaagaatgaaggtcaggtactttgtagaatgtccctcgatttaaaattttctgtgacttcctcaaaattagaatcagattgttataagaaggcaaggatgtcaatttgttccattactgtcggtgctaactttaatcacttggttaagatggtgtctgccagatttctccacttcgaagtcatgctttttccctttgtaatgaacaagaattttatgtgcatataccttgagtctaggcttcagatggaattgttttcacatggcatatacttttctaaaattctgagcaatatgcttggcaattattttctagatctcttataaagtccattagtaatcccttcatatttgcatatctctttatgtagttgtccctttgaatttgatatttgtaattttaaatatttcaactttatataactgacttcaattcttaaccaagatgtctgaccatgcttccatgcctgattgccacttatagcttcctaattttactgagtctctaattacatgctttacacttttacatgtaaatatctctaccatatttgaacattggccatttagatacttgtgtaacttggaatcaaatttatgatctttttttttaaatgaaactcagacatggtagtccgcctctttgagtgtgcagtgatctttgaatgtaaatatagatatttacaaagctggttatttataaagttactgctagtgacattagaacacctcagccatctttacggctgaaatggtgcagtaaaggagtaaagcaaaaaggagaaagagatcgggggaagtgctggcgggcggaagtgctggccggcggaagtgctggcgggcggaagtgctggcgggcggaagtgctggcgggcagagatgaaagcttcaatcagattatgcaaccaacctgagagactttcacaaaaacagaaccgaagattaaattccctaaacagaacttaattctatctgctctgcaaattctcctcattggcctgatctaaccagaagccaaggacagtgactttgctgatacagtccagaaaacttagactacaggccacagtgcaggctggaggagagttaacaatggatccagttgggcatatatatatatatatatatatatatatatgtgtgtgtgtgtgtatatatgtgtgtatatatatgtgtgtatatatatgtgtgtatatatatgtgtatatatatgtgtgtgtatatatatacacacacatatatatacacacacatatatatacacacacacattatatatacacacacacacacacattctacacacaatctgtagattatttgttatctatccggtcaggataaattgttcttcaattcatacctttcacaattttgaaaaaatatcagccattacccctaagacattatctctcatccttctttttgattcttattttctttttcgtttcttatattcctaacttattcctgacttcttgtgtatgtgtgtgtttgtgaaatttcatttttctattctctgttaaatgttctggaaaattatctcaatgtaataattttttattaaaatttataggaatttcattttaaacaataatctgcttccacatttgaagttctacttggctctttctccaaatctgtgtggtcaataattattctcatactttatttcttaaacttttttattctttcaagttaatttttaaatatatggtgcatgtttctttatattttcagttcaacaattgcaacgtatggacttcttccaaattgagaactttgaaacaaatcttaaaaaattagaaaagtgttcacatattttatagttcacaactataattatgtgaataagaaactctttgaggtccattatataaagagataagaatataaaataatttactaactcaaagtgagataaaatgcataatcatgagtaattgtgactaaatgaatttgaatacatacagtcttgagacatgatttaacttttttttttttttttttttttgagacagagtctcgctctgtcggcaggctggagtgcagtggcgtgatttcagctcactgcaacctctgcctcccgggttcaagtgatcatcctgcctctgcctcccgagtacctgggactacaggcacacgccatcacacccagctaatttttttgtacttttagtagagacagggtttcaacacattggccagggtggtgtcgatctcctgacctcgtgatccgcccacctcagtctcccaaagtgctggtattacagatgtgagccaccgcgcctggccgatttaacattttaacttactaaaagatttttattacattattcaaagtcaacaaaaagttagcaatgatactgtcttaagaactacttttaaatagtctaattaatttcctaactaaaataattgatttttattacgtttcagtatttttgtaggtaataaagttattacagtaatgtgcattaatattaataaatcaaaatgttaaagccaaaaaataaaaattttaatcatttgaaagtaaaatttacaatatgggcagatggcaacacaataaatccaaaaaatcaagattttattttattttttaacaattcataaatgggatccaaatacacatggtagcactcattaaaaccagtatttggctaaagtcaaggttacaactgaatatcatcatcatagcataaactgcttgaaaattaatttaggcctggaagtgtgcaggcacgaagatgcaaaaggtgtttttgatcaccggggcaagcagtggcattggcctggccctctgaaagcggctgctggtggaagatgatgagcttcatctgtttgacgtgcaggaacatgaagtaagacagaagctgtccatgctgctccgctggcctctcaccccaccaccatgtcagctacctgcagtcagttttctgggcctccaagtgacttaagcaaaggtttcagaaattagactatatataagtcaaaatgctgggatcatgcccagtccacagctaaatgtcaaaacacttctttggcctcttttgaagaaaagtgattcatatgttctccatagctgaaggcctgctgacccaggatgataagattactgctaatggacttcaggaggtgtttaagaacaatgtctttggccgttttatcctgattcaggaactggagcctctcttcaccatggtgacaatccatctcaacttacctggacatcgtctcgcaatgcaaggaaatctaatttcagcatcaaagatgccgacaagcatctttgccaagccaagcaaaggcaaggaaccctacagctcttccagatatgccactgaccttctgagtgtggctttgaacaggaacttcaacctgcagggtatctattccaatgtagtatgtccaggtagagcattcaccagtttgacatatagatttctggctccctttgttggacactgttgatgccactaatatggctgcttcgcttttttgcagatgcattcactttgacaccatacaatggaatagaatcactggtatggcttttccaccaaaagctcgaatctctcaatcctctgatcaaatatctgagtgccaccactggctttggaagaaattacataatgacccagaagatggatctagataaagacattgctgaaaaattttctcaaaagttactggaactggaaaagcgtgttagggtcactattcaaaaaacagataaccaggctgggcactgtggctcatgtctgtagtctcagcactttgggaggccaaggcgtgaggatcacgtgagaccaggagttcgagaccagcctgggaaacatagtgataccctatctctacaaaaagaaatacaaaaattagctgggcatggtggtatgcgcctgtagtcccaattactcaggaggatgaggtgagaggattgcctaaggctgggaggcgaaggttgcagtgagctgagattgttccactgcactccagcctgggtgacagtgtaaatatagacacatcaatcaatggaacagtttagagagcctagaaataagtggagcccatgcacccatagtcaagtagtttttgacgaaggtgccaaaaatatacaataggaaaaggacagtcaataaaaggtgttgggaatactggatatccatatgcaaaagcataaaattagaccttatctcatactatatacaaaagtcaactcagaatgaattaaagacttgacataaggcttgaagctgtaaaactactaagaaaatgtagggttaaaactatataacattggtctgggcaatgttgtttttttttttctaaatttgaccccaaaagtcaaatcacaaacaacaaaatcaaaaatagacaaatgggattacatcaaaataaaaatcttctgcaccacaaagtgtcacctgacacctgtaagaatggatataataaaaaaagacaaaagataagtgttggtgaggatgtgagaaaagggaacccttgtacactgttggtaagaatgtaaattagtacagccataatgggggttcctcagaaaactaaaaattgaactaccatataattcatcaatctcacttctgggtaattacccataagattgaaaatcaatatgtcaaagagatgtctgtactcccgtgttcattgcagcattattcacaacagccaagttctggaatcaacctaagtatctatcaaggtatgaatgggtaaagaaaatgtggcatgtcatcctcaaagtggaagaaactctgtcatttgtgacaacatggatgggaatggagaacattatgctacgtgaaataaaccaaacacagaaagagaaaaaccacatgctctcacttatatgtggaatctaaatcaattgaactcacagaagcagagaaataaacttgaagccagaccctctagctataactggaaaggctggggttttggctgtgcactggatttctttctatcctcatgttgaaggtgaacatgggcttttccactctctgcactaagctggggggatctgtggcaaatgcctgtgtgcacattcatactgcaccctttgatacagagcagatggctcttggaaattagcccattgtatgtccacctctttgttttctgtggtctagggccacaggaatgcaaaacttcattgactcccagggctaggtcatgaaagagatagtcacttgagtgtgagctatagtagttgtagcacctgatgcatggataagctccttcgaggaagaatggacagattgggtttatcactgaggtgggccagaggaaaggcttgggaagttcttagccctggctcaggcagccagagggctattgtctgtctgccctgttagctcttcaatgcaagtttattgtcaggctgtcaagtatctactggaaatgtgtgctgtaaacctcttaggagagatttagagctgcatgtcccagccctttttctgcaacactactctcaaaggtgtagcccccaaaatggaaatgtttgcagtcttgtttaaaaccacctctttgttcatgatctaagatgactcacatatgccaaggcccttctgcatccagagctaggaagtttaggatgcagtctttccagtgggagcggtaaaacttgaggcatttgacgtttcgacaatctccttcccaagagagatgaatagatctggatttatctctgaggcaagcccaggaagaaggcatgggaagtgctgattttcctctcaggatgccagcaggctacaatttgtctgtcattgcaaattcacgatggaactgagaagccattggaagagtgtgtttttggggagaaacgccgagctcttttcccaaagggtggagcccctggaaacgcatccacagccgtatcaatagcaaactgcctctctttttcttgtgttatagagagacttgctcatgcctaatcccctctgctctcagagatggtgaattaagagccatgccgtgggggaccttagagttagggtgatatatgtgaggtccgaactcttttctccacaggggagagctgagtgttgaggattcccttcctgattgtgtggcacagtgcctggagcggggtccatgctggagtgtgcctcagcttttcctacccttctgatgtggatgttttctttgttgcgcagagggtaggagtctctcaacaactggtttctttctcccagagagaactgatctataaatatatgtttattggcacatccttgggtgtcatttattttccattcatcctaattgcttttgtttcacggtttatcctatcctctctcgttgttgttaacatattattttagtgtttcctttcatttctcctattgaatttttaggtatactacataatattactattatttttagtacttgctttaaagctaatattgtatatttaatttattaaaatctataatagttcatattttacaactataccacactttatagttcatccttcttccttccgaaaacaacagtaaaaatgtctagacctagacttcctgcatcctgtttcctatttcctagtcacatttcctattccaaaaatgtaataactattagacaatttttgtcatatatattacttctatttattccacattacattttcatgctgtttatgctttaagcagtctcttgttttttaaattacaagaaaaaataaagcaaagtctttgttatgacctaacttaataaccatttctggtgcattctgtttcatttaattgatacaattttccattggtaatcatttcctatttacctgtagataccttttaatattacttattatctacatgtgtggtgacaaatactttctgctttcttatggctctaatcagaaagttattattctggccaggtgcggtggctcatgcctgtaatctcagcactttgggaggctgaggcgggcagatcacctgaggtcaggagtttgagaccagcctggccaacatggctaaaccccgtctctactaaaaatacaacaaaatgagctgggcgtggtggcgcgtgactgaaatcccagctactcaggaggctgaggcaaggaatcgcttgaacccgggagtcagaggttgcagtaagcccagatcacgccactgcactccagcctggccaacagagtaggatgctgtctcaaaaaaaaaaaagaaaagaaaagaaaagaaaagaaaaagaaaaaagaaaagttattattctatatcacagctttgggaggatatagatgtttgatttccatggctttttgtttatatatttgctcattttattctttcagcctttaaaacatgtctttcagttgtcctgtgcctaccattgttattgatgaaaactcaatgattatttttaaacttttcccccagcatccaatgtgtcattttttaatggttctttttaaattttattttgaggtttagtttaaaacagactagtacgtgccaagatgttatttattgtattgtttgggttttattatcttttttttttgaaatctaggattttttaaatacaaattgggaattatttagttactagttctgtatattcgttttctttcacagtttctctaatcctttctaagtgtgactgcaattatacataagttagagaatgttctactgtgacaaaactccctgttggtgtgctcatttttctgtattgtttttccttttatacttcagcttagaaaatttatattattttactttcatgttcaattttccatttttttctgttatccctgttagcagtttagatgtgcactacgtttcccgaagcttatatcagcatgctcgctctcaaagtttctgatactatcaattcccaaacaattattttctgactgtacaaaaatgttttcctctttgtccttgacaaatccattttcttcatttttttgttttttgttatttttctccaatgatcatgtattccttcattgcctcgctcattacaaatgttggcaattaattttttcagaataaccttaatactaaattataaaatacttgtacttaaactgtgaaagatagaaaacaaatcaatatacagaaatattttaagcactttatttagacattttccatttgctcatccaaaaagcaaatgccattagtaaaaatgaatgaaaatgataaattaaaaaattaatgacctatattcaaagtaatatagagtttaagcccataatacaacttctgaaattatattccaaggatgaatttttgtttaagtgtatttgtgttgagaggagacgtgctctgaaaactttcctttccacagtgcatagatatgaaaaaaatatatataaatatatatacgcacacactcttacccaccaccacatcctcttaccacctataacgagaagtttcattaatgaaacacaatattggaaatttaaattgcacaaaacctggtacatttcattatgaaaactggaaattttttcataactaagatcatctattcatttacaaatgtcttaggactttgttagaatcatcattgatgaagctgaatacatccaggactaagaggattctcagagaatcctcatgtggaccttacccctttgagcaagctctgtcctccggccgaggcgtccttcagtgcatctttcatgggttcattccacagactgaagacgaagggattcaggaggggtgtgatgatgctggagaggataaagaggatcttgttgaggtgcaggctgctcttctgtgaggggtgaacatagacaaagatggagatcccatagcccacggagaccaccgtgaagtgagaggcacaggtggcaaaggctttgcgttgaccttggcctgagggtatcttcagaatggtggagatgatgtaaacataggagaccactgtgagtgagagggagctgaggatcaggaccagtgagctgagaaagtccaacagctcaatagcacgaatgtcagcacaggccaggtggaggagaggggcgctgtcacagaaaaagtgctcaatcacgttgggaccacagtgtggcagtcctgccttgaggatggtggatgggagcatgaggagaaagccacccacccaggagaggatgacgaggtgggcacagagtgagctggtcataattgcagggtactgaagaggactgcaaatggccacatagcggtcataggacatgacagcaaaaggaataaactcagtgcatccggaaagaaaatagaaataggactgtgcagagcattcgccacttgtgatgctcttcctttccgacgggaagccctccagcatcttaggaacagcacaggttatggttaatgtttcactgaaagagagattgctgaggaagaaatacatgggtgagtggagcctgtaatccacaagaatcaggataataataagggtgtttccaaggactgtcaccaaataggctgataaaaaatcacaaagaggaggcccccaagggctctggtggttggtatccccacaagaataaactcagtcaccaatgtccaatttcccctttccatgcttcatatctcgttttactataaagagagctatagaacaaacaaggtaattcacttatcaaattacaaacttcaggataaagtgagaagaaatagttttagcccctttttttgtttctaaaaaaattgagcaacatggttgaaattatagttgagtgcaatatttcctataaaatccagattaagttatatgataatcaacttctctaaatctgtctttcttttttatattccataattcttgggagggggaggatatatgttaaatatattagtagacttgtatttcctagatctaataatatatttaacatattgacctatatttcctaggtctaatatatttaacatatttaacaaatttgtcacgtgttttaataaatggagcaataaaagatgtacttggtagttgtaaatatcatagcagtttattttcaatgtttaccttgtggggactaagctgcctgggatgttgcgagcacatgtagagggctcaggattccagttcaaagtcagtggggcagctatggcttccagtgtcacattggaccataggtgcacacggcagccaattataacagaggcacttgagcacctaggagtctggaactccaactgctccaactgccagtaagggtggaaaactacaggtgaattagtttaccctccttcacacactgaaaattattgtctctttaagtttaaacatatcccccttttctaacttttatttatctttgccttgtatggaagcacatggaggttaatttattcaaaatcttgcagttggtataaaagcactatagaaataaagtataaatatttgcaaaagtgttgataatttttcaatcttttacaaaactatctttgataggatcaactaaatgtttgaataaaagtttgtgtctcaattagctggagatgaaaaaagtctctgagacaaggttttgctgatgtagattagtgccaacattgcccatatggagcaaaaatttgcaataatttggtattattgcaaacttgtgaattacagaaagaattctcaagtttaaaaattatcataggctggtgcggtggctcacgtcagtaatcccagcatttttgggaggccaaggtgggaggctcgtgtgagcccagtagttggagaccagcctggcaacatagagaggcaccacctctagaaatgatttaaaaattagtcgggtgtggtggcacatgccggtagtcccagctactcaggaggcttaggcagaaggattgcttgagcccaggaggtcgaggctgcaatgagctatgatcgtgccattgcactccagcgtaggaaacagtgtgagacacagccagaccctgtctcaaacatataaaaaattaattaattaaaattatcatattaaaataagtagaaccgtataaactatagtaagattatataactttggcatcagtggagcattattatctcaacaaagaaaagtgggaataatgagagaaacacaatctgtttacacaatgagaaataaaacaaattttagaaaacaaaaaatggaaatatgaattatgaatctgcaacaataagaattgtatcaataaacatgaatatattaatttttactgttataaatatcagattgaaatacaaagccctatgcagtttgctagaataaatatactaaatataaaagcttaaaatgcaaaagagaggtcgggcacggtggctcacccctgtaatcccagcactttgggaggctgaggcaggcggatcacctgaggccaggagttcaacaccagtctggtctacgtgatgaaaccttgtctccactaaaaaagataaaaaattagccgggcgtggtagtgggtgcctgtagtcccagctactcgggaggctgaggcagggagaatgaacccaggaggcggaggttgcagtgagccgagattgcaccactgcactccagcctgggcaacagaacaagactccgtctcaaaaaaaaaaaaaaaaaaaaaaaaaaagagataaaagtacacaggcaagctagtattacaataaatcaatcataccctatttcaactaagctttcatttttgctcgcaagtccacctctgtgtcttcagtcagctgtcagtctcactctgcaagatgagtatggaatgcctttgccactttcttcaaatcctgacctacactgtctatggtaaataagaacaattggccttgtcacgaaaatgtgtcatgtaactcctcaggtgggaaattgtacaagtgccatttccatttctttccttttttatttgagacagggtctcactctgttgcccagggtagagtgcagtggcacagtcatggctcactgcagcctctacctactgggttcaagtgatcctcctgcttcagccttctgagtaactagcattacaggcacatgccaccatgatcagataatttttactatttttggtagacacatagtcattctttgttgcccaggctagtctccaattcctgggctcaaccatattcccgccttggctcccaaagtgctaggattaaagatgcgagccattgagcctggccctatctccatttctttaaatcctcataagactacgatgatcctctcctttctgcctcctacactaaagaaaacacttcccgtactgaatgttggtatttccacatttgaacaagatgccttcttgttttatctcaggctatcagtcatcactttctatattgattcctctgatttattttttatcactatggacctttcccataagtgttcaaacttacttagatgctaacatcttacaaaagtacaactgcccctccaacacaattttttctttcaacctttcaaaattatgtgtctcatggccgggcacggtggctcacccctgtaatctcggcactttgggaggccgaggcgggctgatcacctgaggtcgggagttcgagaccagcctgaccaacatggagaaaccctgtctctactaaaaatacaacaaattagccaggcgtattggcgcccccctgtaatcccagctactggggagactgaggcaggagaatcgcttgaacccggtaagcggaggttatggtgagccgagatcacaccattgtactccagcctggacaacaagagcaaaactccttctcaaaaaaaaaaaaaaaaaaaaaaaagaagaagaagaagaattacatgtctcaggataactgtttcacacacaattgcttccattgttttacaagtcattcctgccccattgccactagtctgatgtgcactaccccgatgccaatcatgctgcccttcccgggaacaacactgaagtctgtgatgagaagtttgatgataaccctttaatcctcatcttccatgttgactgcctcttccttcccccaacactctcaccccttagagaaatgcagccacctcataagtgccccccaacctctgtgcctcttccttctcacaacactctcacctcttagagaaatgcagccacctcacaagtgcccccagcttctgtggtcattcctgccagctccttttggggtttcttttccttcaattaaatttaatgttttaaaattcttttgtgctctgttcttcactctcttattatattggtttgcactcttcctgaaaaaatcgaatttgtttccatattttcaaatatcatctatatgttaaaaacttccaaatttttaactttcggccaggcccctcctctgagctccagatccatacatccaaatgttcttttggtgtaatttcttactgtccctaatatgtggatcaataattttttactctccgtatgcagagccctgcaccaccaaatttaacacgttagaaaaagcttttggtagagtaacataagtccagttaaacataaggcacagctaatatactaatcagagatgaccatctgcaaggtaagatattgatcgtttgggtactctaccgaaaagctgaaaccaatgagacttctctccctactgcacccatttcctgatctgagattctaatgcatcactttccttctacccaatatttgaaccagatgaatcaaaaaaggactgaggacatttctcacaggtcaaatcccagaaaggagagaaaatgtgagggctagaaaaaggcaggtgaaagaacccaaggacacgtggtgggggaaattacatgagctagagggtgaaagtgcattgaaccctgaggctcagggaccactgcactggaacgagtgagaccggaacaggtactcccaacctcaccatccatgaggtacttcctgtgatggattacatcatgaaacctaaaatcaaaccaacttccgctcctgcatgggctactgcaatgaccccaacagctcttgctctcttttagtcttttctctacacagcaatggaattcacacatgcaaaatatatcatgtcattccctaattagtatgttttgataatcatttcccttagtgcaagatctgaaaaccctatgaggtttttaatgacagagatggattagcccctaccattctctccagactgagctccttcctctatctccccagttcctcagccttcttctgccatgccctagctggactactctccactcttgttctcctcactcttgaagcgtaggtgaagtgctacataacatagaaagcttccctaatcatgtatgttgactcagacttgtcgtcctgtgttcatgctccagcttgcactttattatttcttttctttgggatggagtctcgctctgtcacccaggctggagtgcagtggtgcaatctcggctcactgcaagctgcgcctcccgggttcacgccattctcctgcctcagcctcccgagtagctgggactacaggcacccgccaccacacctggctaattttttgtatttttagtagagatggggtttcactgtgttagccaggatggtctcgatctcctgacctcatgatccgcccgcctcggcctcccaaagttctgggattacaggggtgagctactgcgcccggcctcactttattatttcatagtgatcatcacaagtagaaataaatcaatcattgctttatgatttgttacatttttctcctcccttctgcattggaaggtctattaaggtaaagtcttgcttggccctttctttcttttttctttttttttttttttttgagatggagtttcattcttgttgcccaggctggagtgcaatggcatgatctcagctcacagcaacctctgcctcctgggttcaagtgattctgctgcctcagcctccctagtagctgggataacaggcatgccccttgcccggctaattttgtatttttagtagagacggggtttttccatgttggccaggctggtctcgaactcccgacctcaggtgaccgcccaccttggcctcccaaagtgctggaattacaggcgtgagccactgtgcctggcttgcttggtcctttctatgtcattgtctttccgggaaattcagactgtggcacaggacgtggcatgcttcatgagattaaaaatatttgtagaattaatgaatcaaacaatgggcaggatttgtagagatcttctaaactggctgaataaaataaactataaaagtgatttaagagcctgggcgcggtggctcacccctgtaatcccagcactttgagaggccgaggcgggtggagcttgaggtcaggagttcaagacctgcctgaccaacagggtgaaactctatctctactaaaaaaaaaaaaaatacaaaaattagctgggcctggtggtgcatgcctgtattcccagctactcaggaggctgaagcaggagaatcgcttgaacctgggaggtggaggttgcagtgagccaaaatcgtgccattgcactccagcctgggcgacagagtgagactctgtctcaagaaaataaaaagtgatttaaacattttagtgacatcctctgactctcaggactcacagtagcacagaatactgaggatcttctccttcctccctccctcccttccctcctttcctccctccctccctccctcccttccttcccacaatttcattaaacaaaaaacactaaaacatctaaggtcttgtagatgaatatttggcacttcaaaggccttacttctttcttatctttaggagataatgtaggtcaacaaacattttaaatgtcttcttttttttatttattctttctactgctatttaataagcaccaatggcacccaccaggttttaggtccacaaggccagtctactaagagtacttaaaagatgcagagctttctgtacataaggttatgtaaacaaagggaaatcttattgtagaatgtgaaagtaatgtgtgtgtaatcaccatccactggaattcaatcagattttcctaacaagatgttagaaagtgtctaggacaaaactgacctcaaaatggtttgatggaggcagtttatcttctgaccagttgctagtgaggaaccctcaaaaagctgttgttttgtggcctacagaattcaatgcagttctgacaatgatcttcaggtttaaaggtctgaatctaccattcacttaaccctgaatttaatccactgcatgttctgtgcaattttctttacctaataaaggaacttccttttacttgtactccatagaataccacatttccttctcatgacctttctaacagcttctttgaagtctttgttcctcaagctgtagataactgggttcagcagtggtgtgaccacagtgtagaagacagaaatgatcttgttgatttcaggcaacaggtggggactgggacacacatacatggagatcatggtcccgtagtagagagtgacaacagccaggtgggagccacatgtggaaaaggtctttctccggccagaggtggaagggattctcaatatggaggacacaatgaaaacatagggccccagtgtcagaaaaaaacaaatgcacagcacggcaattgacaggatgaagatggtcacctcggtgatataaactctggaacaggagagctgcatgagtggcgggaggtcgcagaagaaatggttaatctgattgcgcccacagaagtccaacctggaaatcatcagggaaggcagaaagcctgtgctgacccctgtgcaccaggagaccaccaccaacctggcacagagcccacgatgcatgaggaaggggtagcggagtgggctgcagatggccaggtaacggtcataggccatgaaggccaggagaaagcactcggtggcgccgaggaatacgaagaagtagagctgtgccatgcaggcagagaaggagatggcttggccccaggacagcaggttggctaggagaaggggcacagtggtggacgtgtaccagacctccagaaaggagagatgctggaggaacatgtacataggggagtgcagtcgcaggccctggctcaccacggtgatgatgacaacattccctataatggtcaggcagtagatgagcaggaaaatgacaaagagcagggcctgccattcaagaaggttctggaatcctaacagctgaaagttagtcacagtggaggtattttggggctccattgcctgtgggggatgaaaaacattctggaaaagcacaggatgcaaggcgcaaatttatcactggtgatgcttggaacttcagagattaatttttaaatagtttagatctgtatgcacagctttttagaaggataaatgcataattccatatctctttcgtaagaatacattttgaaatcttaagctgaatgtgaatattagatcttgtaaggagactcagcaagtttcattcatctgggttctctgaaatcttgaagtctccttccaaagacaggcaaaaaaggactcttattagtagatcttcagtgttctcaccatacaaaaaagaaaaattgaggtgatgaatatgttaattggattgattgtgatgattatttcacaatgaatacatctacgagaacaaagttgtacactgtaaatatatagtatacaataattatcaactacacctcaataaagctggacaaaaactcagaaaactaacaataacaacaaagctttaaaaaaaatcctgcacggccgggcgcagtggctcacgcctgtaataccagcactttggaaggccgaggcgggcgtatcacgaggtcaagagttcgagaccagcctgagcaacacagtgaaaccccgtctctactaaaaatacaaaaattagctgggtgtagtggtgcctgcctgtaatcccagctacgtgggaggctggggctggagaatcgcttgaatccgggaggcggagattgcagtgagccaagatcgcaccactgcattccagcctgggtgacagggcgagactccgtctcaaaaaaaaaaaaaaaatcatgcacatgtggaagcaaatgcctttcccttctcatctgtgggctttgtctgaaaaagaagccagacacagcacatctcctatgccatcttgggaaagtgtatatattccaccctcaaacaatatttattagtccctgctgtgtgtgtgtgtttgtgtgtgtgtgtttgtgtgtgtgtgtgtgtgtgtgaaggcctgtgctgaactaatctgcctcactccactggtgtcctttcttgcctcatccgataccatactcatgctcagccactataattacaccctcgtgtacaccttttattctttcatttaattcattgtctatagttctggataaagtaaacatccacctgccatacaggagcttctgtgaagttgagggagtgagacaagcaagaatagaacctctttaaaatgtacaaccaacaaactcagtgtgcccttactgctggagagcaatcattctgtatttcccttataaaccaaaaataaaattctaaaccccacaactgactgagcggactcctcctttcagccaaggggatttcaaagaaacctaaaaattctggttcagatcatgatgggaagagggggttggacaaacctcattacactctcctttcttcagaattcaggcataactgagcagcaataacatcaaaaaagagattttaaggctgacgaaacagactctgtagaaataagctaccaaattctaacctgactctagtatagcatcatgacagacagccgaccctgaaggaaatggaaatattttaccacaaaatatatttatttgtcatatttaaaatggccctgcaaagctgtctcttgtgggggaaatctacattctgcggagaatccctttccctctccaggcctttgtctgatcctcaagagattagctgaaagtctagcaccttttaaaggtctcaatagaacatttttcccatctgctgcttctcaggctggcaacatatgagacttcatctacatcataagaaccttggtttccccaacccccctatcttaacccagattctcctttctattgattccaggtcttcagacaataacttaattctttcaaccagttgccaatcaaaaagtctttgcatccacgtatgactgtaaccttcccccattcttggagctgtcctgcctttccagaccaaaccaacgcatagctcacacgtactgattgatgtcttatgtctccctaaaatggataaagtcaagctgtaacacaaccaccttaagcacatattctcaggacctcctgggactgtcacagatcatggtctttaaatttggctcagaataaacctcttcaaatatttgttacagactttggtttttatcaatacccgtatctattcactcttccaatctcctaagtgactatttcacttatgttgctctcttttcgaacgtctagcacatccctgttgctctgtaccctcagtaagagacttatttcactggaagatcctgaaatccttcagtggaagtatccacaagctcaggccactaaattctgccatcgactaccttttgttcctgtgcacctactccctacacttcctctgagtaaactatctgtgtccaagtctaaggcaaatccttccacctgggcattaggcgccataacctcctacacactggaaaggtattgcaggtgacagaggcaaaactattcctatccaaaagactcaggagtgttgagctgaagaagacgaacacacaggggacctgccccttcctctgctttcctgaaggcaggaccaagatttacaaagacaaaggtcttcctgcctcccctctgcctcttcccacctgaagacagtctcctttataatgcttgcttctcagctcagacagcaacgccagggatctcggaacagactactcttcctgtaaattttccttcccaaatgtcttgcttttgggaagcctgaagatgccgttttttttgttttgtcaccgtagaggatgtatggctccttgctaagatactatttcagcaaggcctcaaagccactgcttccaaaccgtcgcaacaatctaggtgagccgttttcctgagagagctgctttctttcttgtggatgggcatgacatgcataaataaacatgcttgtttttctcttggtgatctgcgttttgctcatgaaaatctgtcctagcagtgaatttaatgaaagtcgagaagagaaattctttttttctctccttcactgggtattctcagcttcatgcctgaatcacccatggtgccctttctgccaaagcatttcctcagcatgtcaatgggctggatttctctcccccactttaaaaagacaaaacagagaagaatgtctagaggctttgctgttctctgaatactacctgcacttttctgctcccttttcccgatgctttcccttctggagggcactgtccctccctgctgctcctcgtcctctgccttcttgctcgctggaatgcactatgatcaggatgtttttcttgccactgccccagacggcgcagctgtgctggcattgccctccaaccacccatcgcattcccgatcctcttcatctgtggcatcatcgcaccattgatccctccctcttcctggatccactggtcacttaatatccacaactacatactctcttagatcagcgacagccctggtttttcacacttgtacagggcttcgtgtctttcaatctaccttcatttccttcacagtttcaggcagtctcttgacttgaatgctgtcactttgctctcagccctcaaatttatgtctcaagcttgaacagaagcgtcctgtaaaaactgccctatgtgaaatgctcactcatgactagtcagcatttgcaatttaacgagacctaacttagctgaccagcactcctgactaccccagcctccctcagtgcagccttcccatctccatcctcccacttgctcagaccagaaactctgaatttgactcttgttcctttcaaacccaatgtccaatttttcagcaaaattgactggctccacctgaaaatgtattcagaactgatctgatcaccatttacgaccaccatcgcttgctgcctggaaaaggcaccactatctcttatctagattgttgcaatagtttcgttaaagcacctccacgtccagcctgccccactcaagaaagcagtcaaagagaatattttaaaacacgggagagtttttgcagtgaacacagatgtactgtgaattgttcctgaaaaggaagaaaacattgtgaccagacaatccacatattcacctctgcagtttccgctttgtcagaatcgacgttctgttgacttgctgtttctgttcttcatgtctgttgcaattcactatttctgctctgttctacgttctcctctcattcttggccaagtcactgggaatattattttcatgtagccaggaaataattatatcaagagaaaataatatcttaacattattgcacatgctaaaaagagtataatactgaatgtgtcatatatattgaactatatagtacttgatttcttcaataaagcttaagaaacaaaaacaaaaaaccaaccaaccaacaaacaaaaacaaagccttgacaggttacccagccctgcttgttctctcctcccacagcctcaccaaactcttagtctactttcttcttggtccgttctgcacccagtgcttccgcctcctttgtattcttcaagttacctgaaacgtgcctcgttttctccttagcatgtttagttccctgcaacgttgtcattgaacagctttgtatggctcatttctcatgtccttccagtctgctcagataacaccttcttctttaggcctgatctaactactcttctgccattctcagaatttataagagtcaagataaaagtgttaagtatatgttggtttgaaggcaaaatattccagcagttctggcttgaaaacactgaacgaaaactaagagatgtgagaaaattgttatttgatccacatagattgatttattcacatagattatttattcagccgggcacggtggctcacgcctgtaaccccagcactttgggaggccgaggcgggtggatcacttgaggtcaggaattcaagacaagcttggtcaaaatggtaaaaccctgtctctactaaaaataccaaatttagccaggcgtggtagggggcacctgtagtcctagctactcaggaggctgaggcagaagaatcacttgaacacaggaggcggaggctgcaatgagccgagatcgcgtcactgcactccagcctgggtgatagagcgagactccgtttcaaataataataataataataataataataataataataataataaatactcttggtaaaacaacaatgctttcttggaaaatggttcctttttgctttggctttcacttagtattttataagaatatgaccatggtattcaatttaaaatgaacatccacagaaaaataagttaaacatggagcgcaatgagggtctccttgatgagaccacagtgaaaacaaaacagccctttattacaataggctaagtttacaggacactgggctcagatcctagttttctaaagtacctcccacaattcatatccaaatgcacaaggaaaatgaactgttgtataatcatcgcttcatggttaaatcctttcagtaatgaagagctcaccaccttttgaaatactgattgtttttttttttaagagacaaggtcttgcttcgttgccctggctggagtgcagtggcacaatcatagctcactgtaatctcaaacttataggctcaagtgtcctcctgccagggtggctaggaccacaggtgtgtgccaccatgactggttaattatatatccacatattttttgtagaggtagaggtcatgctatattgcccaggctggcccttaactcctggctccagtgatcctcctgccttggcctcccaaagtgctaggattacaggtgctctgggcctgattacttaaatactgactatttccaagtgctagaattactttaattacattgagctggaaaaaaaaaatgcttcccaaaagactgggttggctttagctctagggcaacaagggtaacctcagatttaactttgtagctttctttgaaataaaaataattacgaatgttgttgttgggggcagtggctcacgcctgtaatctcagccttttgggaggccgaagagggtgaatcacctgaggtcaggagtttgagaccatcatggccaacatggtaaaaccccgtctctactaaaaacacaaaaattagccagacatggtggcggatgcctgtaatcctagctccctgggaggctgaggcaggagaatcacttgaacccaggaggcagaggttgcagtgagccgagatcatgccattgcactctagcctgggcaacagagcaaaactctgtctcaaaaaaaaaaaaagaaaaaaaagaatgttgttgttcttagatgcaatcttgcccagagtaaactaaatggccttttgacttctcgagaactcttgattaattgtctgttattacagttttataatttaggcaagatcatttactgtttccataaagatagagaatctgcaaaggctaaaattgccttgataatgatgaataatttattgaagtcgatgtatttttagaatctaacatacacaatcaaaacaaggacatttatgttatttgacagtaaaatacacaccacgttgattttcttcttctctgcatgaactccccctacctgtctgttttcccggcgtccagagcgctaaatggcccctgctctaggcaatgtctacccgtgccctcctgtaacccaaactcttactgtgctttcattgtgagatctgaaatttgccatcttctgccggtgtctgacactgggtaaagccaacttctcctttcaatagccttgggtttcttggggacctggcccttctgagaaacttgttccccagatattattctataatttgacaatcaagtcagaaaacaatcaaatcaaccttttgagattcaaccctgcccactggggcttagatgatgataaaatatttgagacacatggacacatgcaattcttccattctttttgaaaaggatttatttttttaatttaacttaagataggtcccaaaaatgttgaactaaaatctgaatcaaacaaatggagatttctctaaaatccagcaagcagacactgagtgggtgagtgagccgttctgactgaaaacttaacaggtgctttttgctgaatggcatttcctctgcataccttaattacagacgtggctaaatggaaaaaattatgaacacaaattaattaattcattcaattaaagcaatctgtagcaaagatcattctaaatttaaatctgtcaatttaacaaagaaaatgcaatatataaattggtctgagaggctattaggcttgagttttagaagagaagttaaaaaataaaatattttcttttttttttttgagatgaagtctcgctctgtcgcccaggctggagtacagtggcatgatctcagctcactgcaacctctgcctcccgggttcaattctcctgcctcagcctcctgagtagctgggattacaggcatgcgccaccatgcccagctaatttttttgtattttcagtagagatggggtttctctatattggccaggctggtctcaaactcctgaccttgtgatcctcctgcctcggcctctcaaagtgctgggattacaggcatgagccaccactcccggcctaaaaaagaaaagattttcaacccattcgtaatatagcaggatttttttttaattccagtgtatagaagtctaattaagaagagcaaatttattaatatttctagttaaatttatatattttagtctaagagaaaatattaaagcgttgaataaataaatgtataaaaacaaaaaatcacatattttgtttggttatttatgattcatttattcaacaaatacctaccatgtgcctgcagttcattcaggcattatgatacaacagtgaatcacaccatgttatagtctgacaggatttatgatctattgatgtttgatttaaccaatatgcattttttcaagataatatgattcatatgtacagtttttagaaaatttggaggaggaaagacagtgcagaaaaaagtacatctttttaaatagtcatagaactgtctttcagagttacaaacctaatgtcttgccttccaaactctttgtgtcccacatatggggtagaacaactgggttactacttatacagcctgtatcttggctttctttgcagcaaattttatatagcctgaatcttggctattttgcagctactttttcagttaattcctaccatagctcttttctcctcctgctaaattaaaggaaaaaaatgaataaagcaccctttatggattgtataacagtccattgtttggggtggtcttttcatagcttatcacaaatctagctcttgtaatatctgcatgtttgcagagacaggcatgacctagccagcaaagattatgtatccactttctttttgttttttttttgagatggagtctcactctgtcgcccaggctggagtgaggtggcacaaccttggctcactgcaacctccgcctcccgggttcaggcaattctcctgcctcggcctcccgagtagctgggattacaggctcccgccacaatgcccggtttatttttgtatttttagtagagatggggtttcactatgttggccaggctggtcttgaactcctgacctcgtgatccactcgtgtcggcctcccaaagtgctgggattataggcgtgagccaaataacaaaacttctgtgctcatcagcaacagctgagaaaatggagataaaagggtgctcaggcctgcaaaaccatcaaggcttagactcgagagagcacccggcaaagggtacctggaacatcagccatgtacacaaccataaccagaaggtgttaggccctcaatgtccaaggacaatcttgggcaagatggttgtttttaacttagaacaactctttggaatccaataattgaataaaactggtgagttaattgaaacaaccagccacaaaaggtaaatatccaatctagaaatcaacaattattccttctcagtcagccacatcttaaagttctcagataatctgttgttatcttcacaaacctcctggcacctaattggggagaaagtcctcacttccgtatatctccaggtaaaacacacaatggaaataaggaaacttcagaagaattagccctgcagacaattaaacaaaaaatatgtccccaaagatttgcatttgcttttctttcttccatgtggattaattgattgggaagccaagggtttggatgagcatttgttgagtgtgtattagattccagacactccatgtataatgctttatataagccttataaaaggacccttttcgtcgcagaaggcataggcagaaagacttacataacgcaccagggtcagaggaagggtgcattagagcactattgtctgaaggcaggtcagctgcagcttcattgtctgaatttcagtttaatgcactgctttcaagacagttacggaaattgcggggattgtattagtggaatctagttcaaagggcatctaaggaaacgtgtaaatattagttatgggaatgatgcaaagtttctggttctgctaagtaattcaggagctagtaagagggacaaatgagggagagacctgatacacgaattgaagagaacttctactgctgagtggtagacaaggtcagagggagagggagttgacaaggaaagccgttccgcaagggccctgggagagtgttggagatggagccatgtggattggtacttcttatcagcattttcatctaggaagatttgttcctgcttttcttcctaccctgccatcaattaatcaaatatatatgcttcttatctttctttaaatcttatataaagcaggagaaaatactcttttataactcatggcattttgtcttcttgtgctatggagtgtgtttgcggaagattcttgaattcacagacattcttaacgcatgtcatataactatgaagagccaatacgtattttttgtatcaaactgatttacacaataggatttacacaaacggatttaacacaatatggaacactggatccatattagcccattcattgcagattcattgcagaagtctgtatatctggaaaaatgcctcagtgcctttctcctcctcattttacacagaatagagatagcaagggggtgttgagggatcacttcaaactcattggagagcttttgtgggctttccttggagaagtggctagagaggcctactatgggtgtttgtgcatttatcagctggaacaatgcgatctatgcaaatacagttggatctgggctgcctccaaaggctatcagaaaaccccacaactttgctgtcccattccaaccaccccagccaccctagagcatcattcggacagacaaagcctctaattcacagtaatccacaggatgtcaatgctggcaaccactgggaaagagaaaagtagggtctatataccacatccagtggtgataattgtgagtgtcattgatatccattgcctaccaataaagactaaactgtttggcatagcatacaaaattagccatgatctctttccctgcattgccacctgagtgggagccacatccagtcatactaaaaatacaaaatcagccaggcgtgatggcatgtgtctgtaatcccagctactcaggaggctgaggcaggagaatcgcttgaacccgggaggcagaggttgcagtgagccgaggtcgtaccattgcactccagcctgggtgacagagcaagactctctcaaaaaaaaaaaaaaaaaaaaaaaaagaaaaaaagaaaaaagaaaaagagaaaaaaatgcagggttcagttgcgtgaatgaggtccttttaaagccagaagcagggaggaaatgctgagtcagcggctgctagtcttgagggctgtgcttttatttttggcattgtgaatttgccaacccaatagtcctatagacacacacacacacacacacacacacacacacacagagagagagagagagagagagagagagagagagagagagaatttgacccttctggtcttagagcttgaaacttacttttgttttatctgagttccttcctcaggaaaggaccaccagccctcttgaaaagtaaagtaacaaagaactgaaacttaccggatcaccccaggtcatctcaaccagttaatgagatgccagtccagtccgcttattcaacatgattgcttccttacccctccctagttcctctttttccacacagtgtgctatttcttccctgcctctatataagcctctaattttagtcagtcagggagatggatttgaaactgagctcctatctcctctgctgcagcacctgattaaaagcttcttctttggcaataatcgttgtctcagtgattggctttctgtgtggagagcagcaggacctagaccgaactcctggtttttggtaacaaattgggctgatttgggggctatggagctaggagattgtgaatccccaaagctgaggcaaagggtttggccatggagagctgagaaactctgtgaaaagggttcaaagtagggaagaaaatattgctgtcctgaagaaatggtttcaggagcccaaagccatgataccaaagaaattacaaaaaagagcagggaggaataatggtcagatgacggcagatcccatattttaaagatgtcacagaaggcaggacacaactgaagaggaatattagagaaggaggatggttgcaggtggtattagctaaaagatttgcaactctgcaacctgtaaatgagtcacagggtggagttagcctataaattaaggagtggggtgcattagaatttggtcgtattggcataaaccaagaggtgctttatttacgccaaaagaaagctcatgagaaaatacaaatttaagttagagtattcccattaaaccagaaactgcctggcgaggcactccacatagcatttgtaaatacaatgacatctggatataatccagtccacaacttacctgcatggacgtgctgtaagggaaatgtgtgtttctaagaacaatggtaccgatgtcattcctagtcaaccagtgtcagagacaaaacagtttaagctcagcaactctaggaccagcaggggaagaagtgagctcgcccactccgtcacaccctactgaaaaccacagtgacccccaacgtcagaagccaggggcctttccttaggatcacaggcactaggaaatctgaatttaagtgagcctagttatcaactggcccatatatttgagtaaatggattgttttactgtgtctcgttatgcctgcaaaatagaaaaatgctccagcatctgccagagttatggagagccagggcaagatcatatatgtaaaatgcagaaaaacatggatttgacatttgacataatataatcatctttgaacttccctctttcattagctcctatgataaactgtcctaattctgttcatttacttattaacttgtttaatcagttagtatgtgtggagtgtccatttgtgccagttactcttcaaggtcctggggatagatagagcagtgaacaaaatagaaaaaaatctctcttcctaatgtagcttaccttttgactcaccatccttccattcacttcactatttcatttccttttcttcaattaaatatatttgctacatggccgggcgaggtggctcacacttgtaatcccagcactttgggaggccaaggtggggagattgtttgaacccaggagtttgagaccagcctgggcaacagggcgaaactctgtctctacaaaaaatacaaaaattagctgggcgtggtggcgggcacctgtagtcgcaggtacttgggaggctgaggtgagaagatcacttgagcctgaaaggtagaggctacagtgagtcaggttgtggcactacactatagcctgggcagcagagcaagaccctgtctcaatatatatacgtgtgtgtgtgtgtgtgtgtgtgtgtgtgtgtgtatttccaacatgccaggacctatattaagtgtctactatctattagctcgtttaatactctgaaaggccttatatgaatgacactaacacctcttcactgcacgtcagaagaaatgcagggcagaaacgcggcacagcttgcctcaagcttctcagcaagtgccacagcccttagtccggagccagagtctgtttttctttgctaagccttctgctctttagcttttttctctaatgccacatctttcgtgttttgctaatacagatccatgtgtgttctccaagaatctattcgctttaattgcgcacttaacctttaggcctcaagatcctctgctctgcctgtcgccagagatccagcccaagagtttgtccttataatgaagacccacaaaccccagaggatccccaaggacctgagtcatctggccccgcctcttgctgcagccttatctgctgccaccatattctggcccagcttgccagcctgcctggcttctcactgtcatctgggtatgtcttgctcccacctgctgaagtttaccttgtacctttcatggcttctgggggcacggccttgcggagccccccttcccgctggccagcttgtgttcacctatcagaggtttgctcagagacctcaggtgtctgcccccgaccctgcagcctcattcagagtcctctgttatattcctgcaggactggtgagcgaccttccttgcagttattggtttgtaattatatgtttgcatgatttcatatccacctcttctagttgatcttaaggctcctggagaaatggggtcccacctcttttccttaacatgtgtattttcagtacccggtgcaatgtctgagactcctggctacaaacagacacaatgtgtgctcagggacagattgatttgccacaggtacaccccaccatcacttcaaactcgaccatactaaagttattttgcacagatgcagacactgcctcagacttgtcgactttctggacgacattagagactttaatgtactttatcctgattcagccttccactggatgaagtaacatactctgtcaaatcattttgctcctgtctcagcctcccccatctgacaggtacaccactgagaggctaagcttgaattattcctctgatgagtatctctatagctttgtcatctccaagactggctttgcaacaatcctacaacatgtgtgtattccttgtaggatcctcattgaactaggccagatatttatttaaatatttagaattatttttggctgggctgtaaacctatagttacacacacctatgcaggcatcttcccgtgtcaggcggtgtctcatttctttatcaagaggtaattagtgcaagagaaaaaaatgaagtttgaaaaaaacatttaaaaattgattatgccatataaagggggaaagccttttaagaaacgattatggcatgagaggaccatggagtagctcagtaacaatggaaggggctcggagggtggaaggcgggcgagggatgagagatcacctaatgagaacaatttacgctatcacagcgatgcctgcgctaaagcctagactttatgcagtgtctccatgtaacaaaactgcactggtaccccagaaatctgcactaaatctatataatgatgatggaggctgggcgcggtggctcgcgcctgtaatcccagcactctgggaggtcgaggcgggcagatcacctgaggtcacgagttcaagaccaggctgaccaaaatggtgaaaccccgtctctactaaaaatacaaaaattagccgggcatggtggcgggcgcctgtaatccctgctgcttgcgaggctgaggcaggagaatcgcttgaacccgggaggcggaggctgcagtgagccgagatcgcgccaccgcactccagcctgggcgacagagcgagactccctctcaaaaaaacaaaaacaaaaacaaacaaacaaagatggaaggaaggagggaatttagcaattctccagatctactgccagtgaaaatagcatatgaggagggattccagttagaaatgcccagtttcctgggtgtgtgtgtgacgggggcggggaaccacaacgttaattttatccccgacatagggagcgcctgagtggtggcttttcaccgggtgtggctcgtctgagctcttgaactgaagccagcggacaccacccgtcggcgcctgctttcctggggcgtgggctcctccccctgtgcagaccgcgaggggagacggtgcgggcggccgggagcgcagccctccgggaggcgggtcatggcctgggcgccgcccggggagcggctgcgcgaggatgcgcggtgcccggtgtgcctggatttcctgcaggagccggtcagcgtggactgcggccacagcttctgcctcaggtgcatctccgagttctgcgagaagtcggacggcgcgcagggcggcgtctacgcctgtccgcagtgccggggccccttccggccctcgggctttcgccccaaccggcagctggcgggcctggtggagagcgtgcggcggctggggttgggcgcggggcccggggcgcggcgatgcgcgcggcacggcgaggacctgagccgcttctgcgaggaggacgaggcggcgctgtgctgggtgtgcgacgccggccccgagcacaggacgcaccgcacggcgccgctgcaggaggccgccggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccataataattctcatttgtgcaatgctttgcttttgcacagtgtttacattaaatgagtgttgtcagcaaagcaaccctcgggtttgggcgttgttaagaagagtgtcgagctgggtacgggttccgacccctccaaagctcaggtgcacgtgcctcctgaagtaggagcgggtggctctccatcagcagggatttggggacttaggattcgaacatcctcaatgaagaggtgcttcatttggggtgtagcccgggaagcttcaaagagaaagaagaaaaacaaaatgggagtatttggtccccagagtggcatctgtgaaattgtgtgtcgatttcttcctactggtgcccttcaaaagttcttggatgttttctgaacacacttgaatcccagcatgtagaacaactgccagcacagaggaggtctaagtcgtctttactgacagatttaaccaaaggactgtcagtcgcgctgtagtgcattgcaaatactttcttaaaatttttatttatttattttgtttgttttaaattaaggtttaggatattttccccttccttctctaccaatatctctcttggtatttcttcttgattttcgttgtcatttgcgagatgtaggtactagtactaggtaatttctagctaaacttttctggaatgttcttgcctttttaaaaaaagtccagaaagaggattggtagtaacttttttttttttttttttttttttttgagacggagtctagttctgtagctcaggctggagggcagtggcgcaatctcggctcattgcaacctccgtctcccgggtcctggtgcaagcaattctcctgcctcagcctcccgggtagctgggattacaggtatgcgtcaccacacccggctaatttttgtatttttagtagagacggggtttcactgtgttggccaggctggtcttgaactcctgaccttgtgatccatccgccgtggcctcccaaagtgctggtgttacaggcagcccagcctctagtgtaatatttctaaaggtgttctccatattttcagtagttcttcggttaaataccaaataaatattatctaaactcctgagcctctcagtgaaagctttctagggccctaagttatgtttccatagctctcttgtcttaaccagccaggaaacccagcaaatttagccgaatcactgttttcctaactgtgctacatctccttgcttttgctgacagtttctttggcctgagggagcttttctttatctacaagtgtcaaagtgctccgttctttgtaaacaccaaaacacatgccactttccccactgagtcaaatggtatcatgaattctactgttattttatatataacaattataatattctccttttaaaaacaattgatgtgtatgtaggatttattgagtaactttgggaatataattttttaattaaaatcctgtttatgtatgtatctttgtgagtatttaaaatacacatatttacctctagtgagcgccctatcattgaaggaagatttagttctcattgtatttttactcattgcaaggtttacaacatactgtgttttttcatataaaatatgataacctaccaagttccttctgacctaataatactactaatactacaataataaacccatgctttatcataaagtaaccaataacttcaagaagttgaagttatatagagaaatacagaatacagttatatagagaaatatataaatatagagaaatgtataaatatagttatatagagaaatatatgaaatatagagatataatagcatcactcttcatccaaacaccaatagatgacattttatctaatatcattctcatttacatcagcccagttttaatatattcattaccagcacattttttttcaaaattcatgttgttttgtaaaatatttttattcattggacattatcattgtatttctagtcattaaacattctgtaacatcttattttaattctatccagttaatataatttttttctcccctatctttaatgttttagtttagttatgctatcgtatataacaatgcagtgagcatacttttagataaatatttgattgtatctggtattaaaatacatttaaggagctaggcccagtggctcatgcctataatcccagcactttggaaggccaagatgggagactctctggaggccagcagtttgacaccagcctgggcaatatagtaagaccccatctctacagaaaacaaaattagctgaatgtaatgatgtgtgcctggagtcctagctgcttgggaggctgaggtgggaggatcatttgatcccaggagtttgaggctgcagtgagccatgatcgcaacactgcacaacctgagtgacagagcgagaccctgacactaaaacttaagtacatttatgtttagtttttaatgatattgaacatttttatgtgctttctagggactgtttaagttgacttttgtatttcctcacacatctgtgtgacgttaggtacagattgagggcatctgtaacagctgaaatgttcccaaacaggtaaagctccagatggctctggaacttatgaggaaagagttggaggacgccttgactcaggaggccaacgtggggaaaaagactgtcatttggaaggtaagaccatgttggggctttaggaggcttgcctgtttgaaggatccagattcgggtcagtaattcttctaccatcttccattctccagcacttttgttccatctccatatatgcccaagagcacctcagagccatcctgggtcatcccgtcccctcaaatgatatggttcatttttgttctttttgtctctactgccatcacccaatccaaattataattaaatagctttgctagtttgatcttcctgtaaaacccactgctgtatccctgtcacctagaatagcatcttatactgttgctaccagtttgaaaatatttgttaggtgaatgaaataatgaatatttcacaactttgtaacagaagaagtgtagcccaaggtgatcatcttatatacagggtaataatctgaacgtttagccttttttttctatcatctatacatacacatattccatttttttatacctcactagctctttttattccatgtttcattcatgcacatgtgcgtgcacacgtgtacacacacacacagtgattcatacacacacagtgattcacatacacacacacacacagtgattctcaacctgaggcgatacctgccccccaagataacattttgcaatttctggagatgatatttttggatgtcacaactgaggaggggtgggtgcagtgcacctgtcatctagtagaggcaggaatgcagcttaacaccctgtagtccacaggacagttcccatatcttgtgaggaaaaaatgatctgttcaagatgtcagtagtgtcaagattgagaaactacgtatagaaactgtgtgtatagttctatatattcatataatgtattatataatatgatatataataggttatactttgcagaatattcctattctttctccttttccaaataacccttcttttctgatcactctatatatttataattatttccttcttgttttctttgaaaatttagtcttatactctgtctttatacagatattacataaagactttttaaactatatttttctttatttactacattactagattacaatatagatatatacggataggaaaagataacacttatcccagaagaaacatgtacattaaggccaggcgtggtggctcacacctgtaatctcagcactttgggaagccgaagcaggtggatcacctgaggtcaggagttcgagaccagcctgaccaacacggagaaaccccgtctctactaaaaatacaaaaaaaaattagccaggcgtggtggcacatgcctataatcccagctactcgggaggctgaggcaggagaattgcttgaacctaggaggcagaggttgtggtgagctgagatcgtgccattgcactccagcctgggcaacaagagtgaaactctgtctcagacaaaaaaaggaaaaaagaaaagaaaaatgtacattataggtaaatgatgtagatagtgataggaaaggataaaagttatcaatattaaataatattgatgttaataacattagtacctaacgttactcagatgtgtgaagaaatatttaaacttattaacgttgatactgacaaacttatcaatattattaacaaatatctttaaactagtagtgacagtataagatgcaattctaggtgatagggatatagcagtgggttctgcagtaagatcaagctagtaaagcatagtttcgattgggtagtggcaatggagataaaaagaacaagaacaaagctttacagtattaaataatgttcattacttgcctataatgtacatagtggtaggatgtacattatttaatattgtaatattgattgataatttttgttcttttcaggctgaaatacaagtcagttgttttcaatcctggcctgaccatagatctataaaatcagaatccccatatcggagagctgagttcctgcatgttttaagccctctacagattattcttaagtagggatgatactaagatccctgttctaagccaagtaaacttgcatgatcattaccatcaagaatgtctccatgtgagccaaatgcagcaaacacatctttggtcaaaagttattctaaatactgcaaaaccacctttcctttttctctgtctgcagatatagttgtgctcaagagggtggtgtgaaaggaagatggattgcaggcaaatcgcttcccaccttcccacctcacaccccctcgtgccccaggtatgactctacccttctccagtggctgcgttatttgccccaccccacgacagcacagcctctgatatgaagagagcttctcatatttacatgagttacactttcaggaatcagtgtatggaattcagacttggctgatttcagaaagaagatgaagttttctgaatctggtgatttagaaaatggtggaaggaggtagagatggaaaatggaaggaagtagttaagtcttaggggatgtttagtttaaaaaggtgatagctcatgccttttagtcaaagcaagaagttatcacgtttaaaaacaggcaaataggctgggcacagtggctcacgcctgtaatcccagcactttgggaggccgatgcgggccgatcgtgaggtcaggagtttgagaccagcctgaccaatacggtgaaaccctgtctctactaaaaatacaaaaattagctgggcatggtgctgcgtgcctgtaatcccacttactcgggaggctgagacaggagaatcacttgaacccaggaggaggaggttgtagtgagccgagatcgcgccactgcactctagcctgggtgacagagcgagactctgtctcaaaaaaaagattaaaaaaaaaaccaggcaaatgacttcacctacaaggccgtataacaatgtaacaaaactgcatttgtaccccatgaatatatacaaaaaataaaataaatcgataaaacaggacagagaatgggaggtatagatactttgagggaataatttacctctcgtactcagcttaaagttagttttcgatatacttatcttgagagaagaaaatctagaaactaagcctgggacgaagtatgttccttaggtctattcagaaactgaagacgtgagattcaggtagaaattgggattaattctctgacgtgaactctgaaatcagtggcctgagcatcacttagttctttcttggctttgtagagaatgttaggcttatggttgtgttcactattaccatattatgaaacagcattcatattttctcatctctcagccttttcttattcaaacaaacatttcttcatcattcagttgtttctagtggttctagcgactgatctagtagtaaatagtaacttctgctgtgtgactgctctatgctaatcactgttcttgtagtttaatagatatttagctgtaatccacatactcctctttttccccacattttttaagagatggagtcttgctctgttacccaggctgaagtgcagtggtgcaatcacagcttactgcagcctcgagctcttagacaagtgatcctcccacctcagccttgtgggtagctgggactacagggcttaccaccatgcctggtcggttcattttaatttttttagagatggggtcgcattttgctttgttacccaggctggtcttgaactcctgacctcaagcactcctcttgcctcgacctccccaaaacctcacattttgtatatggtactgaaacttcagtataaaagtgccttgcccccaagcctgtggcaaaatgggaactccagtccaacagtattttttaaacttaatttgaaaactctcctgggctacttcttatatgaatggactccagtctgtgcatgttgttaggatgcaaccagtgagtccacagagttacggagcccggggaagtctggacattaccttctccagcactgtcctgtacatggctgctggaggccaagcactgacgatgtgatccacggtgtcacctcaggagaaagtggaaatgcagaggcagcgcttcagattggagtttgagaagcatcgtggctttctggcccaggaggagcaacggcagctgaggcggctggaggcggaggagcgagcgacgctgcagagactgcgggagagcaagagccggctggtccagcagagcaaggccctgaaggagctggcggatgagctgcaggagaggtgccagcgcccggccctgggtctgctggaggtgaggccgggtgccagaaaagcaggcagatgtgagactcaggtgacagagactagtacaatggctttcagagacaaacactttggcgtttatgttctttaggaaaagggcaccctcaaatttactcagaaggcagcttaaacaccctagaatttactcagaagccattcctggcatcagaatcatgagattctagagaatcatatagtttgagtctggcatggtggcacatgcctgtagtcccagttattagggaggctgagacaggaggatcgcttgggccaaggaaatcgagaccttcctgggcaacatagcaagaccctgtctcaaaaaacaaacaaacagcatatagtttgttttaaggactaaagaattcttaaaattaatgatttctgaaaacttaaacagctagggaaaggacaagctacactctgctggctgagaagtaattcctaaaacctcagagtcagtttgtccatgatagcattgctgttttttagggatggctagcacagaaagtctgcataatacatttcagtgtcactggccagaaggatgaataatgatttaaattgtccagcttgaaattgttatattggattgtaaagcaaacactgatttcctggcccacattgcatgcccgttccaggcatggcgaggagggattacgtggactcccgtgcagcttcctcccagtctgtttgggattagagagcagaaagacgagtaagagtgaaaggaaatctttgtttttaatcctctgtgaggcatcatatcccaagtgaacagggaaagccaaagttgttgatagatccatgttttcttggtagaaccaatggcaacagaaatttatctggaccgactcctatctcctccccagtgactcacgcaggggattctaaactaagtgatgcatgttctcatttaaaagctgacccacggattccaccttttctgactcagttctaggcactgaaagtaccatgaatataaataatcctattaactgtctgtataatatttgcaagtacaatgactaaacaggactgattatgaggcaggggaccattagatgaatttataaagccatttaatttgtctcattttatcttatatatattaaatttatattttattattattgctatgttcatttccttgttagcaaactaagagtcagaaaggaattaattttccaaatagcagagagcaaaatacaagaactttgacggtttcttttcttttgtttttttgagacagagtctcgctctgttgcccaggctgagtgcagggtgcagtggtgtgatcttggctcactgcaacctctgtctccttggctcaagcgattctcctgcctcagcctcctgagtagctgggattacaggcatgtgccaccgcacctggctaatttttttttttgcgtttttactagagatggggttttgccatgttggccaggctggtcttgaactcctaaccttaggtgatccgcccactttggcctcccaaagtgttgggattaaaggcgtgagcccctgtgcccggcttgacaatttcaacaatagtatttattgctctgcctgccttggcctcccagagtgctgggattgtaggcatgagccaccccgcctggcatgggaggatatattcttaaataaggtatcttatctatctatttttctaaaagggcaggatctcactctgtcactcacgctggagtgcagtggctcaatcatagctcactgcagcctcagtctcctaggatcaggtgatccttgtgcctcagcctcccgagtagctgggactaaaggtgtgcaccaccacgcccagctaatttaaaacaaatttttagtagagatgaggcttggttgtgttgcccaggctgtatatttttatactttcctttccctttcttccctggtactaataagctacattttacccctgaaggccaagaccaaggcctgacattcccatacagggtaaagcaaattattcccctgcttttatgtcattaaaacttatctgactggcaactgtttttaaggggagaggggaaatgtatcccaaatacaattattaatataataaatgtatcacagatatatttatttaataatctactttgagaaaataatgttactagttattaaaggcttcctttattaatctatttagataacctcctcataggaatagctctggtacgttggttcagagaattaggaatttataattcctataaagatatttagggaaacattttgtgtctttatttgaggaacctatccatgcccctcaaataaattctatgagtacttaggatctattttatcctgttccgtctgaattacatgcagaatgttactctgttacaatatccaagtagcagaattattaattcagaagataattaaattgataggtgttgcaggaattaacctaaactttgtatagctttaaagaaaagagatttgtctgagtgtggtgactcacgcctgtaatcccagcactttgggaggctgaggtgggtggatcacctgaggtcaggagttcgagaccagcctggccaacatggtgaaaccccatctctactgaaaatacaaaaaaataaaaaaaattagccaggcgtggtggcgggagcctgtaatcccagctacttgggaggctgaggcagggaggtggaggtcgcagtgagccgagattgcgccattgcactccagcagcctgggcaacaagaacgaaactccatctcaaaaaaaaaatagaaaagagatttattgtcccctataattttatctcaataatgttttgcagtagtttctaaggaaatttttatggggtcttcagtctgactgtgaaaagcagttcagagtccaactcacactgtgtttttctttccttttcagggtgtgagaggagtcctgagcaggtatgtgtgctttctgaattggtgaagggattgggagaggcagaggagctggtggagaaccctgctgacttctgtggtttctgtgctcttcccagaagtaaggctgtcacaaggctggaagcagagaacatccccatggaactgaagacagcatgctgcatccctgggaggagggagctcttaaggaagttccaaggtagttgcatcttagagactgggaattaggctgcctggggtttgaagaagttccaaggtagttgcatcttagagactgggaatgaggctgcctggggtttgcctcgtattgtggtttgtcactatgccagtcagctgcagtgaccaacagaacctaaagtcttagtggcccagatcagcagaaatttattttgagagtgtgctgttggtttgttcctaggtgtggggacttctgtgccacatcttctcactctggtacccatactgacagagctctacctccctcttggtgctgggagccatagaaaagggcagggttattgaagagatgggggaagaagttctcttccagagtcaatacaacacatcacttctggtcaccaaaatgtgtggggatttctctccgcaaacagccaatcagttctccagcagatactccagccagatgtccttccatgcaatttgattttgacactatctatctggagatagcaccaggttccccgggttgagggctttgtcccacaagactgaccccacttcagatgctggtcacaagcacaggttgtggtctgtgattctgaccaactgactgtaaactggggttcccacaaccctcttcttgagttcacttaatttcctgaaacagctgacaaaacttagggacacatatttactcatttattataagggcgttacagaggctagagatgaacagatggaagagattcttagggcgaggtttgtgagaaggggtacggagcttccacgccctttctaggcctgctacctttggaacctccgtgtgttcagtgatctggaagtcctcaggactcagttcttttttttgtgtgtgtgatgaagtcttactctgtcgcccaggctggagtgcagtggcgccatctcagctcactgcaacctccacctcccatgttcgagcgattctcctgcctcagcctcccgagtagctgggattacaggcacatgccaccatgcctggctaatttttatatttttagtagagacggggtctcaccatgttagccaggctggtctcgaactcctgacctcaaatgatctgcctgcctcggcctcctaaagtgctgagatgacaggcgtgagccactgtgcctggccaatgaactcagttattttgggtttttatggaagcactatgtagacgtgattgattagatcataggccattggtttaccaacccacccttaagcccctctccctcttcagaggtgggggggggtgaggcgtgaaggactgaaagtttcaagcctctaatcacatggttggttcccctggcaaccacacccagtgggaggctttctgggtaatcaccaaccacaattcatcttattagcttacaaaagacactcttgtatttctggaaatttcaaggattttaagaactgtatgtcagtaaacaggatatagaccaaatacacacttcacagtatcataggcatggtgaatgtagaccaaatatatacttcccagtgtcataggtatggtgcctcctgcactgtagaccaaatacgtacttcacagtatcataggcatggtgactcatgcactcctcttaaaggtacccatgctgaattagagcatctggccttcctgagatttcatggctaagtcaaactatcaaggagacagtgtagggggcaagggaaaactttcccctttccctatgaatgtttgctgaaaatcaactgaccaaagacaaataggaacaaaggcatagaaaaagtctaacattcatagcacagtggaatcgcaggagagtaatgacccaataacgcagtgggatacagatgcttatatacctttctttattggaggaaagggagatggggaggtgtggatgattttagggagatagtaaatgattttttggaggattcattgggcttggagtgcatacagtggcttgggacaaagtgttgaaaagtagacagtggtttgtgactaaagtctgtccaggtgtattgatagacttgtctgtcttcctgcaatatgagctaaattaattaaaatgcagggacttcaggcagataaatgagtgttagaataaagcttcttacagtgtgtgatggtctccaagggcctttaatttaaaataatgggcataccagggtgccatattttagggtaaaattccctggtctccttccgtgggagagtgcaccatgcccagaaaaattaggattggtatattcatgagcagtatcagagtcacggccacccatagagcctgcaccaccatgcccagaagaacgaggattagtatattcatgagcagtatcagagtcacggccacccatagagcctgcaccaccacgcccagaagaacgaggattagtatattcatgagcagtatcagagtcacggccacccatagagcctgcaccaccacacccagaagaacgaggattagtatattcatgagcagtatcagagtcacggccacccatagagcctgcaccaccacgcccagaagaacgaggattagtatattcatgagcagtatcagagtcacggccacccatagagcctgcaccaccacgcccagaagaacgaggattagtatattcatgagcagtatcagagtcacggccacccgtagagcctgcaccaccacgcccagaagaacgaggattagtatattcatgagcagtatcagagtcacggccacccgtagagcctgcaccaccacgcccagaagaacgaggattagtatattcatgagcagtatcagagtcatggccacccatagagcctgcaccaccacgcccagaagaacgaggattagtatattcatgagccgtatcagagtcacggccacccatagagcctgcaccaccacgcccagaagaacgaggattagtatattcatgagccgtatcagagtcacggccacccatagagcctgcaccaccacgcccagaagaacgaggattagtatattcatgagcagtatcagagtcacggccacccatagagtctacatttggttagactatgggcttaaaactgtaggtcatctcttattagctgatatgagtaacgttacttccagtaaatttacatttccttgcttataaaatgctaaaaataaattgcttggaggacaaaatgaaacatttgaaagcaccccacctcctaaaagtaatcaatatgaaagcactgcaaagttatcaattagcaagaagtttggtttaatttattggctgagaatttgatgagttgcttgaattagtgagtcaataaagccaaaaatattgtcagttattttcatgtaggaataagcagtgtcacaaaaaattagtgtgtttagtctgattgtattattctttaaaacagtatagattcagtattgtttacaatttcattttaaaatctaatttatcccaagtaatgaaaactatgtctaaatagtgacttcactacttagagggaaagagtgtaaagtcccttaatgagaaaacccatctctgcagcatagtacccacgttctcctgggtagatgaatgtatgctaaatgcccaacttgattaaaatcgtcatggcaccctcagactcagcaacctcatatccatatttgtttttatggaatgaaatcattcaaaatgtgtgattaattttatctcacccattcttttaaacattggaatatatcattcaacaacaacaacaaaatactctacaatccgtagctttgtgttgcagatatgtacttcaccaaaatacacaggctgtaagtggctgacacagaatattgaagaaaatcaaaaagagtatgcaaagggtaatgagaagttctagttttgaataaggtgaccaggaaagaccccgccctgcaggggataacccagcaaatatatgatctggaagaaagcattcaggcagcagaaatgagcgccaaggcctgacgtggaggatggcaggtgtgttccaggagctgtgaggatgtcagtgtgaggactctgtggcagagtaaatgacaggagggtcggagagaccaagaaagggctagataggcaggccatgctgagcatgatactttatccctgagcgaaataggacatagttgaaagttgtacctagaaaaatagtttgattggactaatgttttatgaggatcactctatatgctttcttgtaagtaaattacagagaggagaagattgacatgggaaaagcagttaagggtctttgcagtaatttgatgagagatgattatgtgttggaatagatgttattacggaaggtgccgcaagatggacagatttttgttatatactgaaggcagagctgttaagatttgctgttggattatatatgatgtgctataaacaggaagagccatgaatgattccaaggttttggatcttgcgaactggcaaaatgtgattgccacttatattgatgaggaaagcgacagttgaagcagaagaagggcacagggttttggatatgtggatgttgcgatgagtgctaaatattcaaatgttgctatcaagtgggcagatgaatgtacaatagggagtttcagggtaaagttcaaagctaagcacatgcattgggaatcagtcagcatatgaatggaattttatcaaagcaatgaaccagccagcacccgggtagatagggagtgaggtgagagagagagaagaagtccaagtcttgggactataggtttctccagtggtggtggtggaggagaagagaacagcaaagaggatcaaggagtagtgagcagtgagggaagggaaacatggatgagtgttacctttggaaaagggagattttccagcacaagtagattctcagtgttgagagatacagaaaaatcattgaagatgaactctgggccgggcgcggtggctcacgcctgtaaatccctgcactttgggaggccgaggcgggcagatcacctgaggtcaggagttcgagaccagcctgatcaacctgaggaaaccttgtctctactaaaaatacaaaattagccaggcgtggtggtgcatgcctgtaatcccagctactcgggaggctgaggcaggagaatcacttgaacccgggagatgggggttgcagtaagccaagatcatgccattgaactccagcctgggcaacaagagcaaaactccatcttaaaaaaaagacaaactgacaagtaaccattcatcaacacggaggtccctgggaagatggacatgcgcagtttggttggggtatggtcacatcatgatgaagaattgagtttaggagagaaggggtagggagaggaatgggatacagaccatatcaaaagccatttcacagatctcttttgttagaaatgaagcagaccactgtgccggaagaggaatggcttgggaatacatgacctgttagattgtgttaaatgcacaatccatggagacctacctttcaatctctgttatttacctctagagtttgggaagaccacataaactctttgactctgaatctactcttgtgtaatgtagggatgacaatggtgaccctcagggtggttacataataaaaataatgcaatgcgcagttacgtgaccactcaggttgggtatcaataaaaattcactagaccgggcgtggcagctcacgcctgtaatcccaacattttgggaggctgaggcggatggattgcttgaacccaggagttcgagaccagcctgggcaacatggcaaaaccccttctctacaaaaaaatacagaaaactagctgggcatggtggtgtgtgccttcccagctactcagagggctgaggtcaggggatggcttgagtctgagaggtggaggctgcagtgagctgtgattgcaccactgcactccagactgggcaacagagcgagactccgtttcaaaaaaaaaagtagttcactgtaagtgtttaaaggcaaataagtatagtggtagtggtagtagcagtagcagtagcagtagcagtagaaacagtatttgttctgatattaaaaatcaaactatattaacatgttagtctgattttgcattgctataaagaaatacctgaggctgggtaatttattaatataaggaaatatgctttattttggctcatggttctgtaggctgtacaggagtcatggtgctggcacctgtttctggtgaggcctcaggacacctacagtcatggtggaaagcaaaggaggagccagcgtatcacatggcaagagggaagcagtgaagtggggaggccccaggttcctcttaaacgaccagctcttgcatgaacggataaagaactcacttatcaccagtgggatggcactaagtcattcatgggggatctgcacccatgatccagcaccccccactaggccccaccttcaacattgggaatcacatttcaacatgagaccgggaggcgatacacatccaaaccatattatttattaacttactacttataagcaatgctaataaggaaatgcactgaatattttacatccccccttcactgaggtttcatatctagatgtatttatttattatgtatatgggtcaaatgtctcatcaatctcactgggacttcagagtatcagtattttttattgttatataacgcataactacaagcttatgtgcttaaagccataccatttagtagctcatggttctgaagaccagacatccaagtgggatcagctggctcctctgcttaggttttctcaaggcccaaatatgggtgttggccaggccaggccaggcttctgtgtaggtcgggggaagaaccttacctccaaccttattcaggttgttggcataatacaattctgtgcaaatgcggtactgagattcctgttttcttgctggctgttggttgggggctattctcagctctggagatcactctcagctctagaggtcactcgtttgtctcttcatgtgacctttccattttcaaagccagcaaagagatatcaaatccacatcttattgacctttcctgctgccaccaacccaatagccagagaaaactttctgattttacaggacttgtgggatttgattagacgcaccttgataatctctctcttgtcatatagtgtaacatactcatgaggctaacaccagggtgtgaaggtcatggggtccatcttagaattccgcctaccacagtaatataactttggaagtagtggatttaatattaataaaattctatagatttttaagaaaaaaattcctaaggggtttataaattttatgttaaatgcagaagatcctcctaagtgcactcaaatgctttggatgtaagccagacatggtggtgtgcacctgtagtcccagctgctggggaggcagacacgggaggattgcttgagtccaggagtttgaggctgtagtgtaccacggctatgcccatgaatagctctgcactccagcctgggcaacatagcaagaccccgtctctctgtctctctctctctctctcacgcacacacacacacacaaatgctttagatgtaaatgaaaggaaactaaatgataattcacttggtttgtcgtcatcaatagttgtttttttttgggaaagttaaagagttctgggttacgcagaggtaacagtggaatataccagaaagttataaagaataagaataataaagtaataaagaagatttcacctgtaaggtgaaatactgatttgttttctctaggagttaatagagagagaaaagtgaggaactgtgggactattcttttcagtggtttcctaagtttctaccagtcctttctttcctttcacctggtccaccacattctttccgcagtggatgtaaagctggatcccgccacggcgcacccgagtctgctcttgaccgccgacctgcgcagtgtgcaggatggagaaccatggagggatgtccccaacaaccctgagcgatttgacacatggccctgcatcctgggtttgcagagcttctcatcagggaggcattactgggaggttctggtgggagaaggagcagagtggggtttaggggtctgtcaagacacactgccaagaaagggggaaaccacgccatctcctgagaatggggtctgggccctgtggctgctgaaagggaatgagtacatggtccttgcctccccatcagtgcctcttctccaactggaaagtcctcgctgcattgggattttcttggactatgaagccggtgaaatttcattctacaatgtcacagatggatcttatatctacacattcaaccaactcttctctggtcttcttcggccttactttttcatctgtgatgcaactcctcttatcttgccacccacaacaatagcagggtcaggaaattgggcatccagggatcatttagatcctgcttctgatgtaagagatgatcatctctaaaattctgttcccaagatgcagtcctagcgtagcgaacgttcctggagtggggtgaaggatatcaatatactaagttttaacagataccccatttaggtcagcacttgattcgttgttgctgtgaaatatgtccatgggacaaaagagggaatatgaaatatttgcatatgggaagattatagagcataataattttgtaaatggagcaatctcaacctctatttctagatcacattttcttgatgtcttccttcaaattaatgaccttggattacataaggatttctatgcattcattataatttgttattcctttcaatatccttgtatttcaaatcttccatataagaattagacatggcaattcttaaattgattcagaatggtctgatactattccagtatcacctccttaattctgtttctcctcgttttcctgattttccttctcattctctccttccccgctctgtctctctctccctgtcactctctctctcttgttccttattttttgtttcttacctcttactgtttaacctgttgcttccttctggattaatacatttagagccattcctttatatggtcacatttcctatgactttactcaattacttttaaaatcctttctattctgagactaatttttaagaattacaaagctcattcttctgaatctaatatcactaactcctagactttttccgttttctttggatacactttaagtaggaatttatcagaattttcattcaactcgttctttaatgcagatatttactagttataagaccttaaggctgggtgcagtggctcacgcctgtaatcccagcactttgggaggctgaggcgggtggatcacaagctcaggagttcaagaccagcctggccaacatggtgaaaccctgtctctactaaaaaaaaaaaaaaaatagaaaaattagctgggcatggtggcaggagcctgtaatcccagctattctggaggtggagacaggagaattgcttgaaccctggaggcggaggttgcagtgagccaatatctcaccactgtactccagcccagtgcgagactccatctcaaaaaagaaaaaagacctcaaacaacacttctctctctcttttagctgcttgttatggttcctatacatggaacaattatactggcctcactgtgttatggtaaatatttaaggtcatatttgatattgctggtttgaattcagcttttccatttaaatacattataatgatgatgatgaaatcatgataatatttaacttatttttaaagtatattctgtacctttccaacaaaaaggttaaaagtcattgaaggctaaccttactgccttctttgtatcactgtcttctaaataattattatgtctgggtacagtggctcacgcctgtaatcccagcactttgggaggccgaggtgggcagatcacgaggtcaggagattgagaccatcctggctaacacagtgaaaccccgtctctactaaaaatacaaaaagaaattagctgggcgtggtggtgggtgcctgttgtcccagctacttgggaggctgaggcaggagaatggcatgaacccaggaggcagagcttgtagtgagccgagatcgcgccactgcactccagccggggcaacagagcaagactccatctcaaaaataaataaataaataaataaataaataaataaataaataaatattacacaaatgctaaaatgtttaaatggtaaatgcttcaatgctaaccaaatattaattaatggcaaattatttaacattatctgataataatctgcagaaggtttaattttcctcctcaatttgaagttcaagatgtttttctcttccagggagattttttcgactgacatctttaacttaccttccaatcatattactaacgtagccttcttcctagattttttaattgtttgatcatgagcgaacacttctactctctgtgatagatttgcaaacagaggaaataacgcatcctcgtgtccctcttcttggtgttccacaggccatgtgtgccctagccctcgttcatgcaaggtctgtgtagggaaggtggacttcagctcagcaacagcatcccttcccacagggatcaggtgggtggcttgagataccccttccatggggcaccacccattcagtgagacggggaagccctgggtgggagggagaacacctccacatgtcttctactctctccataggatggaatgagtgtcccagtcccaggagtatccatttcccactgtgtagcccagtactctggtctcactgtctctgctgaatcctgtctcactgtgcatattattgtggtttatatcagtcagtaaaccaatgtgagtcttcatctcttgcattcttaggttcatagttttgtgtgtctcctgtaatgactcttctctttccctttccaactcctgaaagattgccactatttcctctggaactttgtttcgttaccagcaaaatcctcgacatccatacccgtttcctggctttccctctcctttcctctgaatggtagtcttttatattcagctgtccacttgacatcaaaatagacattttgaactcaatttgcctaaaacttacccacaaatttctccccaagtctctccctaactgcaacaacaaaaaccacaggcttctccctgtcactggatggcaactccattcttttgattgcttaagccaggcatccgattgagtactttcttgatttctccagcccacatccagtccatcggcaagccctgttggtcctaccttcagaatatgtccggggttcagttgtcctggccaccctgctgctgtaaccatggtcagaactccatcctgcccctctggattatgactttcgtttcctcacagtggtcctgcttgggctctaggcccttccactcccattctctctacagcagctgggctgattcctttagcacccaaggatatgttggcatcacagtgacttagataccatcacaaagacctcccattcaacttagagtgaaagtcagaatcctcacagtgaatccccaggccctagaggatgtgaacccccaggccctagaggatctgaacccccatccctcctctgattatctctcccacccccacttccctttgcattctgctccagctgccctggcctcatggctgggtttccaccaaagcaggcacttcccatcacagggccatttccccgcctgtggcttctgcttgacattcccttttccctgatatccccttgactcattattccctttcttccttaactcttctgagatccagcttctcagtgataccacacagccctactccccccagagcccatctagagctcacctttccagtcgcccttgccaggctcagtggaggctctttgttccccatacagtacgtgtcgtcgtactatattgttaggcttatttaatttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagagcaaaattgatggacctgaaaatgttttgcaaaatgtaatatagtctactgatacaatatttattattattggccaataatgtttaatgccaagtgctaaattagtaaaattttggggatatagagaaaaattgagcagaagtcttaagtttgtaaacataatggattttgtgacctgataacttggcatgtccaggcctagtcccattgagccccctgtggttttgattccctgtgacatcacagtgacacctttgaattatgctttgtctcatactccataagccacctctcaaaatggtatcatcactaaaaatatggggaactttctataaacttacatagactacaacctttaaaaaaaaaaattgatgttaatgttttatgttgcctttcttcacctaaacgatatggtgcatccacgccatccagaaatggagtgtcttgggtctgctgtccttcccgtcgcttccctgttactgtgcatttctgttatatacatttggcattttttctatctcaaatcataattttttttctttctgacatatccttaaggactgctctgacagttaccagtgaaattctttcgttctctataaaaatttgaacatcaactctggtagagcacagtggctcatgcctgtaatcccaacacttggggagactgcggtgggaggattgctcgagaccagaagtttgagaccagctgggcaacaaagcaagacctggttcctacaaaaaaaatacaaattagccagatatggtggtgcaaacctgtagtcccagccacttggaaggctgaggcgggaagatggcttgagcccaggatttcaagtctgcagtgagccaggatcacgccactgcactctggcctgagtgacagagtgagaccctctcccttaaaaaatagaaaactaaaagagaaagtcaatccccaacatgagcttctagccttttctaagctataaccctccagaactatgtctacatatccagaagtgtggataatttattcaaagaagtaatttgcttaataccccccgatatggtttggctttgtgcccccacccaaatctcatgctcagttataatccccagtgttggaggtgggcctggtgggaggtgattggatcatgggggcagtttctcatggtctaacaccatcccccttggataagttgtgaaatctggttgtttaaaagtgtgtggctctgcaactttctcttgcccctgctcttgccacgcaagacaccagttcctgctttgccttctgccatgagtaaaagctccctgaggcctcctggaagcagatgctgccttgcttcctgcacggcctgtggaaccgtgagccaactaaacctgttttcttcataagttttccagtttcagatatttatagcagtgtgagaacaggccaacataccctcatgaccccttctccaaatcaggtgactggtttatcaatttactaagctttttttttttgagatggagtctcactctgtcactcaggctggagtacagtggcatgatcttggctcactgtaagctttgcctcccgggttcaagtgattctcctgcctcagcctcctgagtagctgggactacaggcgcccgccaccacacccagctaatttttgtgtttttagtagagacggggtttcgccatgttggccaggctagtggtcttgaactcctgacctcaggtgatccgcctgcctcagcctcccaaagtgctgggattacaggtgtgggccactgcacccggccttagactaatttttctagcatgttgagaaggccctgagtgaagaggactgggaggaggggatacagggagcaatcaggagtgggaagtgaaataacctctttagccagcaaaagtaatggaaagcacttagagtggtgattgcaacccctagaaccccagaacgcagagaattgggaacactgggatctgttcaacctgtctgccctccaagcactgactccttggtacttgctttctctgtgctgctggggccccctgtggtctgcttttctatcacacagggaggaagaaaggacgtcagggcctgcgtatgtgtaccacacatattctatgaattctacaccatgtagaatagtctctttactctctaattctctgactacatctacccaaaagtacccagtcatattgataagtttcttagttaattgactctaagtctgattttttttctgacattgcttggctatttctgtatatttattttctttaaaaaattcagcattgcgatgtcatttttgcctttataagagcattgaaaacatagttacatatacatacctaagtcatgatacttgctcaatttccttatcagtttttgaaactataaacctatgtatgctaacatcttcctttcaaaccaaaaagtaaaaataaggctgggcgcagtggctcacacctgtaatcccagcactttgggaggccaacgggcgtggatcacctgaggtcaggggttcaagaccagcctggccaacatggtaaaacctcatctctactaaaaatacaaaaattagccaggcgtgatggcgggtgcctataatcccaggtactagggaggctgaggcaggagaattgcttgaacctggggggatggaggttgcaagtcacagtgagcagagattgcaccacttcactccagcctgggcaaaagagcaaaactccgtctcaaaataaataaataaataaaaatagaacaggccatgctgtagctccttaatgtaataatacactttatgtgatttttttcactatgtaggacaatgggttctttctctttcatacacaaaaatattagtaaaaagaagatgtcaaaatattttggccctattttcagcagataaaacgagagagaaaaaacaaaatgcatgattctgttctaggtagcatgggaccaattatgcctcagctgttttcttagccgtataatgattgttgggaacaggggaggggagcaaatggctcattggtatttatggttttagaacagcaatgaattgagtcccctaattttacttatgtgaggtagtaaattctttttatatcaagggacaaattctcatggtgctcattttctctctggacctgacgggagattgggcaatttgatgtggtgcgcgcctctgcctcagtggatgtgctggtgatccctgtgggtctgaagtttccccagcgctttgggctgctgatgaacccaggctgccatcagggtccgtctccagtcttccctcagcggagctgcaacactgcgtaattgcaagaaacccctgttcaccaatactgtgggccattgcatttataaggaatgggccaagcctgagagaggcacttggatttccttacgcctggctacagcacctgtgtgcgcccaagagggtagaaggcatttcgtgacctggctgaggccctctcgctatgtctgtgttcctgcattctttcagtgttgcctagcagcatgcaagtgaaaatggtgagcaggtttctggattgaggaactcagctcagaggtctgcacgtctaggttggtttgttaaatgaataagtcatagggagtgcctcaagggttaaaaaaatctgaagaacatactccttgctcttagaacatttataaattatgacaggccgggcgtggcggctcacgactgtaatcccagcactttgggaggccgaggcgggcggatcacgaggtcaggagatcgagaccatcctggctaacacggtgaaaccccgtctctactaaaaatacaaaaaaattagccgggcatggtggtgggcgcctgtagtcccagctacttgggaggctgaggcaggagaatggcgtgaacccgggaggcagagcttgcagtgagccgagatcgcgcccctgcactccagcctgggcgacagagcgaaactcagtctcaaaaaaaaaaaaaaaattatgacagacacaccaacacacaaagacatacacagacagcacttatatcacaagtcgtttaattataacaaagcactacatctaccaatgcaaaattattattattactattattattattattatgtttgagacagtgtttcgctctgtctcccgggctggtgtacaatggggtggtctcggctcactataacctccgcctctcgggtgctagtgattctcctgcctcagcctcccgagtagctgggattacaggcatacgccaccacgcacgactaatttcttttttttttgtatttttagtagagatggggttttccatgttggtcaggctgacctcgaactcccaacctcaggtgatccacctgcctcagcctcccaaagtgctgggattacaggcgtgagccaccgtgcccgttctaatgagagtcttctttaacctccacttcactttctaaaagtgagtctctttttggcgggggtcggggaggacagggtctcactctgtcgcccaggctgaggtgccagtggcatgatcacagctcactgcagcctcgacctcctgggcccattgacccccgtacctcagtctcttgagtagctgggaccacacctttgtgcgaccgtgccgggctaaggtttaattttgacttttgtacagatggtgtctccccatgttgcccaagctagaaatgagccttttcaacaatttcaaaccgtacgtccagatatcagttctgtttgaatacaaatacagtcatgcgttgcttaacgatggggatgtgttctgagaaaggcgtcgttaggtgatgttgtcgttgtgtgagcatcacagcatgtacttacacaaacccagatggtgtatcctaccacaatcctgggccataagtgtctgggatagcttgtcactcctaggctacagacgagtacagcatggtactgtagtgaatactgaagacagctgtcactccgtggtaagtatatgtgtatctaaatatagaaaaggcacagtaaaaatactgtataaaatacagaaaatggtaacctgtctagggcatttaccatgaatggagcttgcaggactggaagttgctctgggtgagtcagtgagtgggtggtgactgaatgtgaagagccaggacagtcgtgtacatgactacagactttatcaactttgtacacttagtctatattaaatgcattaaaaagtatttttctttcttcaattagaaactatccttagtttatggaaacatttttacattgtaaaccttttactttttattaactttgtgactttttttgtaatagcacttagcttaaaacacacattgtaaaactgtattaaatacttcctttttattcttattctacaagttatattctatttttttttttttttcacttttcaaactttttcattgcaaactaagacacaagcaaacacattagcctgggtgtccactgagacagaatgatcagtaccactgtcttccacctctacaccttgtcccactggaaggatttccggggcagccacatgcatggagctgtcacctcctatgatcacaatgccttctacgatactgcctgaaggacctgcctcagactcctcttgaggaggtgaaaccaccacagatgtaatttgttgttgaccaaaatgtgttgttctgcaacatgtgcctgtatacatatatacgtaccgtgtgtatttgtgtttgtatagtgagagtttgtgaacaaaaaatggagtcacactacatataatctcactatacattatatttagctttctttctttttttttttgttttttgagatggagtctcgctccgtcaccaggctggagtgcagtggtgcgatcttgcctcactgcaacctccgcctcccgggttcaagcgattctcctgcctcagcctcctaagtagctggggttacaagcatgtgccaccatgcctggctaatttttgtatattttagtagagatggggtttcaccatcctggccaggctggtctcgaactcctgacctcgtgatccaccctcctcagcctcccaaagtgctgggattacaggcgtgaggcaccgcacccagtatagttagctttctacttgtttgatattaatatcttttttttggacaaaattctgggtaatgtcattccaatttagtgattgtttccagtcgtctattaaatcatgtctatcactttaacataccttgtttcccagtattatctatttcagtagatgctataatgaagtttttgagagtatgtgtttactgattgagggttaataaatgcaaagcagattcctagatgtggaattaacagggcaatgagaaaagcatgtcatttaacattttatgaaagacagatatttcttttgttaaaataatatgtactatgtcaaggtatatgtgtatttaaatagtcatttttttaagatctctccaaagatactatttcaattttgactcttatcaagagttcatgaggccaggcatgatggctcatacctgtaatcctggcactttgggagtccaagatgggtggatcgcttgagatcaggagttcaagaccagcctgggcaacatggcaaaaccccatctcaactaaatatacaaaaattagctgggtgtggtggcacatgcctgtaatctcagctacttgggaggctgaggcaggagaacctgggaggatgaggctgcagtgagcccagatcacaccactgcactccagcctgagtgatacagtgagactctgtctcaaaaaaaaaaaaaaaagtttatgagattggacttatttcccacattttttcaagctctggatattaccacacttttcactatttacctatctggaaaagcaaatatctttatatttaaatttttataacctcaatcatcagtgaaaacatttctaatgtttatatcacttgcttgtaaatcatgcattttcctgtgaactgtttcttcaagtcattacatatttttcttttactacaggtttttcttgccacttttttgagaaaaaaattaagtaaggtagccttcagttgtcttgttgaatttttctactattgttattattttttagactttgctagtagtgtttctttttgttttgttttgttttgtttttgagacagagtcttactctgtcacccaagctggagtgcagtgacacgatctcggctcactgcaacctccgcctcccgggttcacgctattcttctgcctcaacctcccgagtagctgggattacaggtgtgcaccaccacacctatgtaatttttgtatgtttagtagagaagggctttcactgtgttggccaggctagttgtgaactcctgacctcaggtgatccacccaccttggcctcccaaagggctgggattacaggcatgagccaccgcacctggccaaaagtgtttcttagagtgtaaatttttctaaataggtaatacaatttatctatgttttgctttttaactttcgagaattgcaacttggcttatgatgtatacttattcaagataattgggaaaaaaaggaaaaataactgtcatgctttctgattgtagttgtattttttaaatgtttaaatatataatttgtaattttatatttttggtgtaggtaataaagaagcgacccacactcccttcctcccacaaatgccttgtcagttatcatgatgtagttattgtattttgaaagcttgattagatataagatagtttctcttcagtaggctttttttcttctggatttctctggctagacttatgggcttgtgtttctgttctgtgtttgcatgacacttcacctttttttgtaacatatgtagaaaccttgacactcactgaacttgtatatgttttatatatttatatttcacattaaaaactctcaaagcatagctgtaaactaagtaaggtaggtttgattattaccattttagatgagaaaactgtgaaaagacaaatgagcttgctgacatcttgtaatttagtcttgttggcatagggataatgcagagtagtttggagctgtagcccaaaatgtatgcatgtatttatttatttatatatttatttattttttaacaaagaaaaaatgtatttattgagcattcactacaaaaactagtttttctgtaggcagagatcttaatgattttttttaattaatttatttattttttctttttttatttattttttaattatactttaagttttagggtacatgtgcacattgtgcaggttagttacatatgtatacatgtgccatgctggtgcgctgcacccactaactcgtcatctagcattaggtatatctcccaatgctatccctcctccctcccccctccccaccacagtccccagagtgtgatattccccttcctgtgtccatgtgatctcattgttcaattcccatctatgagtgagaatatgtggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttagttccaagtctttgctattgtgaataatgccgcaataaacatacgtgtgcatgtgtctttatagaagcatgatttatagtcctttgtgtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgttttcttttgagaagtgtctgttcatgtccttcgcccactttttgatggggttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaaaggatccagtttcagctttctacatatggctagccagttttcccagcaccatttattaaaaagggaatcctttccccattccttgtttttctcaggtttgtcaaagatcagatagttgtaggtaagcggcgttatttctgagggctctgttctgttccgttgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagtagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctaattgccctggccagaacttccaacactatgttgaataggagtggtgatagagggcatccctgtcttgtgccagttttcaaagggaatgcttccagtttttgcccattcagtatgatattggctgtggctttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctcgattacatttattgatttgcgtatattgaaccagccttgcatcccagggatgaagcccacttgatcatggtggataagctttttaatgtgctgctggattcagtttgccagtattttattgaggatttttgcatcaatgttcatcaaggatattggtctaaaattctcttttttggttgtgtctctgcctggctttggtatcagaatgatgctggcctcatacaatgagttagggaggattccctctttttctattgattggattagtttcagaaggaatggtaccagttcctccttgtacctctggtagaattcagctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccatttatcattttttattgtgtctatttgattcttctctctttttttctttattagtcttgctagcggtctatcaattttgttgatcctttcaaaaaaccagctcctggattcattgattttttgaagggttttttgtgtctgtatttccttcagttctgctctgattttagttatttcttgccttctgctagcttttgaatgtgtttgctgttgcttttctagttcttttaattgtgatgttagggtgtcaattttggatctttcctgctttctcttgtgggcatttagtgctataaatttccctctacacactgctttgaatgcgtcccagagattctggtatgttgtgtcattgttcttgttggtttcaaagaacatctttatttctgccttctttttgttatgtacccagtagtcattcaggagcaggttgttcagtttccatgtagttgagcggctttgagtgagattcttaatcctgagttctagtttgattgcactgtggtctgagagatagtttgttacaatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgtgttcaattcctgggtatccttgttgactttctgtctcgttgatctgtctaatgttgacagtagggtgttaaagtctcccattattaatgtgtgggagtctaagtctctttgtaggtcactcaggacttgctttatgaatctgggtgctcctgtattgggtgcatatatatttaggatagttagctcctcttgttgaattgatcctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactttttatccaacttgccagtctgtgtcttttaattggagaatttagtccatttacatttaaggttaatattgtaatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcacttccttcaggagctcttttggggcaggcctggtggtgacaaaatctctcagcgtttgcttgtctgtaaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcgttctctgtatttcctgaatctgaacgttggcctgccttgctatattggggaagttctcctggataatatcctgcagactgttttccaacttgattccattctccgcatcactttcaggtacaccaatcagacgtagatttggtcttttcacatagtcccatatttcttggaggctttgctcatttctttttattcttttttctctaaacttcccttctcgcttcatttcatttatttcatcttccattgctgataccctttcttccagttgatcgcatcggcacctgaggcttctgcattcttcatgtagttctcgagccttggttttcagctccttcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcaatctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttccaggctgctttgtttacctaagcaagcctgggcaatggcgggcgcccctcccccagcctcgctgctgccttgcagtttgatctcagactgctgtgctagcaatcagcgagattgcatgggcgtaggaccctccgagccaggtgtgggatatagtctcgtggtgcgccgttttttaagccggtctgaaaagcgcaatattcgggtgggagtgacctgattttccaggtgcgtccgtcacccctttctttgactgggaaagggaactccctgaccccttgcgcttcccaggtgaggcaatgcctcgccctgcttcggcttgtgcacggtgcgcgcacccactggcctgcgcccactgtctggcactccctagtgagatgaacccggtacctcagatggaaatgcagaaatcacctgtcttctgcgtcgctcacgctgggagctgtagaccggagctgttcctattcggccatcttcgcatgtatttatttttatttgtcttagtttgggagtactgttttgttacctccacgtatggatttatattaatttgcgagtactgctttttacctgcacatacatgcttatatctatttatattaatttgggagtactgctttttacctgcacatacatacttatatctatttatattaatttgggagtactgctttttacctgcacatacatacttatatctatttatattaatttgggagtactgctttttacctgcacatacatgcttatatctatttatattaatttgggggtactgctttttagctgcatgtattgcacagtggcgaagtcttggcttttaatgcatccatcacccaaacaccaggatggaccaagtctccctatatccatctgtaagacttgtggtttgtcttatcaaatatgctttgctttgaatgtgatgtggtattagagttggaacgtgatagaggtttctgtacatatgcgtgaattttgcattacagttgtaatatctgttacaaagttttttcaatctcttttatcctctcaagcagtatatagtactttggaagaaaaacccatacactctatttgttcaataccaggcccatttaaaagacagagagaaaaaaagagattttatgtgtattttgcctgtctcttacattatttatctactgaggtaattttaaaattaaattaaattaaattctgaggtaatttaaaaattacctcagtaatggtaacccaatgaatgaggtgtgtctttgagaccagtaatagataaagtactctgtgtgtaaagagtatttcctaaatactattgatggattattttgaggctccattttgagtccttgaggtttttggcaggagcctagggactggagtctctagaaaaattcgtggtttggccacagcaggatttgccttcacttcactggatttggaggcagtgctactggtggtttagattgcacactctcagctacattgccggggttcagaatcagctctgtgtcttcctacatatcacagtttgctcaacacacatgtgtttcagtttccttttctataagttgggagctaataataatagtgcaactccatataactgttggggttgaatgaataaaataaatataaaaagcatagaagaatgcttagcttctagtaagttctcccttaatatcagctgttattattattattaggattgatatttctgttcagcagcagtagagatggatggaaccaatggcagcacccaaacccatttcatcctactgggattctctgaccgaccccatctggagaggatcctctttgtggtcatcctgatcgcgtacctcctgaccctcgtaggcaacaccaccatcatcctggtgtcccggctggacccccacctccacacccccatgtacttcttcctcgcccacctttccttcctggacctcagtttcaccaccagctccatcccccagctgctctacaaccttaatggatgtgacaagaccatcagctacatgggctgtgccatccagctcttcctgttcctgggtctgggtggtgtggagtgcctgcttctggctgtcatggcctatgaccggtgtgtggctatctgcaagcccctgcactacatggtgatcatgaaccccaggctctgccggggcttggtgtcagtgacctggggctgtggggtggccaactccttggccatgtctcctgtgaccctgcgcttaccccgctgtgggcaccacgaggtggaccacttcctgcgtgagatgcccgccctgatccggatggcctgcgtcagcactgtggccatcgaaggcaccgtctttgtcctggcggtgggtgttgtgctgtcccccttggtgtttatcctgctctcttacagctacattgtgagggctgtgttacaaattcggtcagcatcaggaaggcagaaggccttcggcacctgcggctcccatctcactgtggtctcccttttctatggaaacatcatctacatgtacatgcagccaggagccagttcttcccaggaccagggcatgttcctcatgctcttctacaacattgtcacccccctcctcaatcctctcatctacaccctcagaaacagagaggtgaagggggcactgggaaggttgcttctggggaagagagagctaggaaaggagtaaaggcatctccacctgacttcacttccatccagggccactggcagcatctggaacggctgaattccagctgatattagcccacgactcccaacttgcctttttctggacttttgtgaggctgtttcagttctgacattatgtgtttttgttgttgctcttaaaattgagacggggtctcactctgtcacctagggtagagtgcagtggtgccaccatagctccttcgactattgggcttaagcgatcctcccccacctcagccttccaagtaactgggactacaggtgtgcatcactggcagtgggaattgtggcttgtggcttttctgtcttctatggagacggggtcttgctgtgttgaccaggctggtcccaaactcctggcctcatgtgatccccctgccatggcctcctaaaagttctgggattacaagtgtgagtcactgcgactggccaacattatgtgatttatgtgtgaactatataacacaaatcatccccaaaacccatcatgatctgtaaagcagctgcaaagaatgaagtgagacaaacagttgtaaagatgagtttccacctacttataccagagtgctaagaggaaataactcttctcaatcagagctttgctttgtttgttgttgtttgctttaaagtctaacacacctgacatgtttcagtcagaatgaccccaaatgcatcactgttctccacgtggtccaagtgcctctctgtttagggccatcaaatcatggaatgcagcacagttttatattttctatattcccaattcctacccaaaccttttcatgaaatcgtagagtttgttttaccctttatctggtgtaagattctgcataaaccaagaagtgaacctgtaagttatgatgcatgggttgtttaaatcttaaagcatcattctttctcaggcatgtttttttcattattagtaagaagaacctgacattggtttagtcccttctgtgtaccagacgctcctaagtcatgcaacctcagtatttgtatgaggtcagcatgattatcattattcccattttatctccctggtccttgagatctgaaggttaaatcttttgctcgaggggaactgaaccagggttttttccaagttctgtcagactcccgattcatatggtttctattgcatcatgaaatttcaaagagcaaaaatccttaagcatttggcacacaatgtcaaagaccctttggggctaaggggcatgactggctactgttccttacacattgcagtcctcaatgtgtcccactaacgtgccctccagttatctgaggtcttgttccaatgcaattccaattcagctggtgataagaggggtctgagtttctgcgactctgcaaacctcccaggtgatgtccctactttggggactcggactacattttaagaacccaggaagtatatcaccccctgctcttgttccgggcatttggagggtggacacattctggaaaaagttgggagagtgttcatagaccaagggcgaacacaaggtgagagggagtggtgtgaaaggccagctgaggggtggtcctcattcctctgccgttgctcctgtgctcggctccctcctcctccacaagtgtatttctgcgctcttttgtatcctcctcacctccacacctcacatctaaagtcaccagccccagggcattgtgtaagtgtaaacaaaccagagccccagagagggggattcctgtgcttccagagcaccccctctgactattcaaggatgctgtttgtaagaagtactgatgtggatgtgtagtaggaagagccgcagacaaaactcctcagacaccgagttagagaaggaaggggtttattcgaccaggggcatcggcaagactcctgtctcaagagccgagctccccaagtgagcaattcccgtcccttttaagggctcacaactctaagggggtgcgcgtgagagggtcgtgatcgattgagcaagtagggggtacgtgactgggggctggtaattagatcggaacaaaacaggacagggattttcacagtgcttttctatacaatgtctgtaatctatagataacataaccgattatgtcaggggtcaatctttaactaccaggcccagggtgtggtgctgggctgtctgcttgtggatttgatatttgccttttagtttttactttttttttctttggaggcagaaattgggcataagacaatatgaggggtggtctactcccttattcccccctttgagagtctcactcaatagtgggagttctcactttcatttttactacccatgtcttctggcaagacagatcaatagtgattcatatagtacacttgtgctgaagcttttggtgaactaaggtagtgatgaagctttttatcatttgaagaagtacaggtagcaaacaaaggagcagtaagtaggttcctattactattataactcttattataagagttttaaatcctcctagctctgggaaccattttctaaacatggccccaggatcaaatccgtcacacttgcatgggcacgtgtgccagttttgtcatatctctaactatgtcttcaaatacttgcccttgattatctatgtgtaggcagcaattaataaggttaaatttcctacagacttctccttcagctgctagcaagtagtcaagagccaatctgttttgatagatagcatttctcatctgagtttcttgctgggtcagaatggtcaaggctctgccggttttattagtgattatttttaagacagcttgtaaccatatgatttggttgatcatgtacatgtgggtccggtatcctcatgagccgtcttgtacctaagtagcaggcccataatattgcacgattctcttagggggccatttatcattttttcaatttcttatagctatgcttctcttttcatgggaagcatagacagggaagcccaggagtttgcctgtttttatgggcggtaggaagaaagatggtttaatagtgccaataacacaactacctgcctactggtcaggtaatttggcataagctctatgcctacatatccagtataatccagtgggggccgtccagtcctggtgggactccaggtgggtccacacgatctgcaactttgggaatttatgaaatggatttctctctgtgtgatttgaactccaccaagtgactgtttttgtggtaccattatacagtttctgtctccgacaactaagtcatcctacagggtgagtaaattcttttccttccctagctatgcaatattgtccaataattgaggcgtttaggacctagaaattatcagggtgattcttttgagccgggaattcatcaggaactgggtctgtaggtactaattctcgggcttcccatggccattgatctcccattacagttcctccacatacataatgtgaagtgacattgagagactgggctacatgcttggctaattgcaaaaacaaatttcatgtttttcctggaatttctggtactggcacatttagttcatcatagaaagtttgaaacgctggctcaggagagcgtttgtaaacttctcctcgaaccaagatatttactcaaggatccagtccggccccgtcaattcctaaggtcacacgctcctctttttcccagcgaggttcaaggggcttggttattactagctctaaggggttacattgtcccttagtacaggaagggccattttttcctttctgaaggtggactggatccttctcattttttttttttatccaagtggcctaaaggacacaagaccagtgtttacatttatttccacacagccctaatttatgacagatgtacttattttctgccgtatagcctcttttctaattaagagaaccacaccttattcctaacttattactattaatgacagcacaggcatcaaattttaaggtgacttgtttgggcacccctttttcttctgttttggctaacactttactcgtatcgtttatgagcccccaccagtcctcagtccttaatcttattttaaaaactgtggtcatgggaggctcagatgggtcataacacatatcagattggtcatttcctgggctacataccttgtatagaataacattatacaaacaagttctttttagagttccagtacacttataataaccataaaataataagactgtagcaaccttttatcctacctcagcgacttgatgtatgcactgggaacagccccagtctgaggaaggtcagttgaagtccttactgtacaagtccaaattttaaggaaaatgagtcccgcgatgagtttcctcatgcttcagccatgcgtggaccagtcagcttccaggtgtgactggagcagggctggtcgtcttcttcagagtcactttgcaggggttggcgaagctactcccatccacatacagctcacagtctactgatgtttaaggatggtctcagaggttaggcctgctagaataaactgagtccaacacctctatacagttatgttcagctgggctctctgataccgggagcaaggtggtggggtttagggtgttgcaaacttcaatggttatgtggggattttcacatagcgagctttggtacttggttaatctagcctttgttaaccaatgatgtccttctgtatttattaaagttaccacagcatggggggcctttatatccaggttttgcctaagggttagtttatctgcttcttgtgctaacagggcccttgctgctagggcccttagacctgggggccaggctttggaagccctgtctagttgttttgagagataggccactggccttggccagggccccacagtctgggttaaaacttcaactgccattttttctctttctgacacatagagcgtagagttttgtcaggtcaggtggcctcagggctggggctgacgtgagtttttcttttaactcatgaaaagcttgttgctgttggttgtaatagatgtagtttatctaaactacatttttcttaactgtcacccaccaaaatattgacttaaatcctgcagctgtttgatttcaagctttaaattgatctgctattcttcgtgggactccagttgcatttaaatagacacgagagtcgaaagacccgtaaggggcttctctcgctttacagtgtcttattttttttccttctggttgatgaaatgccagggtgaaagggatagccaattggactaaagcacaagtgccactccagttattcagcagagtgcccagtaaaggtccaccacaataccaccacacatccgctcagggatgaacaagggctgactgattgataagctctcgaaaattcttaagctcactgcatcctttcaggtatccaaggaatgctaagtttcctccctgtcatgagagacacgaaatgaacttagtgttggaagatggaagctggatggccctcgggggctgaccctcagggtgctggactttgggatatagcagagagagcttggcacgtcttgttactccagactgtagaatcctggaaaagagctaccatgcagcccacgcctggtcgactggaggaccaccttagtggaaaggggacaatctgggcctctggtctgccatgtgcacgagcataacaattgcttttgtttaacgtgcagatggaatatttgatccattttaactaggcatttgcatcgtggtatcctgtcttaattgctaaagtttgttttaagtctttaacttctataatcctctagtaaaatgaatgtatggttttaggaaattacaaaaactggttggggcagtccatccttgctctttagtggtccacagaacattggaccaactatggcagggaagctctacatcggggggcaagactcctggttggcactggggtgtttatcgaaatctcccgggattaaatggtcctagtttactaacgcccagtctgaggagagtcagggggacagaagtgcttttctgaagtagagagctgtctttgacttggcacgtccccacagggtataaaagggcaagcattaaatgcaatagtttgaggcaaaattgacttggttatgttaataactagagggtcagcaatagagcgcggaaagaagaaagagtaatagatgaaaagcgttagatttttcttagctttagtttggtagggttttcctctgggactatggcccacaactctgtggcgggggtggcactttcttgactgggtgtgatgagtccatccttttttgctgtatgagcagctgtcttggtggttagcagcacaaggtagggtccttcctaggctgactcgagtttttcttctttccacctttcgatgagaacgtgatcttcaggctggtgctggtttactggaaattctgggggtagtacctgtgctaaaagacttttagttttttttgcgagaaaggaaagtggaagataaaccaagtatatagtttttaagagattgaccttttgttttaaatgtggggaccttggcagtggactttataatacttagtgcctttttactgagaaatttcctttagcacctatttttattagtttttaaaccaaagaaaaccaaataccattttacgtttaacaatgcttctcatatgatttttatactagataagctaaattttatctttatattagtgtgttattaatgttaaacctaattttaataaaacctagtagacatttatttaatttttaatgtttgaccataaggtaagattttatagactctttttaaccttctataatttttgctaaagagcaggttggtgctttaagaaaaacttgttatgcttttactttaatgtccagttcacagaaaaactggatgatacttctttaactttagctaatatgtttacacacataattttctttataactaatgttttaaaacttgcttaaaccttcaaaacaataattttttaaactttttaatgtaggtaaaaatgtacattcttatgcctcataatccttttactaaaggtatattttacttatacaccttggacataaactgttttttttttcaatagttttacattcaggaggcctagttacttttaaattatataacgttttttgcataagttctttttttaacacacttttaaaaataaccttttttttttctttcatgacttttacaggcaatttttcgacatgccttaactttctgacttattacaaacatttctttctttaaacaaccagttaatatatttcaggacaagaatttaccatataacactctttttatatgaattccgcccccaccctttttttccccgaagatgataaccattcttttccaaagcaaacctttttttatgtctgtgaactagactgtctacggccacaagaatagaagttactatcatacatgttacactattaactttcagcaaactttacttttgttgaaaaccttgtaagtctgggattttaattatcctttgctattaataagaccttgtcttgtccaaattagaattggtatagatggctttttttttttttttttcaattacccagaaggaaccatagatcgtcctgtcctgaagggagttcctcctaggtttggtcagaccttcgtatggtaattaagatttagatcccattaggaaacctgctgggttaagggaattttcagcagtcaatgttaaatcgtctttctttctttctctctttgactttgtctctctctctttcactttccttttgcctctgtctctttctctctctctctctgtctctctctttctttctctttctccctctctccttggctccttctttgtctgtctcttcctctctctcttttcctcttttcctctctgtctctttccgttctctctctgctggtctttccttgcctctgccagtcgcttatgctgctgttctctcaaccactgtgtgttgggggcgtggggtctaaaaccagctgtaatcaagtgtctatgtatgggaactggtctggatgccttggcttacaggttaccttgtgccatacctttgaaacaggggacctgtacaggcttccttctaatggccaacctacctctaatgctggctagtctatcttacataaagttttaagttttcctggtgtcatagtactccatagtctcccttaaatcctttttttgaaatttttcaacatagttcctagtggggtgggcttactttatgcctcactcatgtttcctcgagacaaaataccacgctcacaccacatgcacaccacaaaacaaagaacgggtaaaaagggcacacacacacttttgtagtttacaccaaaccaaaatcaaaaccaaaatcagagtatccagaaatccaagccaggtcaataccaaaaccaaagtatcaagcaatccaattcaagtcagaaacaaaaaccaaagtgccggtacaggcatgtcgtgggtgatcaggtcacgcttccactcaaatggagtgggcaagttcccaagaccagtcctgtcaagcaatttaaaccaagtcaaaaccaaaatcaaaaccaaagtgccagtacgggcatgccgtgggtgatcaggccacgcttccactcaaatggagtgggcaagttcccaagactagtcttaccaagtttcagatgtccagactccaagtaccagttccttcctggtgttcagccactgcgctgatcctccacaggggcctgccacacactactctggcgaggcgtcccattgcgctctcaggatccgtgtcgctcgggctggtcagagtcccccacaaggatgttccacagggcaggcttaagctccttaggagctgcctcaaccatctgccaatcaccttgcttccccgtcagggaaccaagaaatgtagcagacaagccgcagaaaaaactcctcagacaccgagttaaagaaggaaggggtttattcggctgggggcatgggcaagactcctgtctcaagagccgagctccccgagtgagcaatttctgtcccttttaagggctcaccactctaagggggtgcgcgtgagagggtcgtgatcaattgagcaagcagggggtacgtgactgggggctgcatgcaccggtaactaaattggaacaaaacaggacagggattttcacagtgcttttctatgcaatgtctgtaatctatagataacataaccgattaggttaggggtcgatctttaactaccagacccagggtgtggcgccgggctgtctgcctgtggatttcatttctgccttttagtttttactttttttttctttggaggcagaaattgggtataagacaatatgaggggtggtctcctcccttagatgggttaatggtgaatagagaatgagttatctgtgtggcagttaggatttatttccaacagttataaaactccccacatccacatatatatgttaaagaaaatactttatttttttgagatggagtcatgctttgttgcccaagctgaagtttcttctcctttagcaaaattttctgctgcaatcgctgtttgatgaaggctgctttggctgcaggtgtcccattctgtacttattcctctgcttgttcccctttctcgaatagtcactacattttttattttgtctcatgtttctttccttctttaaaaaaaaactctcttgaaactcttatctacttatctctttgttgttgttccctccctccctccctccctcttttccttccttccttccctcctttccttgagacggagtttcaccctgcagtcagggtggactgtagaggcacaaccttggctcaccgcaacctccacctcccgagttcaagcgattcttctgcctcagcctctcgagtagctgggattgcaggcatgtgccaccacgcccagctaatttttgtatttttggtagagatggggtttcaccatgttggtcaaacgcctgaccttaggtgttccacctgccttggcctcccgaagtgctgggattacaggcgtgagccaccacacccggctgttgttgttattacacctctggcccctcttctattcgtgtcacttctagcatacatcaaagcgaaatataattttcaggaaaaaataaactcatgactcacagctataaaaatgaatatgagttaaagaatttgtgttactcatagtatctgcgggaactaggcagatgctataaccagcttaatagaaaagtcaagccaatttaaatttacagagtagaagaatgttgagatgaattgcaaatgaaagtgaaactggtttttccactgggaggaagtctgttcctaacaagatataatttgcatgactgtcagttacaacttagcaagaatcgcaaatagctcaaacccaggaaagggctggaatctgataacttgataaccagaagggtgtgctgaaaattactgttttctttctctctctctctctctttctctctctctctttctttctttctttctctctttctttctttcttctttctttttctctttctttcctttcttttctttctttctctttctttctttctttcttctttttttctctttctttctctttctttctttctttctctttctttctttcttttctttctttttctctttctttcctttcttttctttctttctctttctctctttctctctttctttctctttctttctttcttttctttctttttctctttctttcctttcttttctttctctttctctctttctttctttctttctttcctttcttttctttctttctctttctctctttctttctttctttctttctttctttctttctttctctctctctctctctctctctctctctttccttctaccttccttctttcttttcctttcttttttttttgacagagtttagctcttgttgcccaggcttgagtgcaatggcacgatctcggctcactgcaacctctgcctcccaagttcaagcgattctcctgcctcagcttcccaagtagctaggattacaggcatgtgccaccacgcctggctaattttgtatttttttttttagtagagacggggtttctccatgttggtcaggctggtgttgaaatcccaacctcaggtgatccgcctgcctcggcctcccaggtcactgcgattacaggcgtgagccaccccacccggcctcattcacagttttcagttgaaacataattatgtttttgccatgctaatgatggttaatactctggaggtggtgggtatgtgtcaatcactcagacaatttacctgtgtttactcactgaatcctcaagaaagagaggtgggaaatacatcacatctgtcttacaaaggaggaacttagggctcagaggttttggatttcaatacactgttgctgcaggagtgggaatttgaataaaggtgttctgatggccacatgtcagttcttttccactgggctatgctatttgtgtgaagccctgagcagctgagtcctaggaagtcgtgcaggctccagaatgtagaacaacagtatctctccacctgggaaggcagtgctctatttactttttaactttccaattttaactggaataagctttcctcctcctcccactatccacattctccactgaatcctctaactgttactaattctacggaaatttgtggaaattaataaaaccttgtggaggccaagggaaaacttccccttcatctgaatgttcacagaaaatcaactgaaaaaagacagctgagaaataataagagaaaaggcatatgaacttattaaagtgcacaggagttttacaaaacataagatctcaaataaatgaccggatggttgacgcttttacaccatcttgagtttccagaaagaatgaggcttggatcagtggcaaaatggcttatgggaccagagaagaggtggcctgtctagcgaaggtggtcttgttacatggatggaccctcacaggtagcagtgctcagagacaatagatgtaaatgtttcaggcctttagaaacatcagaccctcagttaatcatccctaaatctggacaagggaaggcctcagagaaagcctggctgcatcaatgcagatttttctctacaggtgcaaatcttcttcacaaaagacagcttttcagctaaatttgtgtttccagccctcctgaacagccatcttgaaacatttcaaagaagtatattttaggctaaaatattctggctacctttgtaatctgagaagccaaaatagatatctctttatcgaataagatggaccccaaggctaaggcaatgaaaagttacctacaggctgagggctccaaggccttgctgccacggcaactccctaaattcctttggctacagcaaaaaccacaggtttgctaaactccctaacaataggaaacatcaggcaaaatgtcaggcccttcctaactctgatttacgacctctcttggtgtctggcttgggacccctttccggtaacaatcctgttcattctttggatgacactttcaaccttgcatgtacaatatgatatacttgccctgtttgatgaatcgtctaacttgttgtttctcaacctgttcattttttattactgctggccctaaaaacttttatgtggcattatttctgagagctctgttctgttccattggtctgtatctctgttttggtatcagtaccatgctgttttggttactgtagccttgtagtatagtttgaagtcaggtagcgtgatgcttccagctttgttctttttgcttaggattgacttggcagtgtgggctcttttttggttccatatgaactttaaagtagttttttccaattgtgtgaagaaagtcattggtagcttgaaggggatggcattgaatctatgaattaccttgggcagtatggccattttcacgatattgattcttcctacccatgagcatggaatgttcttccatttgtttgtatcctcttttatttcattgagcagtggtttgtagttctccttgaaaaggtccttcatgtctcttataagttggattcctaggtattcttttctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatgcgcttttctagatatacaatcatgtcatctgcaaacagggacaatttgacttcctcttttcctgattgaataccctttatttccttcttctgcctgattgccctggccagaacttccaacactatgttgaataggagtagtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaaggattgttgaatttcgtcaaaggccttttctgcatctattgagataatcacctttctctcctcccctggatattatgaatcacatcacaaggaggtgtaccccctaatgatatggggagtaatatcatgtctctcccactggatattatgaaccatatcacagggaggtggacacccccgcaatatggggagtaatataattcttcttccctctctagatattacaatctatatcacaggggtgtgtacgcccccacgatataaggagaaatatcacctttctctccctcactggatattatgaaacatatcacagtaggtgatgaggaaagaggatgatattacctccaatattgtggggagtgtacatacccccttgtgatattgtttctaatatccagggaaagaggattatattactctcaatattgcagggggctgtacaaccaccctctgatattttcctaacatccggcgggggggcggggggcggaagacgatgatatccagagggggagatgatgatattactcttaatatcgcaaggggtgtacacccccctgtgatattgtttgtaatatccaaggtggggagacgatgacattagtcctgatatcacagggggtgtacaccctcctgtgatagtgttggtaatattaagggtgggagagtataatattatttgcaatattgcaggggatatacacccccctgtgatattgtccgtaatatacagaaggaaagaggatgatattattcccaatatcccagggagtgtacaccttcatttaatgttgttcttaatatccagggtaggagaagatgacattactcttaatatcaggggctgtacacccccctctgacattgttcgtaatattcatggagaaagaggatgatattactcccaatatcctgaacaccccatgtgtacaccaccctcttgtatcgttcgtaatatccagcaggggagaggttggtattactctcagtatcgcagaaggtgtatgccctgctgtgatattgtttgtaatattcagggaaagagaggatgatactacttccagtctcgcggagcatgtacaccccctgtgatattgtacctaatatccaaagaatgagaggatattattcctagtatcacaggctgtgtacattcctcctgtgatattgtttttaatatccagggggcgagaggatgatattaccccaatattgcagaagggtatacacaccccgcgatatggggagtaatatcacccttctctcccccctggatattacaaacaatatttattgggatattgtttctaatatccaggcgaaaaaacaataatacttccaatattgcagggggtgtacaccgctcctatgacagtattcctaatatccacggggggagaggatgatattattgccaatatcgcaggagctgtacactccccctcttatattgttccttataaccgggggggacgggatgatattagtcccaatgtcgcagagggtgtacaccgcctctgtaatatccacgggggaaaaggatgatacaattcccactatcgaagggggtgtacccccctgttgtattgttcctgatatccagggcgtgaggaaatgatatcactcttaatatcgcagggtgtgtacaccctcacgttgataatgttcgcaatatccaggggaagggaggataatattattcccaatattgcaggggctgtacgtctcccctgtgatgatgttcctaatatccaggagggtagaggatgatattactgtaatatcgcaaaaggtgtacaacccctctgtgatattgtttctaatatccagatggaaaggggatgatattacaacaccctgtgatattatttctttttctttcttcttttttttttgacagagtctcactctgtggcccaggctggagtgcagtggtgcgatctgggctcactgcaagctccgcctcccgggttcacgccattctcctgcctcaacctcccaattagctgggactgcaggtgcccaccaccgcgcccagctaattttttgtatttttttttagtagagacggggtttcaccctgttagccaggatggtctgtatctcctgacttcgtgatctgcccgcctcggcctcccaaagtgctgggattacaggcgtgagccactgcacccggccaaagaatacattttaaattagaagaaatcatgtaagtgctattcttgaagtttcttattttaatttgtgatttaattaattcagtctcataaataaactcaatgaggaaggaagaatgtggaactgacaatgtaagttgcttacataaatcgcctcatatggcttcagactgagtctctaaattgagaagatcttaatgcgtgacaattagctacatggtagagaagaaactactcaatgaaaatttatttctatttcttgagccaaaatttgaatgattgtccttatttatggtagcccagtagaaagattccaagggtttctttcctttctttgtttttcttttcttctacatttcttccaaaattaacttaaagtaactcctgaggttgtatataggatagtagaaagcacactttcataacgttgtttggaaggtcaattatatgatgaatgcaaaatgctgggattttgcattttgtaatgacagttacaaaacactgccaaaataaatcagagatgacacaaataaatggaaaaacattccatgcttctacataggaagaattaatattgttaaaatgcccatactgtacaaagcaatttacagattcaatgctatttctaccaaagtaccaatgtcatttttcacagaattagaaaaaactaatctaatgaccaaactaactgaaaggtcaaaactaaccgaatggccatatcaatctcaagccaaaagaaaagagttggaggaatcacactctcagatttcaaactgtactacaaggctacagtaaccaaaacagcatggtactggtacaaaaacagacttatagaccaatgggacagcttagaaaaccctgacacaaagctgcacacctataaccaactgatctgacaaagtcgacaataacaagcaatggggaaaggattttctgttcaatacagacttcaggataactggctagccatatgcagaggattgaaactggatgtctttatttcaccatgtacaaaaatcaactcaagatggattaaagacttaaatgtaaaacttaaagataaaaaaactctagaagaatacctacggaaataccattctggacataggccttggcaaaggtttcgcaaggaagactccaaaagcaattgcaacaaaaataaatattggcaagtgggacctaatttaactaaaggccttctaacagcaaaagaaactataaacagaataaacagacaatgtagagaatgggaaaaaatttgcaaaccatgtgtccaacgaaggtttaatatccagaatctataaggaacttaaacaaatcaacaagccaaaaaaaggaattccattaaaaaataggcaaagggcaggaacagacacttctcaaaacaagacatatgtgtggtctacaagcatatggaaaaatgcttatcactaattattagagaaatgcaaatgaaaaccacaatgagataccatctcacacccgtcagaatggctatttattattagaaagtaaaaaaaaaaaatcaaaacaacagatgctgggagggttgcagagaaaagggaatgcttatacactgctagtgaaaatgcaaattagttaagccaccgtggaacaatttgaaaatttctcacaaaactgaaaacagagctaccattcaacccagcaatcccatgactgagtactttcaatggcaaaaaccgcaattacttttgcaccaatctcatacatataaagcatggaataccacacagccacaaaaaagaacaaaatcatgtcctttgcagctgcatggatgcagctggaggccattgtccttagtgaactaacacaggaacagaaaaccaaatacagaatgttctcactcataagtggcagctaatcactgagtgcacatggacacaaagaaggtaaaagtaaacaccagggcttattggagggtagtaggtgggaggagggtgaggatcaaaaactatctatcaggtactatgccccaaaatacataagaatgatgaattattctagtgcaaacacacgttacatataaagattcacatagataataaataatagagggagatttgttatgctaagaccacgaattagctgcatacttcacacaagaaaaatgattcaggctaactatgggcagttcataataataaatgggatgcatactcaaaattacatgacaagctttaaattacatgtaatgacaaaaattgtcttgttattgtcccacaggaccctgaagctcttttcattaccctttcaatcttttttcctcattatatttagattatgtaattcctatttgtttatctttaagtttgccaacacttccacctgtcttctttattttgttattacactgaactacagtgaggattttttttttattattactatttggtctgccttttttggcttttacatttttatttagttcttttgtttttctttgctgagaattctcttcactaaattatagacttaatgttgtagaaagtacatttagacctcctctatttctggaactgtatgcaagtccagctgctcaccacctagaagcaaactgcaaaagaagtaggatggagtgacaggaaagcagttttatttttcaattgctaggagatgggagatgggctgcctcaagcctcaaaaacaaaacaaaacaaaaaaacccatctcaaagctttgagctgagggcaggggcttaaaaagggaaacgtggtgtgggaggtatgcaggggttatgcagagtgtagggtctgcgtgtctttttgcaatggctatcttgagttattgtccacctagagtgccaactggcaccatctcaagtgtggctgggctgcagattattcatcttgaggtcatctttcagagggagagaatttgccactgggtctccatgcctggctggtttcaaaattagtccctagaatctcttaacaagcatacagtaagataagtgtgtgtggtgcaagggagtgcctggtcagaaagagagggaagctgtttccatttcagctcctcaggccagcatattcctagttggcaaattccaaaccaacttgtgcctttcagttggaactagaacttccaggcaaacatattttagtgccttggtcattgtttctagatgtcgtctatacctgcactccatgtgactgcccccctgctctgtgctacaagaacacatctgtgtgaatagcactggggctcccttcatactgaattctgatcgagtttggctcatgcagtgtaatgtacattatacagtgtcatgtgctctccacactccccttcccacttgagcactgaagtacttgttcccccagctgccaggagaattagtatgtgacagctctcagctaagtccttctcaagtcactgttcccagttgaggtaaactgcctcacccaagcttatgctctcttcctgggggcagccacatgcaatcaatgctcctgtgggaacacaaacgcggggccacctgccctactacaaggcaacatggaaggttaatctcacagttcatccaaggagtagccaagactgtagttgtgactacatcacagttcatcttctcccagtgcccaactttgcttcattaatgccacaggaattgacactaggaactctccttggtcagcttcctgaatgtcgaagtctccatctcagtctttttttcaggaatttctgagtgataattatttctcctgctcaggcttgctggtctgtggattcttgactttgccctctggcaggttcaccttggaggtggcctcctccatacagcccatctgtgtgaaatctggaagctggtctatccccacaggccatcaggaggcgagtgggcagaacatcacggtcttggtggtgtagggactcagcatagcctctctttggttttcgtaaattgtgccacatagtagttaatctcaactcagctacccagcatcgctgtcctttccgtttttctgtggagctctgggcagtacatacatctttttctcatctgactcacagcttgtctggccttaattctcacacaccctagagtccttcagagagatttatctacttaaggcaaaaggctacttcccccattggacagtagccacctgtgttactacaccattgtattgatactcctgggaccccagagacatcagtgttcagaacatggaaagataaaacttttatcataagtgataggtaaactttcattgaaagttttatttgttacttgatatactaaatatctacaacctactgcttgcactcagccaggaatttgtttttttccacaggaaataagataacctgactttaactgtagactgcatgtgatcaataacattctaaatcagagtaggattagccacttcagtaagatacaacatgcaaaggcagaggtgtcactaaaatctatgatgggcttgccttctaaacacaaacaatggtgattacaacttcacttggaataagcaattacaatatctcacgttttgtctaggagcagctttccccatgatctattccatgagaaattttgtttaaatatatttttttttacagttttggaggctgagatttatatatactggcagtgaagcctgagtccactaaacttgcaaaagctggagccaggatcccaagggtgcttgacagtagaaaatattaagaacaaataacacaatcatagaaggcagccccagataaaatcaaaccgcaaactgcctggcacagtgaatacaatctgttgttactattgttgctatcactgattttattacatagatacaaacacacaaaatattaaaaaatacaattatatcacacagatgcaaaaatattgatacttataaagcagcagagattctgtcaagtttagttcaataaggaaactaccatggattctaccacggtttctttttatttcaactactttctttgacaagagctggtctttcaatatcacactgtttaatcttcccatcctattaaactacacacaagtaacgccagagccacattacctcgccccttaatgtatttttcaacatcatcttttccatgcacatctatttacatttcatttttgctcctaaataattctctcttctttcaataaatcgcagctttccaaaagcattttggaagtatattaaaattatgggtatttataaaatgtccctgaaaattaaacatctttggcagccaaagtggcaagctcatgcctctctggtttattaatcagagttgatttaggtcacacccctaaacagtagactgtagacactgatacaagtgaagccaacacagccaggctggaagagcttttctcgatgctgctcagacaggatccagccttttgggaggagtcatcacttttatcttctgtaagtagaaaatctgtgattctgtaaatactaatcacttaatatttaataattttcctgtaaagtttgaactctagataattcacagctatatatctttacgtattttacaaataaaattctattatccattctacaacctgaagaatcaaaagttgctagctgacacagtcatcaggttaaattcctgtaataacctgtcaattttgtcaaatatatgatttggctgtttccaatttattttctgacaggacaaattgattaatcattttagtatcatggggaggagagttacagttttactattaagttttggcaacagggatcagaaaagcacagaatggaatgttagaggcattgttctcagtgttctgtgattacttgacgaattattgatgagaaaaaaggaagggatatatacgtgccttctactagcattgcaaaagagatcagtgtgatttaaagtaaaaatgtccacattttatcaccattctaagtaagaaactatggggacagaagaaaatatagttcaaaattctctagctttctaagctatagtgaagaaagaaaaggaaaatatttatttttcagggtaatactttatcatacttctttctacactagtcaatcttgaattttcaaccctctgttaaatgaaattatagacattttattagcaagattatttaattcttcatttttcatttaactgttctttgtatccatggccaatttttaaaaaaaattatcccaaataatcatttttgtaggtttataaacattttaattagtggcaaattatcttagctttgtaacataaaaatatagacagtaatttcaataaagcaaataatttaatattatcacatcgtagaaaaatacagttatctactaattttatttaacacatttaattaatcatttcgtgaaataatctgaatgctatggcatgatgaccagttagactgatacaaactgataatttttatacacctggaaataaagaatttttattccacataaacataaagaatagaaatattatctattttcactgaaaaggtacaagctaatgacatcaaattttacaaactatttaaccatagtaggaacttcataataagaaaatgtatttcctgaactgaaaagtcatgcaagttgttgagattattctctgaaaacatatgaaccagtctggcacaatttaagcggctaattaattgcaattgctatatttttatgctatatatgtttaccttaccaaaataaaaaaaactaacatctgtcgtgaaacattccattaaaatgatacttaaacatacagctgaagtgagtgggagcaacgttaatggctatgactggataattgaacaaactgttatatatgcagataatgaaatagtattcaccctttggaaggaaattctgacacatgggatgaaccttgaggacattatgataagtgaaataagccagtcacagacacacacacacacacacacacacacacacacacacaataccacatgattccatttatatgaggtttctaaaacactcaaatttatagagacacaaaatagaatggtggttgctgggggctgtgtgtgagaagaatggggagttatttcacagtgggtacagaatttcaatttagggaggtgaaatgagattcatagatggatattgtggatggtcatacaacaatatgattatacttgaagccactgtactgattgtgccttaaaaatatttaatatgatagaaaaaataatttaagaaacttgtccaacaccctacagttatgacattacagactgattttttaaaagatatttaaagttgatcaagcttcaacactaaggaaggttgggaaaacggagaaatggaagatatcgagtgaaagaaatgagtcaggagggttttgaggtctttcagcaaagtgacactaagggctgtaattagagattttgtatagttcctacgtgtagaaagtacatgttattgcattttctaagaagtaaaaagaaaaaaatagagcatgttagagatacgaaggtgtgaagatcacaaagttttgtcaaatgcagaatttatttgtcaagaaggacatatgtatatttccatgatgtttaaattttaaacaaccaaataaaaccctcaggtattgtgctgcccgtacaattatgatgctcaagtaatgcactctggtattgactgacgcaactgcactgcctttcccagtcgtgactggcattttagtttagggtggatacaaaaagtggaggcaaagggaatgcgcatggaagagatgggctccttctgccatataactttattgaattagaccatatccttgagattgaatcagcatcaatacctctgcaggtgtggcgacatttattcaacaaggtagaaaacttcctgcaccagcagatctaagatgaaaatgtctataaagatttcatttctcttgagactgaagaagacattaatttatctctgtgattggataaagatcttagttttcttttttctcctttacctggtaaaggttatacttgtggactgatgagaaaaagtctcattgcaacaaagtaccttgtacagttaatgaaaatgtgtgtttaccattatactcttacactgcaaagaaataaaaaatatccaagaaggtcagtactgttttcagtctatcacctataaaggaggactaaatgtgttcacaactccaaattaactatgttttcatctgcagactcagcctttccagacctgagaatataagtcaccctctttagaaaggaaaaaaagtcttcttggattaagtcagggaaaactgcctgattttggtaggtttcaatgagttttgatatgttatagacccacaaccttcacagtcaaggatgtagttttatataatgaaatatactgacttaattcagcttctaaaatattgactatgcatgatgtaactcaagcacaaataaagtgacaaattatgtgaatcatttcattctcactcacttatgatggtaccagataaagcaaaaccattctgacaggttacttgcaacttatccagaacgtggatttgtgatataaaattaatcaatacttagcctgagaagcatttattatgaaatccttggaaatgagaaaaagtttaattaattttatgcacaaattagaacattttgcaagtggcaaatgaaagatttgacataggtttcatcgctttcacacaagtacttttctatttttttactacgtaactcaaatggagtaccataaaggataaacactctgtcttctttttctccatttgcagtgtcactcttatttgaaatcatggaaaatgggagctatacctcttatttcattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacgtgatgctggtttccaccactgtgcccaaaatggcggctgactacttgaccggaagtaaggccatctcccgcgctggctgtggtgcgcagatcttcttcctccccacactgggtggtggagagtgcttcctcttagcagccatggcctatgaccgctatgcggctgtctgccacccactccgatatcccactctcatgagctggcagctgtgcctgaggatgaacctgtcgtgttggctcctgggtgcagctgacgggctcctgcaggctgttgctaccctgagcttcccatattgcggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccacaggtccactaaccacgacaaggttgtgtcagccttctatactatgttcacccctttactaaaccccctcatctacagtgtgaagaacagtgaggtgaagggagccctgacaaggtgtatgggtcggtgtgtggccttaagtcgtgaataagactatatatttgccccaacattcaaaactgtgcaaagtgtttgtgtggaatttcctagaaataaggaatatacacttttatttctacatctgttgtctctgtgtgtgtgtgtgtttgtgtgttgctttgaattgcagatgaatcttcattcctcgggttcatttactcagctatcattacccaatcaaatcatggattgttaaaaatcggtgaactcactaatccttagtaagatggttttacatcatacctcacaataattttttgttcaaagaatgaattaaccattcaagcagttttgaaagttgttgccatttgtttcaaattgaggtgtagcttacacacagtagaatgctcgcatttaagatgttccttttcaactaatttccacaaatatctaccctggtaattcacccattaggaagagacaccattttcaccacctcagaaaggtcctgcaggcccttttccagtgataccccaggcctaagatacatccactgctctaatttttatctctgttcgttagtttgggctattctaaaatttcacatcaaaggaaacaaatagtatggtcttgaatcttgtttccttctttcagcttaatgtatttctaaaatccctccacatttttacctcattgttacattgcttttttttactgctaagtagtattttgttttctgaaaatttcatcatttgtttatccattattttgctgatggacatctgggctattttcagtttgaagttctggtgactgaaatgtatgttaatctcctatttgtaatcatatgtttttatttttcttggtaggtgtctggtgaactcttcagtaaactgttttcaaagtggttgtttactcttatactgccgctgacaatgcacacaagttcctgttgctccaaatgtcgatgttttcttcattttagcaattcttctgagtgtagtaggaactcagtttgcttttaatttgcattttcctgatgactaataatgttgaggcctcttgcgttagcttattatctattgcctattgatgtaaactgtctacttcagtttttggaaaaaaaaatctgtatatgcttccaaagcgaaaacaacttggtcattaactaataggcaatctatggcattcatagggctacttggaattttggaaataaaatcatatattgggttattttttattatatttcctgacacatgtgttatcattcaatgcctcaagatttgctgttttattaaaccaggtatttagtacatctcttccacctcctgcattctgcttaaagctataaatctgtttgttttaattatgagttgtaacagaacatcccacttcactggaggaatgatgccactaaaaacacacagattttattaattttacatatacaggggcttcttcacaagagcatgaaatctgaggaagtggccaaagagagaaattttatattttctcgagaaagaatgataaatttaagaagacgtgacaggacaaaggggatggggtaacagcagtacatttctaggtgagtcattaggatgtatgtgaaggggagtaaaactcgtagaagggttacttcgctaagtatattcattctgatccattgcacccccggatcccagtgtctggtgtaagggctattttctcagctggtacatggagggtgcacctcccgaggaatctctatggcttcgcacatgtaggaagagaatgatcagctggccctttctgaaataaccattgctcctatgtttttaattcgaagtaatcaatattccaatttggtatttggggaatggcatgtctttcactcctttacaggtaaatgattatatagatgcagtaattttcaggcaagaaatttggcatgttgaagagactgctgattttacgaaggaaacaaacataaacatacgtttatttctatatcaatttatttataaatatatactcatgtgatctccaaaaacaaaaaattaaatccaaaaatcaattgtaatacaataatttcacatacttagagactgtttttttttttactttgcttttttttagtctcaatcttctccttcacaactttttcttttcttgaaataaggagcagaggaatgtagagcagacgctctcagggagcaggagccagtgagatccaggttggcaggtccctgcagtactgtggaagtggcggcccctggggattgtggaagaaagcctggttgaggcatttaccccgggcctgcaggttgtgctttagggtatctaaagccaatttattacactttaaacctggtttatttctataaacataggcataatttgatcatagggtaatttcatcaaatagccaacttccatattctttcagaaacatgaagtgaattggtttaaccctcgcctagatggagtagagtataacttcttatgaaataactataataacagtaataaacacaaatacctctcattcatttagtacttaatttgcaactgtattttgcttaatatttcaccttcattttattattttagttataaccataaccttccagaattggctcagtgttcattctcatttttttaaaaaaatggagacaagcttattggggtaaaattcactatccacttttatacagacctgaatccaattgcctgactttaaaaagcttgcactcaggaaagagctagttttcatagtgtttcagtgagcacctgcccccaccccacacatatacacatgcacactcatttgaaatcgccatcatttcttctactagtgttcaagatgttgtcacatggttttcctccttcacacaaggtattgctgcaggttctcctcacttttttctcaggcatcccctagggacatgagtcctcatggtgccctatgaaagggtggccgttttctctcccacaagccacatgctacaggacttccaactgggaagttgtctttcatccttttccttgctcctttcaaatcacatatccccttctccctgtaaactgtcagctaatcggaaggaaatcgctgaactgagtatcacccaatgcctctgagtcactctcaaggacatgacattgaaacaaacatctgagtagcatgaacagcagctggacaccatgagggaggaaggggtgttgagcccagtgtgctaaatgtgaaaggccctgcctggaatgtcctgtgcggagcggaacgtggtaaggtcaaatgtggtgggagatgggtaccccgggaggacttcagggtcaggtcacataggaaggcgcaggttttgttcagagcgcgctagggtacacctgcagtcagccctcatcaggaaggagcagacggtccacataaacataagcagctaaactgtagattaaacatgatgttctgacagagcagattctgagggggagagagtcatcctctttaagagaacaggaaagtctccatggagggaagatttacatgtaaaatcttgggagaatggaagaaattgaagcccttagaagtgctggggaagagtgtttatgtgcaagaaataatccaacttatgaaaaagatgcagaatagctcaatttatataaatataaatacttcagcttcactggaaattagaactaaatgtaggcaaattttatgaattttttttaaatttaaaagaatgtgacctagcagaatgtctgcaaatgcaaagttgtggttacagaaagaggaatctagtgttaggactgaaatggatttatacagggagaaatttgaggcagggaattaacttaattgtcattataatttttgtgtttctatcctataaaagcgggtgctaaatactttgagtaaaacatactggaattacagtagattgaagattccgccaatataaaatctaatagatgcattaagggtagcaaacgattatcacagactactgtactaggttttctattcccagatcaactcatttgccttcttcaatgattctttctcatcaatatatttcttctgtaaattctgaacacaaaatgtgtaacattctaatataatctgcatacatacataatgtactaaagtgaatttagtatagaactttaagatatgcctgtagtaggcttgattttcacatatttattcaataaagcaaattaaatcatgccattttatttagataaatgaaacaccatttaaaattatttgaaataacttaaaataaatataaacattatctttagcatagaattttagttttgatttaaatataaaaatttggaaactcaatgttacttattatattatttttactattaaaaactgaaaggtaatataaatgtaacaagtaagataatagttgactaaatagttgtacacccagttgaaatttactacattaacacacgataatccaaagatctttgactgatagcaatggtaaagagtttctctgctgccagtggagaagtcatataggttaacttgttatataccccttattttggcctctgaaaagattgtttgtccactgtggtcttttaaccttgacatcgcctttggattgaattttctttccctcagcataatgctattgcttttttgatctctaggggaaattggagattgtacattgatgcatacaatttgtggccaaattccttctactgcagtctcaatggtctaggggttacttacagttctacaacacacaaattcagagtggtacaaccagacttaggtttcctttggcagtactggtgtttcaaaaacatagctggcatttattcatttccatttgagaccactatcagtcaaaatctactgctaagatagagtttttaatctcttgattgctcccaacattagttaaatgtggctacactgagaatggtttcaacaatagactttagtgggaacaaactagcttgattctttgtgacaagcaagatgccccctgtattctgcagcgttctcaaggaaaagtgcttgatgaggcttgagccacggagtcatttccttgtcaggcgcacacaccccatatgcagttgatgttttcagtccttcgaggcttctaagtattaggcttgggtgatatctatttcatgtttcagacagagaaatatttgatcagcaaagcttattttctcatctctgctaactctagcttggttcatctcacacttgctggactttgctttgtgttctgtggtagaacaggtaacagagttaaatagcctgctaactcccacacaaaagacatttccctaatttctagaaatcatctcagtttttttcaatcacctgcactataataagaaaatcgttttcttttttctgacagcattaagtgcataataagagagaattcagttctatcatcagtaacagagacctggtcagtagggacttcaacattaaacaaggatttaaaaagttaattgatgcacaattcttgtacaaatttatggggtacagagtgatatttggatacatacaaagtttaatgatcaaatcagggttattagcatattaatcaccttaaacatttagggggtgtgtgtgtgtgtgtgtgtgttgggaacattgaaaatcctttcttctagctatttgaaaagatagaaaaaattatcattaacgataatcatcctagagtgctatagaacactagaacttattcttccaacatagttataaatttgtactcattgagcaacttctctctcttctcttaggccctcgtgtttcccagcctcgagtaaataccattctactctctacctctatgagatcaggttttttaaccttctgtatatgaatgagaacatgtagtatacatccttctgtgccctggtttattgaactcaacataatgtcatccaggctcatccatgttgccaccaactacaagattttattctttttatgactgaatagtattccattgtgtatacataccacattttctttaactattcattggttgatgaacatgtagttgattccatatcttggatattgtgaacagtgtggcactaaacattgaggtacagatgtcccttcaataggctaatttcctttcctttggatatatgcccagtagttgaattgctggatcatatgatagatctatatttttagtttcatagtgttctttataatagctatactaatttacattcccatcaacactgtataagatgtctctttctctacatcctcaccagcatttgttattttttgtcttttttgataatgaccactctaattgcagtgaaattatatgtcattttggttttgatttatatttcccttatgattagtgatgttgaacattttttcaaatatttggctatttttatgtcttcttctgagaaatgggtatttagatcatttacctattttcaattggattatggggttttatttgctattgagttcctcgcatatactatatattaatcttttgtcagaagaataatttgcaaatattttcttcaattttgcagggtgttttttcattgagatgaatgttttcttttctgtgcagaaggtgtttagtttaatgtagccccatttgtgtgtttctatcttgttgcctgtgcccttgaagtcttagagataaaatcttttctgagaccgatgttgaagcatttcccttaaaacaagcatcatttttaatttcttcataagaagcaagtgttgattttggccaatcagggcagcttttgtgattggtgatcaacaggaaattgcctggtagcagacagtcttcggctccttaatcccttgagttttgtccctatgaaatggttacaggaacatttcaggaacatacatcatcatatccatatgctaaagaaacaggatgggccgggcgcggtgcctcacgcctgtaatcccagcactttgggaggccgaggcgggcggatcacgaggtcaggagatcgagaccatcctggctaacacggtgaaatcccgtctctactaaaaataaaaaaaattatccgggcgtggtcgtgggcgcctgtagtcccagctccttgggagacagtaattataggaatcccttaaatcaggtggcagtaacaaggagaagacatgtggtcactcactccgtaatgattgtatggaattgaaaagttagaagggccaaaaaaaatggtgaattaaaacatcaaatggctggcataaaatgagattgtaagcagctcagattatttgatttcaaagtcttcatttgctctttcacactcattttcatgtgcgcatgtgggtgaggaagccgacctaaacattctcattcagtgtggtgagtttctttctccctagcttaatgagtcaattttctggacagtgagtacaaaatatacttctgattcacgcattatattgtactttgctttacatagctacattctatcatatcctgaatctctcttctttcattcctttccttcctgcccctcttttcctctccctagctatctcattttctccctcccctggtatataaccccttacatgtgtatttaagaaacaaaaaagagtaagaatatagtaattataggaatactaatatagtaataatagtagtagcaataataatcatcctgagtattgactgtgtgccaggctctattcccccccttcactcggtgtgtgtgtgtgtgtgtgtgtgtgtgtgtgtttgcagtgggggtatttaatgagtctcatctaatattcaaaacaactttatcaggcaggtactgtcatgatcttcatttcatagaaattcatttcagacataatttaatggatatttcagatataatttcatatctggtgtttcatgtaagacaaaaaaatgaaatatttttgggatattgcatttccattaaattttcctgtttatctcttcaaagcagtagggtattgatgatattgttattttcttaataaaatgtttgagtcaatagcatacgaattcctgggctaggtaacatccattatatttctattatatccatgtctgctctagataaagtaatagttaaatttcatccagatttaggttaatttagtatttgagttttgcctgtcctatgaaattccactgtagtccagtgaaataccagtgaccactttttaaaaatagtcagtcactaactcattaagtctgatattttaagcttatgataaagcttatcataattgatttagtgattttcttttgtcttgtgcttgtcttgcagtcaaacatgtaatgtaaagaaataatgtaggaacaaataaataactacttaacatttgaatgtcaagtcattgcaatattagtgaacaatcgaagtctgtataaatcaaaatttaaagaaacatgttgtatgctttatcggtataatgagagatctggtagataaattaaaaagtattttttagttgaactaagtctaaattaatgaatatgtggtgtgttttaacaatcttcttagatataaaatgctcagaaggatttgagtgtagtgggtcaatgagtgaagagtacaaaaggagactggggtatgatggtgtctgtacctagaatgtaatttccaagcaggagtaaattcaatggaacatttgcacagtaaacagataggaacagtttgattcactaacgggaataaacatatgaactctgaagtagttccattgacaaaatgaaacaatttggctacatgtacaaatatttggaatagttggctaaataatttaaggagcctaaatgattgttcctaaatgaagacatttttagatatggtaaagtctcacacacacatacccacacccaaacacacacacacacagacatttaatcacatacagttatcatttgaaggaagtgtgatgtgtctggaaaaaaatgtgggctcttcttttgtattaaacttagtatgaaattatgtacacgatttatgctggtgtcactctatatttctttctctataatcatgacctgcgtttcttcaaatcaaagtggctcttttatgctcagtttatgtgaagtataatgtacactggttaaatttcagactgacctgcctgactgcttcttccaaatgataaaacttgaagtatatataaagatgtaaacagacttttgggaaactaggaatttcctaaaaattacagagccacaaagctgaaaaacttaagacaaaatcctgaggagagcatgttctctgattaatctccaggcttatagaaaagacatggatgtagagtgtatatttttctccaacatttaatattattaacaaggtatacttggagctagatgggtgataaatgaactttacctcgtcaaagagtttcctgtgtggggaacaagctataggataggtgacacgtattttctccactttcaaacacggaattgagagcatttctctttgcatacaatggcagatttcacccaaaattgaaatactcctgggtaacatagaggatacactttcttgaatcattccatcatcatgggagtatatttcagatccctgactgactggttaagccaagagatatgaaaaaaagttgcagaaatatgaggtgcctcatagtagtggacatatggtgttggaagtaagatgatgagggagataagaaataaattgtggattgcttccaatttctgaagaaaaaatacaggtattattgcgtagatgatatgaactctaaaaaatgtaaaagccagtatgaaatacagagaaggagaatttatgcatagctgaaaatatttttacatcaaagaccactaaaacaattaaatcattcttgtaaaaagcaattaatgagacctaaaatgggccagaagtcagctaaggacatatgattcagtagggcatggaattatgataataaagtaaatcattgattaaacaagtaaaacgagaagaatgatataactccagggagtggggaaaagttaacttcggatataggtgtgttgatttgagttgtcagcagtgtttattgattttgtaaatttatttacgatcagctcatgcagggcaccactgccctgaagtctgaatctgtgtgtatcatcacattttacaaagctgtgggtcaaaacagtcaaaacggaaaggaatggctgggtgcggtggctcacgcctgtaatcccagcactttgggaggccaaggtgggtggatcatttgaagtcaagagttcgagaccagcctgaccaacatggtgaaaccccatttctagtaacatacaaaacttagccgggtttggtagtggtgcctgtattccaagctactcggaagctgaggctcgagaattgcttgactccaggaggctgaggttgcagtgagctgagatcacaccactacactccagcatgggcaacagagcaagactctgtctcaaaaacaaataaacaaaacaaaacaacaacataaaaaacaggcaggactaattacacatacatttataaacttcattgaggtgcttatcttttctaactcttctaggtcatagcacacaactgttgttattcaaggaaattaaaataggattaagtgatctgtttatgaagaatctcaatattcacaaaaattaaaataatcatttatatattgtcggtgacatacttctgcatttattttacaaaagggaaaatctaagctcattttattcaaacaagtagttgttaataagatggaaaataattttttaatgtttgttatttgttttgatgatcataaagcatcttgaaagacagaaacctggactaatgtatttataaattttataatttacgtattaatatgtgaaagtatatatgtatgtatttatgcatattgagggaaatgttatacatacagaaggtgcacaaataactcttatgtaaacatttaagtaaccactatcaaaatataaataaatgatatgaacacctactatcccacatatagaattaatacattatacttcaatttcaacaagttaaccaaacacgtaaatatgaaatacaaccttaaagacacattgttgatgttgactagatgatacttctattttttacatttaaaatatagtgtttcaaattataaacatattgagttttgtgacaatatttcattacttattattttggaaagtcttagaattatacattttattttctataagtttaatctaaataataaatgcaatagacagaaagacaagttccacagttcattcatttcattcaaatattcaacattcttgagcaactgctatgcactaggctctgttccaggcagttggttataccagtgatcagaacaaggatctctcattgtgaagtaaaaattctggcatagaatgaaaataaacagtaaatataaccagtgtgtttattatttaatgtactagaaggtgaaaagtgacatgcaaacatgtgaaaatggagcagagcaaggaggaccaggaaattagggtttaagtgggagccctacaattttttaaagggtgtgcaaggataggcctccttgggaaagtgacatttgagaaaagagtagatttgagtaaattatgtggaattaattaagattatgagactcaagatggagccaagggcccactcaatatactgaatatcatcgattatttgaagaaagaaatgcccagcttgtaaaacatgcccactccaaaaactggctaagagtattttgatgttgattacaaaacatgcatcactaactctcattttattatgcaggtatattattgttagattaagatttacactaatattttttctttattattaattcattatttctttttaggttaaaaaatagagaattcatgatgggccatcagaatcacactttcagcagtgatttcatacttttgggattgttctcttcttccccaacaagtgtggtcttcttcttagttttatttgtcattttcattatgagtgtaacagaaaatacgctcatgatcctcctcattcgcagtgactcccgactccacactccaatgtattttctgctcagccatctctccttaatggatatcttgcatgtttccaacatcgttcccaaaatggtcactaactttctgtcaggcagcagaactatttcatttgcaggttgtgggttccaggtatttctgtccctcaccctcctgggtggtgagtgccttctcctggctgcaatgtcctgtgatcgctatgtggctatctgtcacccgctgcgctatccgattcttatgaaggagtatgccagcgctctcatggctggaggctcctggctcattggggttttcaactccacagtccacacagcttatgcactgcagtttcccttctgtggctctagggcaattgatcacttcttctgtgaagtccctgccatgttgaagttgtcctgtgcagacacaacacgctatgaacgaggggtttgtgtaagtgctgtgatcttcctgctgatccctttctccttgatctctgcttcttatggccaaattattcttactgtcctccagatgaaatcatcagaggcaaggaaaaagtcattttccacttgttccttccacatgattgtggtcacgatgtactatgggccatttatttttacatatatgagacctaaatcataccacactccaggccaggataagttcctggcaatattctatacgatcctcacacccacactcaaccctttcatctacagctttaggaataaagatgttctggcggtgatgaaaaatatgctcaaaagtaactttctgcacaaaaaaatgaataggaaaattcctgaatgtgtgttctgtctatttctatgttaaatgcctgaaggatactcatgagaggtttcctagaaagaaatcaaagcttctatcttaccacatataagaagtgaatatttcagaaacattgttaataataaacaataatatgtgtttgtgttgtaaacacgtacctctaaaaatgtagtgttccttctgtggtaccaattataatcatgcaacagttacaggaagtagaagttacccaaggcgtcctattccctaacaccaaaattgtaagacttatgagaatatccctaaaaatacagtcacacatccattgtataaaagacaaatccatgtttatttttataaaactttgttaaattatattgctaacaatcacttatcaaaaattcacaaattccatatgaaatcattattctttgcctggtttatcaacacctttatttagtaaaattttacagatacacatatatatgcacacacacatatatatgtacacacatatatacagatataagttgtgttaaaattgaattactcatcctatgctagaagcaactatacaatattagataggaatatcataaaaattgccttatttcatttatacatacaggatgatgttttacaaactcttctagcaatttatcctaatagttatttcaaagaagataataaatatttctattgagaattcatttaatttttttccttttttttttttttttttttacaaacactaagacacactttgtaagtttaaaatgtatgggccaggcgcggtggatcacgcctgtaatcccaacactttcggaggcctaggtgggcggatcacgaggtcagcagatcgagaccatcctgactaacacggtgaaaccccgtctctactaaaaatacaaaaaaattagccgggcgtggtggcgggcgcctgtagtcccagctactcgggaggctgaggcaggagaatggcgggaacccgggaggcggagcttgcagtgagccaagatggcgccaccgcactccagcctgggccacagagctagactccatctcaaaaaaacaaacaaaaaacaaaacaaaaacaaaaacaaaaaacacgtatgaacagcttgagtcaaatctgccttctggcagctgggcaccaagtctgctcccccgcaggctcctgccttccttcacattgcactgctcattgtgtggttctggtcctgggacctggtggtaggggctggagaatggggattgggcagcccagttccgctctcctcatgcagtgtcctgcgtctgtcatctgcttgggttgtggcttgtgtggaaggaccacgactgaggttgccaggccagcaaagacggggtgcagaagagtctcagccagagtgatgtgctgggcagcgtccaattttaccaccctccgcatcaggtcaaacagctgcacgtgctccagagagtcttggagcatgtcactcttcagacgtttgcagttcttcacatatgggctgtcagagctgttctcatcccaaactaggccccatttgtagaaatatttctgcttcttggtacaggagatcacgcgtaatgggatgagccgtagggtcttcaacatcaccaggcgctcttggttttcacaggtctggaagagtgtgaaacctggtagtacttaaagagaaggtagcccatgccctggacatggcaggggcgtgtccagcccagatcaaggatcagttcaggcaggcgacagtgaccgtggtcaccatggcgatgtggtgcccacggtcagaggtggcattggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggttttcctgcccaggagctcaaaggtgatatgcatggaccgcggagggtgaaccagtcacaccccaagacgcacagcagctggttctcttagtccttctcgtttatttttttcgagagcgttgagttttggcggtgccgcctcccggtgcttgcccacattgcagatgaccctccggcaacccgagacgtccttctggcagggtccaagcactcacccccttgccacaggcgccttggcccaggttcccacttgtctttattgctcttggggccaatcaccgacccggccaccaggtggcgcctgtttatcatcttccgcacctgcgccctgggctcactcgctggggctgccggaggacgcgctccttcaggacccgctgcggccaccaggtggagcctctttatcatcttccgcacccgagccccgggctcactcgctggggctgccggaggacgcgctgctgcgagaccagccgcggcgtctttggcagtagtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgaggtatcagacgagaggccccctggggacggggcggttaccgcagtctcccttcttgctcccgactgtcagccctcctcccctcccatcagcagctcagggatggggctggctctggggcctcctcttccatcaacccctcagctacggggctggttcaggggactcctcccctcccatcagcagctcagggatggggctggctctggggcctcctcttccatcaacccctcagctacggggctggttcaggggactcctcccctcccatcagcagctcagggatggggctggctctggggcctcctctcccaggctcagctgccgctgggacccactcccctgagcgcctctcccctaagtaatgttattcatagcaaaaactagaaaaacacattttaatgaaataaatgttcaggttaattttattatagcatgccaactaaatgttttatactatagaaataaatatttaacaaaatatgaagatatatatgaaactttaatgaaaaatgattagcctttcacaattggaaaattaaaaacaatagtaataaatgttaaccatattttggtgaattggacatcataacatattgtaggcatacatgaaatatggtacaaacattttaaaaagaacagtgtggcaatatatattaaggaccttaaataaactatgaaattatcttctaataatacaactatttaatgttcataatttagacataaaataagcaattattatatattaataacattttttccctgacaattgagtttttttacttgattccagtcctgtaacagtctcctatccctggtgtgctaaggagttttatttcagtagagaatgagtaaaattactaatataatgatatataaaaatgtattgctaagagacgttcaaaattgactggaagtgctaatgttaatattagatgcatcaggtgctgtatttttttaaagcctgcttttacaactcataataatacctaatgtggacccaagagcagcatgaaatcagagacagtaaaaatccgaatagcaagatattattgtaagcaagagaaagtcattctgctgaacagatctgaggatgatatagaagtttagaagtcagaattcatagatttacaaatttccagattaaaatacaaaaataatctgtgatagggctaaaaaacatttttttcctgttggggatatagaaacatagaaacgcctacattgagggtagtagaagacttcatgtaaataaacatgcccacacacacatgcacacatacacactgacacacacacatatatttttcttaataaagagtgtaaagagcatggttcaatcagtgtgggattgtaaagcatacttggatgaaattggaagtggaaagtaagatattttaaacattaaccacatacctaaagtactgcacatagaaataattaggcttaaaggtaaagcctatcacaatctaaagacatgcatttgtagtggtgcgtgttcagatacctgggtattgtggtggagatacacatagtcttttgaacattccgttgtaggtcgctggtagctggatatgtcctttaaacttttgtggcaattcatttgagaagaaacgcagctttttctattgagttcttatgctataagtaaaggatgcaagacattaattagacaaaataaggtaaaattttgtattcgcttagagagtttaagaggctattagccactagtctctatagtgcctaagtaaatcgattctgcttaataaactgctacctggcttagtaagtaaacaaattgaaacttattttaggaaagaaatatatattcttatatctacatcagattctcttatgtagaaacactagagggtgaatgaggagttaatgtaagcagcatcatatttttgctcattcctttctctatgatttctgcttcttctgtccaaattctgtgaggtgtcctctagatgaaattatcacaggcatggaaaaggtcattttccacttggtccatcctcatgattgcagttgtaacatactgggactcattcattttcacatatgtatatgagacttaaatcatccacatttcaggccaggttaagtttctagaaatattctatgctttccttgcacttacactcaatcctgtcgtctacagcgttggcactgacagtgttctggtggcaatgaaaaatatgctctagagcaacattctacataaaaaaaagaataggaaaattcctttcacttgtgtattccctctatttccacattcaatgtctatagagtgttgttagtttctttggaaagaaaaccgaaccttctgtctttctaagtgtagaaagatgtggatattttcaaaaccccaataataataaagtttttacatatgtttgttttttcaatgcatgtctaaaaatgtattgttcctcttgtgggtaccgatttcaatcactcaacacactctagaaagacaaagataacctaaggcttccaccaccctcccactaaaattgtaagaatatataagaattacatttgaaatacaatcaaaccattatattaaaaacatgtactaatataatatctgtgtttttatgaaacttcctaaaattgtatttcaagtctcacaatcagtttcttttcaaaaatctacaactccacttgaaattaccattattcattgaatggtttgttttgacactttagtttcctcaagtgaaaaatacatgcacatacacatatatacatacacatacttacatacattgattgtagtcaaatcaagtttctcattctttgttggaagcatgaatacaatatttaagaatatcctgaaaattatgtcttatttcatgtatacatacaggcttatattttacaaacccttctaacaatttatcctaaaagttattgcaaagagaaaaataaatgtttctattaggaatacttttaaatggttttattaataggaaaaactagaaaaacattttaatgaggtaaatgttttaagttaattttatcaagttaactagattttgtatatttaataaatatcataaagtatttaacaaaatataaaggtatcatagcaagctttaatgggtgaaagtgttactttgccttctataattggaaactttaagacagtaacaataattgttatcaaagttttgggttgaatttaacagaaaacctataggtattccttatccaactcactgttgatgagcacctaggttgaatgtatgtctttgctgttgtgaatagtgcagcaatgaacatatgaatgcatgtgcctttttggtagaatgattttgtgtgtgtgtgtgcatacgtgcgtgtgtgtgtgtgtgtgtgtgtgtgcgcgcgctaagcaatggaattgctgcgtcaaatggtatcctttttaaattttttgagaaatctccagactgctttccatagctgctggactaatttacattcccaccaacagcatataagaattcccttttctctgcagcttcatcaacatctgtgcttttttttaaattttttgtaatagccattgtgacttgtatgaaatggtgtctcattgtggttttgatttgcatttctgtgatgattagtgatgctgagtattttttcgtatgcttgttggccacttgtatgtcttcttcagagatgtgtctgttcatgtactttgtgcattttttaatggggttgttttttgcttgttgatttatttaacttccctatatattctgggcattagatatttgtcagatgcttagtttgcaaatattatttcctattctgtaggttggctgtttcctctgttggtagtttcttttgctgcacagaagttctttcatttagttaggtcctgctcatcaattttattttgttgctgttaattttggagacttataagtcaggtagaggagtaagtatttgggttatatcatagatattgaaaggtttgctctctgaggcatgtcaaaagagagtttagatatataaagaatggtgaatggatactagactttctgatgaactagcattaccatgcccctcatttatttatttacatggtcattgtaaaggagatatggaatatgtaagaagtttgttatatgcatgatacttggagaaatagacatggaagatgaaaaaaatagatggattttggtcttgattcctcaattaaaccaacaaattcctgtggtgctatttggacagacgccgaatggagagagatagagaaaaagagagagagagagagaccttgtcatgaaagagagagaccttgtcatgaaagaatttgtgaaacaaatggacaagcattggtacctatagaacctagtgatggagtgtgactcagagctgtgtacaaaggctgtctcttcatttcattaatgaatacaatgtgtggcagggatacaggaatgtctcttattctcttcggcatcttaaagtttctgtatgtttcagattttgtggcatggagccttcctagtgagaatcccaatcatgattaattcccatttggtctcacaagctggtaaatactgggaattattgtgttactatgactgtagcctcccagtaccagtcttggtttcctttctttctgtccttcaatccagactggctttcagatacacacatacacaaaaaaactacatgatctcacttacatattgggcctaaaaataattggaataagttgcccagactggtctcaaactcatgggtgcaaatcatctggaaaccatcctcacaaaatgaataaaactaaattctgggtttttaaccaaaagcataaacttttagtagaagcatacagtaagcatgaaccagcttgcccaataacctattttgtgtggctgcttagtgcttaaaagtcatgtagcccctgtcacaaggtcctcatttcccttaattgcttctttagatatcatctttaatattaggaaacctcaagttttctacataaaatgttttctagatcctgaattccagtgggtccacggaaccagtggggctaccgagcttgtctgagaaactgactcagtgtactacatgttctacttgccaataattaaactagtaatataaattatataatattggattagtcttaatcccagtctcttattgattcctaatgacatttatgaaaataatttggtgttct

SEQ ID NO: 592 - DNA, 149644 bp, Homo sapiens
gtgcttgcattggttgcaattctgagagtcatctctgatggatggacatagataccttggccttggacaatttgtgctgactgtggagcatctgtgggtcctgtggctggcagtggaggcggtaaggagatgactagcagtgagctaccctaaggcccccttgtctaccgcctctcgtctcaaagtcctcatcctcctgtacacatgactgcatggacagccagtaggtgctttcttcttcagtttcttgaaacttgaacagtcatctgttttgctgatagattaagtttgttaaaaccctgccttgtccaagggcagtggttcatgcctgtaatctcaacactttgggagaccaaggtgggaggatcacttgagcctaggaagtcaactctgtttttcttataattctaccatccgctctccaccatggagccagactgacctttggaaaacatcccccaaccccccaccgccaaaaaaaacaaagaaaagaaaaacatcccagatcatttcattcccctgctagtgatactcccgcatgagtgattttcctttgtactttgaataaaattccaactcctgctgatggcacccaagggctgtgtgtaactggcttccgcctgcctctccagcattgtcttagatcatctccccacactccccgtgtcgtgtacatgccggcctcctttttgttcttggtctgtcttacctcagggcttttgcacatgctcgtctcagtgtctgccaaatgtatagctcgttccttatccttcaggtctgtttccaaatgtcacttccttggaggctgtttctgaccatcctgttttaaatatgcccctagttactctatcatgttagctttatttactgttttatttgtatgtttatttgtatattgattggtgttctcctcattcacacacgcaaactctcaaatgtaaatttcataaagacagggacttccccattcttgttcactgctagcagaatatctgaaactcagaatgccctcaaatatttctttttttgttttttttttgtttgtttgtttgttttttttttgagacggagtctcgctctgtcgcccaggctggagtgcggtggcgcgatctctgctcgctgcagcctccgcctcccgggttcaagcaattctcctgcctcagcctcctgagtagctgggattacaggcacctgccaccatgcccagctaatttttgtgtttttagtagagacagggtttcaccatgttggtaagactggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggtaaggatcagactgcatttggctcatggctgtgctgcactaatcgtataagattccctctcctttcagagatactgccccaccagtagctaatctaaatgttgctaagtagcatgagaagaagcaaggtggaatctcctgaattttgtttaaggatgactaataatgctcatgttctctggtttttagagagttggcaaatttcgttttccttttttttttttttttttttttttttggtggtggtgttttggtagacaggatctcgctttcttacccaggctgagcttgaattcctggcctcaagcagtcctcccaccttggcctcccaaagtgctgggactacaggcatgacccactgtacccagcaacattttagactttgacaaaaatttgcgtttgtaaataatgtggattgcatttaagcaaagtagacaactgcttgtgtttgcttaattgctaggttcttaatattgttctcattccccaagagaaatatgctctataggcttagtttctctgtgctcgccttcttttaggtcaagtattttctgctttattggcttgtaagctaagtccctttatattaatttgtaatagttacagagattacagaatggattcttataatccatcattaattaatattataccactatacaagtaatgttagattcatacaacaatattggccgggcatggtggctcacacttgtaatcccagcactctgggaggctgaggtgggcagatcacctcaggtcaggagttctagaccagcctggccaacatggtgaaaacctgtctctgctaaacatacaaaaattagctgggcgtggtggtgtgcacctgtaatcccagctactcagcaggctgaggcaggagaatcgcttgaatccgtgaggcggaggtggcagtgagcagagatcatgccactgcacgctagcctgggtgacagagcgagactgtctcaaaaaaaaaaaaaaagaatacaggcctttgactctgataattctcaacctgtgtttagctaatgttttcttattcccttttttttttttttttaagatggggtcttgctgtgtcacccaagctggagtgcagtcacactatcacagctgactgtagccttgacctcgtggattcaagcagtccttctgccatagccttccaagtagctgggactactgacatgcaccaccacatctggctggttgttgtatttttctgtagagatgggatctccctgtgttgcctaggctgttttcttttctttcttttttttttgaaatggagtctggctctgtcacccaggctggagtgcagtggtgcaatttctgctcactgcaacctccgcctcctgggttcaagcaattctcctgcctcagcctcccgagttgctgggattacaggcacccaccaccatgcccggctaatttctgtttttttagtagagacaggatttcaccgtgttagccaggctggtcttggactcctgacctccagtgatctacccaccttggcctcccaaagtactgggattacaggcgcgagccaccacacctggcctaggctgttgtcttgtgatcagacttgggttagagacttttataaccatcactgtattgagatacaatttgcataccatgccactcatccttgttaagtgctgaaatctgtttacagagttgtgcatccatcatcataaccaggtcatacatttttggcagtaagaccacagaaattaggctggactctcagcagtgcaccacatcaggaggtgtatggctgtcctgtctcacttctggtggtgataaacctggtcactcagttacattggtgtcctccaagcatctctagcacagagaccctgttttctccccttgtaatgggccagtgccctttgaggagagatggattctgagattatgccaatatcctgttcatatgagacctccacctaccgggcttagcatccattgacaactgttgcctgagtcagccaccaccgtgatggttgacaaatggtgattttttgatcatacttctacatttattatagttggcatattactgtcaggaagagatttccttctcccccatttatttactcagttatatatctgtatacacacatacacacacacacaccagtttagactcatggatttctattttatgcagtggatagttttttttttgagacagagtcttgctttgtcacccaggctggagtgcagtgacgtgatctcggctcactgcaacctgtgcctcccggattccagtgattctcctgccccaggctcccaagtagctgggattaatagttgcatgccaccacacctggctaattcttgtatttttagtatagatggggtttcaccatgttggccaggcaggtcttgaactcctgacctcagctgatccacccgcctcagcctcccaaagtgctgggattacaggcatgagccaccgtgcccggcccgcagtggatacttttaagagcaaaagtgggttttgtttttgttaatgtttttgagacagagtctcacgctgtcactcaggctggagtgcagtggttcaatctcagctcactacaacctctgcctcctgggctcaagtgatcctcccaccacagcctcctgagtagctgggactacaggcatgcactaccatgcctggctaattttttgtttttttggtagagacgtgatttcaccttgttgtccaggctggcctcaaactcctgggctcaagtgatccgcccacctcaacctcccaaagtactggggttacaggtgtgggccgccacacttggcctcataatgcttccttgatgtcaaagtctttctcctattttttgaaatccttttaaatttaattatcaggtatttccacaaaaagtgataaactaatcgcagtgtaaatgtttctaagtgggagaccctagggaggttcatttttggtttaatttgttgcttcaagattatataataccttagaattgatataaggcagactatttaaacctcacacttaaaaataattacgccagccaggcacgatcgctcacacctgtaatcccaggactttgggaggccaaggtgagtggatcaccggagatcaggagttcgagaccagcttggccaacatggtgaaacgccgtctctactaaaaaatacagaaattaactgggagtggttattcgcgtctgttaatctcagctactcgggaggctgaggtaggaaaatcacttgaatccaggaggcggaggatgcagtgagccaagatcgcaccattgcaccccagcctgggcgacagagcaagactcagtctcaaaaaaaaaaaaaaaaattatgcctcggccaagtgcagtggctcatgcctgttatcccacgactttgggaggccaaggtgggtggatcacctgaggtcgggagttcaagaccagcctgcccaacatggggaaaccccgtctctactaaaaatgcaaaaattagctgggcgtggtggcataagcctgtaattgtagctactcaggaggctgaggcaggagaattgcttgaacctgggaggcagagattgcagtgagccaagtttgtgccactgccctccagcctgggcaacagagtgagactgtctcaaaaaataatagttattattatgccttatccgtggcttgtgaaatggttttatactgccctttatgtataattattcctcttgtccatcttcactattgttctcatagatcaatgggtcttaaatctgtctgcacattagaatcagctggggagcttttaacaattaccagtgcccagacctctccccagaacaaaccagaatctctaggggtgaggccaggcatcaatatttttaaaagcttccccggggactctaatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttagaaccccccacctgctttcttgacatatgggtcccttgcaaaactgggtctttgggccctagcattactgtagcctttatattctgttgctaccacaaattagagaacatttttttcaatgtaaagtttatgtacttttgaataggcaatgtatttatatgattcaaaattgaaaatatgtaaaagaagctgggtgcagtggcttatgccggtaatcccagcactttgggaggctgaggcgggtggatcatctaaggtcaggaattcgaaaccagcctggccaacatggcaaaaccccatctctactaaaaatacaaatttagccaggcatggtggtgcacacctgtaatcctagctacttgggaggttgaggcaagagaattgcttgaacctgggaggtggaggttgcggtgagccgagattgtgccattgcactccaatctgagtgacgagcaaaactccgtctctaaaaaaacaaacaaacaaaaaaacaaaaattagctgggcatggtgacacacacctgtaatccctgctactcgggagactgaggcaggagaatagcttgaacccaggaggcagaggttgcagtaagccgagattgtgccattgcactccagcctgggtgacaagggaaactgcgtctcaaaaaaaaaaaaaaaaaaaaaagtatatatatatatatgtaaaagagtatacaggaaaaagactccccaatgttctttccttttctttctttttttttttaagatggagtcttgctctgtcacccaggctgtagtgcagtggtgcagcctcagctcctgcaacctctgcctcctgggttcaggcgatcctcctgcctcagccttctgaatagctgggattacagacgcctgccaccatgcccggctgatttttgtatttttagtagagatggggtttcgccatgttggccaggctggtctcgaacgcctgacctcaagtgatctgcctgcctcagcctcccaaagtgctgggattatagatgtgaaccactgcacccagccctcaatcttcacttctaacaaaaagctttctctctggagggaagttaagttctagttatattctctacttctataagcaattatgtgttggtaggtttgtgtatatgtgtatggatattcatttattatattttttctcttttttatataagtgggagcataccttacacactgttcttcaccttgctttttcattatgattgttccattttggtacataaagaccttttcattcttttttatagctgcataatattccattgtatagatgaattccaaaattttattttattttagagatggggtcttgctctattgcttagtctgaagtgtagtggcacaatgctagctcactgcagccgcaaacttttgggatcaagggatcttcttgcctcagcttcccaagtagcctggctaacttttatctttattttttttacttttttttgaggcggagtctcgctctgtcacccaggctggaacgccgtggcacagtcttgactcactgcaagctccacctcccgggttcatgccattctccttcctcagcctcccgagtagctgggactacaggcgcctgccacaatgcctggctaattttttgtattttttgtagagacggggtttcactgtgttagccaagatggtttcgatctcctgaccttgtgatccgcccacctcagcctcccaaagtgctgggattacaggcgtgagccaccgcactcagcctttatttttatttgtttatttatttttatttttatctttttttggtagagacacagtctggctatgttgcccaggccagtcttgaactcctggcctccagtgaacctgctacctcagcctgtcaaagtgctgggattacaggcatgagccactgtgcctggcctaaactatccagaattttaaatctgtcccatgtcattgaacatttttctcaccctgttgcccaagctggagtgcagagatgtgatcacagctcactgcaacctctaccttttgaactcaagcgctcctctggccttagcctcccaagtagctgggactgcaggcatgtgctaccatgcctggctaattttgttgttgttgttggtagagatgggttctccctgtgttgaccaggctggtcgtaaacccctgtcctcaagcagtcctcagtcctcctaccttggcctcctaaagtgctgggattataagtgtgagccactgtgcccagcttgtttccatcttttggtgttagaaacagtattaaatgagaaaccctgacctcgtattcacagatgacgtcaatctacctaatagcattttgcatccatcctgcaggctggctgctggctctaccaggttctgtgctggcatcctgagcactgccaggcacttgaccattgagcagaagatggcagactactcaaacaaactctactatcagttagagcaagaaacagggatccaaacaggtaagcaagtgtcttccatttattgctttgcctgtccctgagattgttatattcatttctgtatttggtcctctgccaggtgtgcctgctgctttggtaattaaaacttgggttggccgggcatggtggctcacgcctgtaatcccagcactttgggaggccgaggcaggcggatcacgaggtcaggagatcgagaccatcctggctaacatggtgaaaccccgtctctactaagaaattaagaaaatatgtaaattatccttactgtacttcttttgaaaataagataccaaattgcttcaactctttcttcataagaattaagagtcattgcattttaggagaattgtcattggcccaagtgtaattatggttctatatcaggtgtgttgattacagacaacaggaattggctctggccaacttggagcttgttgggaggagcttgggcctgtggagttggcaggaggctgccagctggaggcagcctggaagccaggatgtggggactgcaccgcaggcagtccctcagcgagaacaggagcagcctggcgtggctgatgctgcccttgagatggtgacctctagtcattcacctacgtgctcaagactgactcttccaggagggtctgattggataagcttaggtcacatgcccactgtttggctatactggggaagaagaagggagaatccgacccttggtagctgatgttattgtgagtggcctttgccagggattacactcccccaagactaggaggagaaagggtgaaactgcctaaaaggtgggaagaatagggatggtcgaatccctgcccaaaactgtcttttttttttttcttttttttaaagacaaagtctcactctgttacccaggctagagtgcagtggtgcaattttgacccactgcaacctccacctcctgggttcaagcaattctcctgcctcagccttcccggtagctgggattacaggcgtgcaccaccacacctggctaatttttatatttttagtagagacagggtttcaccatgctggccaggctggtctcaaactactgacctcagatgatccgcccccctcagcctcccaaagtgctgcgattacaagcatgagccactacacctggcctagaatctcatttgatcctcacaacctcacaaaactgtgagctgagaatgtttggtcagggcatggagccttagtgcatctgaagttcttaaaattttgcatagaagctcagagaagctgatttacctgcccaaggatattgagtggcagtcccaggattcatcacaggtcttctaacctataatctagtggattttccactctcctgtcctacatttggtctgatctgtctcatttgggctcatttttcttacaggttacacaaggacaggctcaatctttctggcccaaactcaggaccgactgatctccctgaagcgcatcaacgcagggctgaagtacgtaagagtctagaagcgtgtcctgactttaccacactggcctctgccaaagagcctgtgaatgtcattgtcccttgtgttctgtggcagtgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgagcaggtttttgcattttcttaagataggttagcagggaagacattacctaaggaagtgtctcacaataggaagtgacaccaactcaagtttggaaagattatcctctttggggtactcagcctccattttgaacacttataattttatttatctgttaatgagtgttttccctcagggccacatttttaaagttctaaagaactgcttttagtgctaattaatgccccttttttggagacagagcttcactcttttcgcccaggctggagtgcaatggcacaatcttggctcactgcaaccttcgcctcctgggttcatgtgatcctcctgcttcagcctcccgagtaggtgggactacaggcgtgccccactacacccggctaatttttttgtgtatttttagtagagacggggtttcgccatattggccaggctggtcttgaactcctgacctcagatgatccacctgcctcggcctccctaagtgctgggattacaggcgtgagccactgtgccctgccaattaatgccctttggacttaaggtaatattttccgccacaggacttgagaagctcaaggtgaaaacacaccttggaagtttaatccacacctgaaatcatgagcccagttgcattgaatgaggggaagacttaactagcgtccagggtatcatatccatggtatgagcaggttagcacttaaggcgcactatttacatcctctcctctctgctccatagtttatgattccaggaatttaattattgtgttccaaagtctgtttttaaactgagttgctattttcaatcttgaacaaggcccatttacatagtctcaggatgtgattctagggttttgtgttttttttaaatgaaagcattgagccgggcgtggtgtctcatgcctgtaatcccagcactttgggaggccaaggcaggcggatcacctgaggccaggagttcaagaccaggctgaccaacatggtaaaaccccatctctattaaaaatactaaaattagccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaacactgctgttcttatttaacgtttgtctccaagatttttttggtgtagagaagtaagattagtattgtgattggttatacagatatcagtaactacgctgtttcttgtagggtattctaaatcagaaacctacacttagtctgcaaatagaagcctgtgtgaccttgtccttcctccacactgggttgatgggtgctatcctggtcaggaaggccagcaaatggtcaggcattgacgtgaatccttggcactgggtcttgatgttacatttcattctataacctagcaaataacatattaggctattttattgtgtcaggaatgtggacactaatttccaggacactgcttcttttaaagcagattggctcttgccttccatgctatgatcccgaagtgaactaagaaatacttttgccatgtgaagttcatttagtgattgctatttggggtttgtagctgagcccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaatacatttttttgtttttgtttgttttgcaagctaattttagtcctaaacagaggtcattgagaatatttggactgtcttgttgactttttaacttgaatgctatggatagtagaaatgtcataggtaaacaatagacttaggtgggttcgtggttccaagcactgtaggagagggttctcacatccttttgacggtcttcatgcctagaatgggctctgcaacccccctctctgttaaactttcgcttggcacagtgggagttacgtggtttgcttgtggggactagtcaaagcttctaggtaagggataatcagagaaacagtctccactgaaaggctaaatgggaggatcttcccccgtgacctcaaaaggtattttaaagctaatgaatgcctgtgttcattgaatgttctttcattaataaagccattaatgggtgtttttgtttggttgttctgtccatttagaaagctgacttgcctctaaacccttgttttttcttccactccccactccatgtcatttctccacctcagctattgtggatgctgatggaagaatttatattcggaactggcagggtggcatcctgtctgggggctttgagaagaacccgaaaccaattttcactgagggcaagaaccagctggagattcagaatctacaggaagactgggatcactttggtatgtgaactgcattataaccgtagtgccttatatttgtttaagatgttatatttttcaaagtattttgaagaatagttccttgtttaatgtttataacatcgccatgaggtacaacagtggttacagagggtgagtttgcctggtctgaggatggagttactaggtagcagattcaggggactaaaatcttagttaatagacatttgccttattcttttttaattttattcttagttttacttttttttttttatttcttgagacggagccttgctccgtgctcagactggagtgcagttgcacaattatagctcactgcagccccgaactcctggtctcatagctttttttttttcttctttttggtagagacatggtctcgccatgttgcccaggttgatctcgaactccaaggctcaagtgatccctttcaccttggcctcccaaagtgctaagattacagatgtgagccactgtacctagccctttgtgtgtgtttagtcatctctatcattttgtgtgtgtgtgagatggcgtcttgccctgtcacctaggctggagtgcagtggcatgatcatagctcactgtagcctcaaattcgtgagctcaagcaatcctgccacatcagcctcccaagtagctgggattacaggtgcttgccaccatgcctagctaatgtttaaattttttgttgagatggggtctcgctgtgttgcccaggctggtctcgaactcttgggctcagtcaatcctgcctcagcttcccaaagtgctgtgattacgggcatgagccatgatacccagctgctttttttttttttttttttttgagatgaagtctcgctctgttgcccaggctggagtgcagtggtgtgatctcggctcactgcaacctctgcctccccggttcaagtgattctcctgcctcagcctccagagtaggtggtaggtgggattacaagcgcctgccaccactcccgactaatttttgtgtttttagtagagacagggtttcaccatgttgatcaggctggtcttgaactcctgacctcaggtgatccgcctgcctcagcctcccaaagtgctgggattacaggcatgagccactgcgtctggcctttttttttttttgagataagagtcttgctctgtcgcccagactggagtgcagtggcacaatctcggctcactccaacctccacctcctaggttcaagtgattctcatgcctcagcctcctgagtagctgggattacaggcatgcatcaacatgtccagctagtttatgtatttttagtagagacaggattttaccacgttggccaggctggtcttgaaatcctggcctcaagtgatctgcctgccttggtctcccaaagtgctgggagtaaaggtgtgagccactgtgcccagctctgcttcttttttttgtttttttgtttttttttgagatggagtttcactcttgttgcccaggctcaagtgcaatggtgcgatctcggctcaccgcaacgtctgcctcccgggttcaagtgattctcctgcctcagcctcctgagtagctgggattacagacatgcgccaccacgcctggctaattttgtatttttagtagagacagggtttctccatgttggtcaggctggtttcgaactcctgacctcaggagatctgcccgccttggcctcccaaagtgctgggattacagacgtgagccaccatgcccggcccctgcttattctttattcacctaaaattattgctcagattttaggttttaggaggagacttctttcagtaggacttcatataaaattgaagagttctttagaaaacagaattgttttgttttgttttgtttttcagaattgttttgttagtgtagtattttattaaattttaaaataattttatttatttatgtatccattcattcattttgagatggagtcttgctctgttgcccaggctggagtgcagtggtgcgatcttagctcactgcatcctccgcctcctggattcaagcaattctcctgcctcagcctcccaggtagctggaattacaggcgcccaccacaacgcagagccagtttttgtgtttttagtagagatggggtttcactatttggccaggctggtcttgaactcctgacctcaagcgatccacccgcctcggcctcccaaagtgctgggattaccggtatgagccaccgcacctggcctttaaggcctgtaatcccagcactttgggaggccaaggcgggcagatcgcctgaggtcaggagttcaagaccagcctggccaacatggcaaaaacccgtctaaatataaaaattagctggatgtggtggcgcacacctgtaacgccagctacgtgggaggctgaggcaggagaattgctggaacccgggaggcagaggctgcagtgggctgagatcgcaccactgcactccagcctgggtgacagagcgagactccatctcaaaaaaaaaaaaaataataataataatatagttacctagttccaaatttaaaaagatgaaagagtctctaatgaagaatttccctctgacccttgatgggctttctttttttaataaattcttacggaaaatttcaaacttttaaaagtggatagaagctgggcacagtggcttacacctgtaattccatcattttgggaggccaagatgggaggatcactggagcccaggaagtgaagaccagcctgggcaacatggcgagactggagactatgtgtctactaaacaaacctggcgagagtagtatgatgagcccccatgtacccattatccagctctggtctggtttcatctttttctgctgtccactggattatgtcctgatggtagatttcctttaaagcagggtgaaagtctgtcttttgcagctattccaatgcagaacattgcctttttttttttttttcctgagatggagtttcactctattgcccaggctggagtgcagtgtcacgatctctgctcacttcaacctccgcctctcagattcaagcgatttttctgcctcagcctcccgagtagctggggttacaggcttccaccatcacgactggctaatttttgtatttttagtagagacgaggcttcgccattttggccataatgctcttgaactcctgacctcaggtgatccgcccaccttggcctcccaaagtgccggggttacaaatgcaagccaccatgcccagctcagaacatcaccttttattaaaatctctgtggccgccatttaagagcttttccactcacactggtcccttcaagattattatctgtagatacgttttacttgctgttctctgctgctttcctttctaaccaatatcttttttcctcagtctttataccaagtattttgcagctatatcctgtaattctaccaaggtttctgctttgtgataaatggcccagttggctcgtctttaaaaaaatctcttccagccggacgcagtggttcacacctataatcctagcactttgggaggccgaggcaggcagatcacttgaggtcaagagttcgaaactagtgtggccatcatggtgaaaccccatctctactaaaaatacaaaaaattagctgggcatggtggtgcacgcctgtaatccgagctaattggcaggctgaggtgagagagtagcttgaacctgggaggcagaggttgcagtgagccgagatcgtgccaccacactccagccggggcgacagagtgagactccatctcaaaaaaaaaaaaaaaaaaaatcaagaggttttctgaaaggggagagtgtaaaaaagtagaggggttgaaagtggtttaattccttaaaggtgagaactctatttggttttgttgtcattgctcagagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgtggtatatttaatctagtatgttaagactaataagaagatacatgtaattttggagttgtccccttctaagtatgagaggctccccatgttccagaaatgtcatcgggcaaaatgtttttgcaactcatcttttggagttagccacagatcctgtgggatattcttttatattttttcagttataacaaatattggtcatttgagtgtgtatttgagtttggtagccaagtatgttgattgaggtaggtatttgaactaggtaatacacggtttgtttgtttttttagacagtcttgctctgtcacccaggctggaatgcagtgacatgatctcaggtcactgcaacctccacctcctgggttcaggctattctcctacctcagcctcccgagtagctgggattagaggtgtgtgccaagacatctggctaatttttctatttttagtagagacagggtttcaccatgttagccaggctggtcttgaactcctgacttcaagtgatccacccaccttggcctcccaaagtgctaggattacaggatgagccactgtgcccggccacaagtttttatttaaaaattagacactaggccgggcgcagtggctcacgcttgtaatcccagcactttgggaggccgaggtgggcggatcacaaggtcatgagatcgagaccactctggctaacacagtgaaaccccatctctactaaaaatacacaaacaaaattagccgggcgttgtggcgggtgcttgtggtcccagctactcgggaggctgagacaggagaatggcgtgaacccaggaggcagagcttgcagtgagccgagattgcgccactgcactccagcctgggcaacagagcgagactctatctcaataaaaataataataataaaataaaataagacactaatgaacattaaataagccagtcacaaaaggacaaataccgtgtggttccacttatatgaagttgctagagttgtcacatcatagagacagaaagtacaatggtggttgccagaggcgggggaggggagctattcttgaatgagcacagagttccagaaatgcaagaggaaaagagttctaggatggatggtggtgaaggttacaccgcagtgtgaatgtacccactgccactgaactgaatacttacaaatgggtaagatggtagccacgatgaaaagtttattttaaatttatgagaccagttctcttgagtgatttgtagaatggctctgaaaacagttacagaagaggagttagaaaaatgtttggagcaaaggagatgtggtcacgtaactgtataatctttaggtgacagaaaaaaacccattggatatttagagtatatttgtatgtgttttagtcttatttcttcatagatgaggcttataacttttttgaaacaagatcttactctcacccaggctggagtgcagtggcaccatcatagctcactgcagccgcaagttcctgggctcaagggatcatcccgcatcagactccagaagagctagaactaactgcaggcgtgtgccaccatacccagctcttttttttttttttttttttgaaacgaagttttgctcttgttgcccaggctggagtgcaatggcacaatctcggctcaccacaacctctgcctcccgggttcaggtgattctcctgcctcagcctcccgagtagctgggattacaggcatgtgccaccacgccggctaattttttttttttttttttttttttttttgagttggggtttcgctcttgttgcccaggctggagtgcaatggcgtgatctaggcttactgcaacctctgcctcccaggttcaagcaattctccttcctcagcctccgtagtagctgggattacaggcgtgtgccaccacactggctaattttgtatttttaatagagacagggtttctccacattggtcaggcttgtttcgaactcctgacctcaagtgatccgtctgcctcggcctcccaaagtgctgggattacaggtgtgagccacctggctcactttgaaacttttttttttctgtagagacggggtcttactatgttgcccaggctggtctcaaactcctgacttcaagcaatctcctgcctcagcctcccaaagttctgggattacaggcatcagccaatgtgtctggctggcttctatgttaaatacctcctagggaatcttatcatctggggtaaaatcctcatagtagtcttttgagagcagtacacagacccatgttcgtttcttccagaaaagttaaggaaagtgcccaaaactattcagctggtctatggcaatttaggatcttttgattctgtttgttctcgatttgtagaatattaattttctcaaatctcacacctgagccccaacacgtgccctctgtctatataggtaccttgccgaatggatggtacatggttatccctcagaaaacgtttgggaattggacctgaaacgttttggagccctccagagcagccgcacctttctgcgccaccgggtcatggaagtcatgcgtaagtgaagctttatcgcagttgctcctagttgcaggtatcttctcggtggcccgtgttgtcattcagaaggagcaaagttttcctcagttctttaacaagtgctttgagttgggcatttgatttgactgtttcaggcctgagttaaggggctttatgctcctcatgatatatacgtaacattttctttagtgcatcggaccttgtttcattctgagaacaagaaaatagaataggagttacagttggtacatagcagcttcataaatattctaagcaatgccttcttcccggtctgccttgagagaccgtatgtcgaagtgcgtgctttctgcagtctgccttgagagaccctgtgtcgaagtgaatgctttctcactcccacttagtttttgagaaaatgctttctcactccccacttagttttttctttccaagtcagagaatttgccgagttattctcagagcttcaggcttccgtgagtgactttcaccattaatccaccctacagcagcaagattgggagccacttcccatataaatacaaaacatacattcctgctctcactcccgtgttctcgccctgcttcaactttgaaggattggccacttcatcttaatttgttattctaccttgatctctgatttattttctaggaagcccttagaaagcttttgtatcaggaattgaaccaaaccacgtgggttcaagttgtaatttcattttcctgtactgaggagctgttctcagactttgccaaatggtatctaaatattttgggcatacttatgctcaggactaagtttctgtgttggctctgaccaccattcttggttgcaagtaaactgttagtttggtagttgaacaacattgttggtgaggactctggatggcctttaatgcctgagtgctcacttttggcctgggaagaggatgtacatccatggagatgaaggacctaacagcaatatgtttaactgctaaggttctttaattttagcaaatattttggttaaaatgttgaacttggctgggtgtggtggctcatgcctgtaatcccagcactttgggacgttgagggaggtaggtcacttgaggtcaggagtttgagaccagcctaggcaacgtagcgaaaccctgtctctactaaaaccaaaaccaaaaaattagccatgcctagtggcacacacctgaagtcccagctacttgggaggctgaggtaggcgaatcacctgagctggggaagttgaggctgcagtgagccatgatggtgccactgtgtactccagcctgggcagtgggactgagaccctgtctcaaaaaaataaaatacaaaatcaaagttttttgttttaaagttgaactattataagcctaaatttccctacccatagttactttggaacctgtacaaatcataattgagcttgagcttctgcttggtgatatgacacttttggtagccaattctcatgaaatagaagtggcaggcacatagaaaatggggaaggcgccaggcgcagtggctcaagcctgtaatcccagcatgttgggaggctgaggcaggcggatcacttgaggtcaggaggtctggcctgaccaacatggcgaaaccctgtctctactaaaaatacaaaaatttagccagatgtggtggtacgtgcctgtgatcccagctacttggcaggctgaggcaggacaatcacttgaacccgggagatggaggttgcagtgagccaagatctcaccactgcactctagcctgggtgatagagagggattccatctcaacaaaaaataaaaaaaaaatagaaaagaaaatgggggaggggatgatagaaccgaaagtactaggagatggagagattgtcaccatgcagagaaccccacctggcttccttctcctgtctcccaacctccccaagccttgatgtgccttttgtttgggatggtgtgagatcagggaccacagatcacactcttctggctttttttacttattgctgttgaagattagaccttaagggaaatgaattttttttttttccgagacagtcttgctctattgcccaggctggagtgccgtggcgtgatttcggctcactgcaacctctgcctcctgggttcaaacaattctcctgcctcagcctcccgagtagctgggattacaggcgcctgccaccatgcctggctaatttatgtatttttagtagagacagggtttcaccacattggtcaggctgatcttgaactcctgacctcgtgatccgcccacctcgacctctcagtgctgggtttacagacgtgagccaccacacccggcctaagagaaatgaattctgaccctagctttgttgtgtgaataatgtcattggtacaatacaatataacttctcagatttcagagccacctaatcaagctgcaatatgtaccctttcacttcagaagtgagttaattatcagggaggaaatgtctgtaacaggtctgagatcctaacacaggcacaatgaagaatcgaatgccattttttcacattttgttaccacctgtgtcccacttagtaaccttcttctctgctatgaagcttggtaaggtttaggaccctgacctttctgccatcatttctacctactaatgtggaatgctgaatgtgaatacaggccgagtcatgccgtgacacgtagctccagggagggacgatagcagcttggcaggattgtcttttccttctggagcatgcctgatacactgggtaattttgaaaattagactacattagcctggaaattgggccgggcagagtggctcacgcctgtaatcccagcacttcgggaggctggggcgggcagatcacctgaggtcaggagtttgagaccagcctgaccaacatggagaaaccctgtctctactaaaaatacaaaaattagtgtggcacggtgacacgtgcctgtaatcccagctactcgggaggctgaggcaggagaatcgcttaaacccaggaggcagaggttgcagtaagccgagattgtgccactgcactccagcctggacaacaagagcaaaactccgtcttaaaaaaaaaaaaaaactacgttagcctggaaagctcttttgaatagaaacaactccagagtctagtggacatgggctactcaggtctagaatctgtgtcttgggctttgatagactactcgtgtcttttctagctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggtaagaagtcacattctcatttttgcttcttttttttttttttgtcctgggaattaataaaacatattttcaaatgcataggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaaaaatacaaaaaattaaccaggcatggtggcgggcacttgtaatcccagctactcgggaggcaggagaatcgcgtgaactcatgaggtggaggttgcagtgagctgagattgcgccactgcactcagcctgggcaacagagtgagactccatctcaaaaaaaaaaacaaaaaacaaaaacaaaacactgatttcttaagaattctggtatattttagtgtttcatctgtattgtaacatttttctgaaattttagctccttgtttcaggtttttaatttgctagagaggcctgtttatcataagaatcaatagctagcgttccctggagcttcttgcagtggagtaggtctgcaaatgttgtcacatgggaattggctgattgaattttctcaatgaggttcattgctggtggggccatgtggcccagccaggtgctctcacgctcactctctctgtttcattccctaaccctgcagtccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcaggtgagatgagctgccgtcccgctctgctccctccaacatgttgattccttaggggtgctgtagcagaggctctcaggcgcttctccgggaaccataaatcccagagtctaagaatcattacatgaaatcaaagccagtttattagcagtcctaaacaaaagaaatcaccaggaggaaaagaaaaaaaagcccaccagattatgtaccctactgggagaagatgccttgtcttttttcttttttttttttttgagacagggtctcactttgttacccaggctggagtgcagtgatgcgatcatggatccctgcagcctggacctcctgggctcaagtgatcctcccacctcagctttccaggtagctgggaccacaggtacacgccaccacacccagccagtttttgtatattttgtagagatagggttttgccacattgcccaggctgatcttgaacacctgagctcaagcaatctgcccaccttggcctccaaagtgctgggattacaggtgtgagccactgtgcccagccgatgtcttaacgttagtaaatctgtataatttcttggcattaacaggaagccagaattttgttttgttgttaggtggtgtatcctagaatggtgctactggccttctgtgaaagctaagaaatcatttcctagtatttgcctcattgctttgaaaccaaataagatttgattgcttcctgatccttttgctgctacctggttttgattattttggggtctcacttttcagtttcttcatgatctctccaaccgaccagcaggtccactgttgggcctggcttaagaaacacatgccgaaagacagcaacctgctcctggaggacgtcacctggaagtacacaggtacgggggttcgggctctgccacgtcgaaaaggccagcagatgcagatgtgtccacgtttgccttctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgaggcaggagaatcacttgaacccaggaggcagaggttgcagtgagccccagattgcaccactgcactccagcctaggcgagtgagactccatctcaaaaaaaaaaagaaaattgagggctggacacagtggcttacacctgtaatcccagcactttgggaggctgaggcgggcggatcatgaggtcaggaatttgagaccagcctggccaacatggtgaaaccccatctctactaaaaatacaaaaattagctggacatggtggtgcatgcctgtagtcccagctactcatgaggctgaagcaggagaatcgcttgaatctgggaggcagaggttgcagtgagccaagatcatgccattgcacctccacctcccgggttcaagcgattcttctgcctcagcctcccaagtagctgggattataggcgcccgccaccacgccgggctaatttctgtatttttagtagagatggggtttcaccatgttggccaggctggtcttgaactcttgacctcgtgatccacctgcttcggcctcccaaagtgctgggattacaggcatgagccaccacgcccagtcccagagagtacctaatttttaaggatgacttggttccctgattttctcactctcagcagtctcggcttaacccctcccaccttcccacctaactgatcttgccccttggccccaccagcgtttgctctcccaggctctcattctcaattccttgtagtagcaaatatgatatacgtcctgctcctggattgggatactacagaatgttactgaacaaaagtcatgttctagcctgtcttaggatggatgacatgtaattagcacaagctgatgtcacaaacactggtgtccagaataatgctttccttatctagtaagcattaggatatgtttgaagtggatttagcttctctgaatttaaagtctgtatactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggtaagtgctgataaagttctgtttcttaaatgggcagagaatgtgtctttcatagcggtggcaggtacatattcttactatggtgttagcacccacaaagagtgtcttggctgggtgaggtggcacatgcctgtaatcctagcactttgggaggccgaggcaggtggatcacccaaagtcaggagtttgagaccagcctggccaacatggtgagaccctgtctctgttaaaaatacaaaaattagctgggtatggtctcacgcacctataatcccagctacttgggaggctgaggcacaggaatcgcttgaactctggaggcagaggtcgcagtgagccgagaacacgccactgcactccacctgggtgacagagtgagactctgtctcaaataaaagagtgtgctggccaggtgcagtggctcacgcctataatcccagcactttgggattacatcttatatttataaataaatataaaaatacaaaaattagccgggtgtggtggcgcatgcctgtggtcccagctactcgggaggctgaggcaggagaatgacttgaacctgggaggcagatgttgcagtgagccgagattgcgccattgcactccaggctggcaacagagcaagactgtctcaaaaaaaaaaaaaaaaatgtgctgcccttcattagcaaagaagtgactaagtatatttatttatttatttatttatttatttattttgagacagagtttcactcttgttgcacaggctggcgtgcaatggtgcgatctcggctcactgcaacctccacttcccgggttcaggcgattctcctgtttcagcctcccgagtagctgggattacaagcgcccgccaccatgcccagctaactttttgtatttttagtagagacagggtttcaccatgtttgccaggctggtcttgaactcctgacctcaggtgaaccacccacctcagcctcccaaagtgctgggattacaggtgtgagccactgcgcccggccttatttgtttattttttacactccaagcttgctttatttaataagcattaggatatctttgaagtggatttagcttctctaaatgtaaagtctttatgctttttggtttctgtagcactggattaaaatttgaagttacaggattatgacacacacaaaaatgcctttcgaagttaggtcccttctctccatgcagtgtggcctcttttctgtacacagagtaacttctgtgtctgtggcatcttcagggaagaaatggcgtaggtgaatctctgaacttcctacataattttctttcctataagtggcaaccacagctgagtgaaacaaactgtaaccgaatgaaagcaatgacaacggaatcctccccaggaagctgctgattagagagggccaaacggacagacatcttggccacctgtaacgagcaacttccaggtggttactgatggagactctttgaagttcacccaaagtgggatccacctacaaattgtttcacagttttccttcttctccgaggcaaagtgaaagcaacagaaaactctccactgttagctatcagtggacccctcccagcgtttgctctgctgcttggaggagtgacccatacgctcaacacctggcgagtgctgcatcctgtcagcctcctgtggaagcggttcacttcggtgctgtccaggactttccactttcctttataggaacggtgattgcgtcagtggccgctgttagggaactgagctgctatgtaacgtgttctgagaatcagaagcccatctttgaccccaggatagcagattaattatgtctgtgggcatcgggcatcatcttttgtatggcaggcggccagggtttgtctgctgattcccccagagaagacactcgccttgtcctcattgtgcctgctaccctcgactaacacaaggacctggcaaagaggaatattttgtgcttgtcaaggactttcctccactctctaccatcagcttggctaaaactcctgagatggtaacagtagcaagcagagatgtcacataggcagtgctccattctctgtgcctcaggacctggaagttaaccactttcgggatgaaattcttgccttgacgtctgtctccctcaacagtaaacagagggtgcagcactaatgaaaggtttccccaggcgtccctcccttgacaagtaatgtgagtgcccaggctgactgctgcctttgtccctgcaggagatgagtgtgggctatgcaaatgggatccgggtgatgagcatgacgcacacaggagagccaggattcatgctctacatccccatagaggtgagagggcacccttcccttcccttcccttcacttcccttcccttcccttcccttcccttcccacaaccactgtggggtgccagtgctcccagcagcgcgttcaccagcactggcaggtttggagagctgtatctgattgggccttgggagctgaggtaggctgcattgaagagatttgaccatttttaactaagttatataagtttttttgaataggtgatacatttaaaaagtatttggcgccgtctgatctgttctcaccaactgtcaccaataatattagtattacttttatatgtcatttcagatttgtatgcatattgcaagcaaattcataattaatttttttttttttttgagacagggtctcactcttttgcccagggtggagtgcaatggcatgaccgtggctcactgcagcctcgacctcttgggctcaagccaccctcccacctccgcctcccgagtagctgggactgtaggcatgtgccaccatgcctggctaatttttgtatttttttgtagagacaggttttgccatgtcgctcaagctggtctcaaactcctgacctcaggtgatacacccaccttgtcctcccaaagtgctgggattataggtgtgagccaccatacccagccaagccccctttttaaaaacagaaatggaagcatactgctattcttcatcctgtttttttttttttcacttcacaattttttttttaattgaggcagagtctcactctgtcacctagggtggaatgtagtggcataatctcagttcactgcaaccttcgcctcccaggttcaagtgattgtcctgcttcagcctcccgagtagctgggattacaggtgcacgccaccacgcctggctaatttttgtatttttagtacagacggggcttcaccatgttgcccaggcttgtttccaactcctgacctcaagtggtccacacacctcagcctcccaaagtgctgggattacaggcatgagctaccatgcccggcctcacttcacaatttctcttagagctctttctttgttggtacctaaagcaaaagagcttccttgttctttttttctttattttttaacagtggcgtagcattccattgtggtacatcattccgatactaatagacatttatgttatttctagtcttttgctgttataaaaaggtctgcaggctgagttcagtctaatcatatgcaaatagtaatagtttcttccttctccagaaccttttttttgagacggagtctcactctgtcgcccaggctggagtgcagtggcgcaatctcggctcactgcaagctccgcctcccgggttcacgccattctcctgcctcagcctcctgagtagctgggactacaggcgcctgccaccacgcccggctaattttttgtatttttcatagagacggggtttcaccgggttaaccagaatggtctcgatctcctacctcgtgatctgccagccttggcctcccaaagtgctgggattagaagcgtgagccaccgcacccggccggcttttttttttttttttcttttttttttttgagatgaagtctcacacttgtcccccaggctggagtgcgatgacatgatctaggctcaccgcaacctctgcctcccgggttcaagtgattctcctgcctcagcctcccgagtagctgggattacaggcgcctgccaccacacccgactaatttttgtatttttagtagagacaggatttcaccatgttggccagcttggtctcgaactcctgaccttaggtgatccacccacctcggcctcccaaagtgctggaattacaggcgtgagccaccgcacccgggcccatagtctttcttcctataatttccttcctttgttctattgtgacaggtagcaatcaatgattgtaggcatgcttgttttcttcttgatgttagtcatactacttgtagtgataggttttctcttaattttttttttttttgtgagacagggcattgctctgtcacccaggctggcttactgcagcttgacctccgaggctgaagtgatccccctgcctcagcctcctgaatagctgggactacaagcatgtgccaacatccccagctaattttttaattttatttttgtagaggcagggtcttgctatgttgcctaggctggtctcagactcctggactctagtgatcctctcacgtcagcctcccaaagtattgggattacatgtgtgagccactaccccgaccttatttattactattttttagtgcagtgggatgatcatagctcactgtagccttgaacttctgggcttaagcagtcatcccacttcagcttcctgagtagataggaccacagatgcccagctatcttttatttttttgtttttagacggagcctcccactgtcgcccaggctggagtgtagtggcatgatctcggctcactgcaagccccacctcctgggttcaagcgattctcctgcctcagcctcctgagtagctgggactacaggcacacgccaccacactcggctaattttttgtatttttcatagagacagggtttcaccgtgttggccaggatggtctcaatcgcctgacctcgtgagccgcctgcctcagcctcccaaagtgctgggattacaggcatgagccaccgcacccggcctatttttttattttttgtagctttgagagtctcaatatgttgcccaggctggactctaactccagcctcaaatgatcctctcatctcagcctcccaaagtgttgggattaccggcgtgagccactgtgtctggccctgttttaactatttgagccactgtgcccaaccctttttaaatgattaaagcacagataatatcagcgcatgaaatttcatctgcttttccacactcagaagtattacaacaatatgaagatgaagagattgttcaagacttgggaagaatttaaacagatgcagctgccatggttggcctgtgcaggcaggttgattctgaagtgccacccagtggttcaggtgttgtcacctgggtgcttgtggtcaaacctcatcaggaaggggaggctctgtggctctagcagcttcatccttgcttggaggccttggtttcagctttctgatttccctgggctgttcccattcttatgatttttcaagagtctaagagattatttgtgccacgcttgggttctttataagctggcttttgtccaggaagcttatgtttgtctctctgagaagaggtcttccaaaacatgggggcagatggcagattctcgttttgttcacactaaatctctggtattttgtgagaaaaacgagtaaatggtggggaactactctttgagtaaatggtggggacccactcttctctttgattttcccagcattagtcacgtagttggatctggcccaacactagtcacctggttacatcgttcttccttggtcatcctcttacctaaaggaccgggcattgagcttgaggtgggagagtaccacattccctggagatgccagctgtgtattctcctcgtcctgccgcattctgtgggtctcctgcacccaccttggctgattcaggtgtttcccttacacacataccacaggcgagtgttgcatgcaatagcttggattccttttttccacatttaaagttgtcttcccggcacggtggctcatgtctgtaatcccagcaatttgggaggccaaggtgagtgaatcatctgaggtcaggagttcgagagcagcctggtcaacatggcgaaacctcgtctctactaaaaatacaaaaattagctgggtgtggcggcagccacctatagtaccagctactcgggaggctgaggcaggagattcacttgaacccgggagtggagatggcagtgagccgagatcgcgccacttcactctagcctgggcaaaagagcaaaactctgtctcaaaaataaataagtaaataaagttgtcttgatcatagtggtctgtttggtagatgcctgttcagctacagtggtgcagttcatagaaacatactgtgctaggataaagaactgcagtaccactgaagctggttctttgctacgtcttgctttggatttcattttacagttttaaaagcaaacagtgtagtctcatttttgttggactttaaacttaacagcgtatgttcagacagggattgaatatttgctttcagtttggaaaaccttctgttcactgatctgataacgtacatgtttctgaaaccaagaaaagagcagcttgagagcctgaatgctgtgggacatgagcaggcgagccctgccttcctggctcccccgccgtcatccgatgtgtgcacacgtctcgagtaacgtgtgagagctgggcctcacagcttgggccagtacgtgagggagtaacagtggttgggaaattggagcaaaagaacaaagccagaatcagatgaagaccatggagggttggtgggctgttttagaaatgatgatgagattggccatttaccaaatggtgagagagcttctataaattattatttaagaattgctgtaagctagaatcaccacacaagacattttagagaggtgaaaagacatggatcctgttgtcatggagcttaagtccaggctggggtgaccccagctcatcactcctgggctgtgccctgagcgtgtcaaggatgagacatcctgggagttttatacgcctcctctcttgtccatgttaatagtgtgagccatcagcgcttccagacatgctccatgcttaattctgaaggtctgctgcttatgaactttctgtctcttcctatagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaaggtactgtgtttacccagactccactttcactcagcatcccgagtagtgaatctgcactagactaggaagaagaactgatgtgacaggaaaagggggaaaagattgaggccttgatgttagcatcaggtaaatgaggacaagagtgccctgagaatgaaaactttataggataaaatatcttcaaatgaaaacataataatggtggctcacgcctgaatcccagcactttgggaggctgaggcgggtggatcacctgaggtcaggagttcgagaccagcctggccaacatggcaaaacccgtctctactaaaaatacaaaaagtaggccgggcacggtggctcacacctgtaatcccaacactttgggaggccaaggcgggcggatcacaagttcaggagatcgagatcatcctagctaacacagtgaaaccccgtctctactaaaaatacaaaaaattagccgggtgtggttgcgggcgcctatagtcaggagaatggcgtgaacccaggaggcagaggttgcagtgagccgagatcacgccactgcactccagcctgggcgacagagcgagactccgtctcaaaaaaaaaaaaatttacaaaaagtagctgggcgtggtggccagcacctgtagttccagctactcgggaggctgaggcaggagaatcacttgaacctaacaggcagaggttgcagtgagccaaaatcgcaccactgcactccagcctgtgtgacagggcaagactccgtctcagaaaaaagaaaacatagtaaatagatgacacttggtcaggtgcggtggctcacaactgtaatcctagcactttgggaggccaaggcaggaggatcacttgagctcagcctgggcaatacagcaagaccttgtctctgaattacaattgaaaaacaaacaaaaaaacccacttatttctagtgttctgctgtctaaaagactgagtgctttctgggaagctattctgagttaattatggtgatgcattaacatgccacgaatatttgtacaaactagtcgtcctatagtcagctgcctaatttttgtggtttttttcttttgtttttgattttgaggtggggtctcattctgtcacccaggttggagtgcagtggcgcgatgttggctcactgcaatgccctctcatgctcaagtgatcctcccacttcagcctcccaagtggctgggaccacagatgcacaaccatgcccagctaatttttttgtattttggtaaagacagagtttcaccacattggccagggtggtctcgaactcctgagctcaggtgatccgccctcctcggcctcccagagtgctgggattacaggcgtgagacagcacacccggcctaatttttttggtttttttgttttgggcggatcacctgagttcacaagttcgagaccagcccggccaacatggtgaaaccccgtatctgctaaaaatataaaaattagctgggcatggtggcaggcacctgtaatcccagctactcggtaggctgaggcaggagaattgcctgaacctgggaggcagaggttgcagtgagccgagatcataccattgtactcccacctgggtgacagagcaaggctccatctccaaaaaaaaaaaaggtaataacccattttggaaaatataaagaaggaaattaaaatcacccatattttgtctatttaatggtagtaactattttttttttctttcttgagacggagtttcgttcttgttgtccaggctggagtgcagtggcgcgatctcagctcactgcaatctctgcctcctggcttcaagcgattctcctgcctcagtctcccgagtagctgtaagccatccagctaattttgtattttttgtctttaccaaaatacaaaaaattaggtgggtgtggtggcgcatctgtgggcccagctacttgggaggctgaagtgggagaatcacttgagcatgagaaggcatttttgtattttttctttttttagtagagatggggtttctccaggttggtcaggctggtctcgaactcctgacctcaggagatccccccgccttagcctcccaaagtgctgggattacaggcgtgagccaccgtgcctggccataatcaccgttaatagtttattctagtcttatttgttgtacatatgtgtatatatgtgtgtatgcattgaatatagatgtgcatggtcttgttgggattatataaaaaagtctttttttttttttttttgagacagagttttgctgtgtcaaccgaggctggactgcagtggtgcaatcttggctcactgcagcctctgccacccaggttcaaacgattttcctgtctcagtctccctagaattataggcacactccaccagaatcttggctcactgcagcctctgcctcccaggttcaagtgattttcctgtctcagcctcccaagtagctagaactataggcacactccaccacacccagcttatttttgtatttttagtagagatgaggtttgcctcatctctgttcaaggcgtgagccaccacgactggccaatataaaaacatttttctaaagtactggactgataaggtattttattaagtgagtgagttttcttcctaaacgtttttgttctatctggtcttgtgactttatgtttataaaataggaaacaaaatgcgtacctctgttgttacaaaaattaccgcggcgtcttttatatttcacatgcagtttttcacatggtagaaatcgcacagtttcccaaaagctggcagggttgtgggaggaggcggctgtgccccattgcagtgacaccaggggacccttcccacggtgctgctctctgtgccgagggtctgagtgtcgctggatgactcggcgtttcctttctttcttagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgcacggctgcttgtgaaatgttcttcatctgtagtgacttaaatgtgtttgccaccacaaagcataaacagcgtgcagaggagagtgtgtacctccctgtgtgtaccagtgtgagggaggatttggggacgggggtagagaagatgtaggtgtttatcttaccctccctgcagcgctggagtggctgggggtaaaagcttcccgcctcctgaaattccgaccggccttctgcctacagctgacctcaggaggaacctgccacctgatgttccacacgggcacgtgtgcactcaggtttgtgtggaaagcaaggggggtcgtgttctcaccctgtggaaacaaccctgagagaaacaaccagtgctctttttctacaccagcttccatccacaagttggtccctggacttgacctgttcactaatttttttttttgaggcagagtcttgctcttttgcccaggctggagtacagtggtgtgatcttggcttactgcaacctccactcccaggttcaagtgatttcctgccttagcctccagagtagctgggattacaggcacgcgccaccatgcccagctaatttttgtattttcgtagagacggggtttcgccaggttggccaggctggtctcaaacccccaacctcaagtgatccacccaccttggcctcccaaagtgctgggattacaggcgtgagccactgtgcctggcccaaagtaatttttgagtagtttttttttttttaagtatttgtacttttgagaatctcataggttaacatgtttacaacaatctcttcatcttgtcttctaaatcagccccttctattccagttccaggaatagtcaaccacgccagaaacctgggactcacctggtctccccactcgcctctccctacacctcccgctcattacccagcctcacagggctgtctcctcagtgcctctcctctgttcggacctcactgtccccaccactgctgctgtggcagagagggttgtcagccctgacttcgagaacaatctcttactgattttcctgcttctcatgtcatcccccctccctctgcagggttgtctttgtaaaacaggggaggtcaatttactcactgccttgaaaccctcaagggactcccctttgtcgtgagacaaagctctcagtccttagcctggccagccagggtctccagggtgtggcaggccacgctgccccagggctccggcctgcgctgcgtgtgatgtgggtcctgcagccgagtgcgtgctcgccatccacagctggatctcacctcgaatcctgctttccagtcacactgagaggtctcccactcccatatttgctcactaaaatgcctcctggcagccctcccctgtgcttgtggaaagtcgcaaattgaggatcacatggacccccactcccccaagttgtcctgacagagacctcctgtctttcatttgattgattgattgagacggagttttgttcttcttgcttaggctgctggagtgcagtggcgagatctcggctcaccacaacctccgcctcccaggttcaagcaattctgcctcagcctcctgagtagctgggataacaggcatgcgccaccatgcctggctaattttgtatttttagtagagacgaggtttcactatggtggtcattggtcaggctggtctcgaactcctgacctcaggtgatcaacccacctcagcctcccaaagtgctgggattacaggtgtgagccacagtgcctggcccctcctgtctttcaaaagctctgcccaagaccaccatcatcccacagtggagcctttccttccccaagagaatggcccctttggggtcctcacacacccgtttctgatgtgtctttatttggttatctgccctgctccttctgtaagtccctcggagaaagactcgaattctcccaaactccaacacctcacatggtgtttggtgtttaacagatgattaaatgaatgggcaaaaagtggagggcaaaatctttaaaatgtcttttaagatttaaggattttaggccaggtgcggtggctcacacctgtaatcccagcactttggaatgccgaggcgggcggatcacctgaggttgggaattcgagaccagcctgaccaacatggagaaaccttgtctctactaaaaatacaaaattaggcgtggtagcgcatgcctataatcccagcttcgcgggaggctgaggcaggacaatcgcttgaactcaggaggtggaggttgcagtgagccgagatcacgccattgcactccagcctgggcaacaagagcgaaactctgtctcaaaaagaaaaaaagatttaaggattttaaatgtttgatttttttttcttgttgagatagagtcttgctttgtcgccaggctggagtgtagtggcgtgatctcggctcactgcaacctctgactccctggttcaagggattctcccacctcagcctcccgagtagctgggattacaggcacacgccaccacgcccagctaattttttgtatttttagtagataccgggtttcaccatgttgaccagcatggtctcgatctcctgaccttatgatctgcccacctcagcctcccaaagtgctgggattacaggcgtgagccaccgcgcccggcctgaaaatttttaaatgattgtttgccgactttacaacaggacgatgttgttgttcgcaggccagtaggtggcgctgtggcacgtgatctgagcctcctggattcacacaactgttcatgtggagaacccagtgccgggacccattagcaccccagtcaggctatgcgtctccctcccaagggtgctcacctggtgtggccttcatggcacagggggagtgagatgaggctcctttagtacaccctcccctgagaagagcgacgtgtgcttaccctccagtggcttgttctcatgaaaggctccacagttagggaccttcagatgcttagatctggggtgtcacctgactcaagcagctcagaatcccagattgttgtggtgggtcaagggcatggggctttgggtttactggcctgggtctgaatgccagcattgcctcttccttggtgtataggaccttgggtggttacttttcctaggcctctgtttacttgttttaaaatggacagtgatgcctactttatagggttgttatgaaactcaactaatgaatataaaatactcgacccagactggcatggtggttcacgcctgtaatcccaacactgggaggccaaggtgggaggatctcttgagcccaggagttcaagaccagcctgggcaacttagggagaccccgtctctaccaaaaataaaaaaattagccaggtatagtggtgtgtgcctgtagtactagctacccgggaggcagaggtgaaaggatcgcttcagcccagaagttcaagactgcaatgagccgtgatcatgccaccgcactccagcctgggtgacagatcaaggccctgtctcaaaaaataaattaacaggtcgggcgcagtggctcacgcctgtaatcccagcactttgggaggctgaggcaggaggatcgcttgagcccaggagttcaagacaagcctgggcaacttagggagaccccgtctctaccaaaaataaaaaaattagccaggtagagtggtacgtgcctatagttccagttacccgggaggctgaggtgaaaggatcgcttcagcccagaagttcaagactgcaatgagccctgatcgcgccactgcactccagcctgggtgacagatcaaggccctgtctcaaaaaataattaattaaatacttgacccattgcacgatctttccatgcacgacagctgctcttctattattcttccaggatgagctgcacagcctgcccccttgggtttccaggttgtgggagatgagcaaaactgaatgacctcagtaggccaagagcaaaggatgtgggtccggacctggtggccagttgcttgtgacaggagctgggctggagtccccaagtgccactagtgctgacatcttttaactgtgttcattgtgacttgtttatttctaaaagtaaccactggcgccttggtgcagatggaactccaggtgcatgcggtgagttaaccatggtctggggagctttgtttccacgcctaggacatgcatctgtgtgcatgatatgtgagctgatatagccatgcctctggtgatttgaacgcctgcgcttcccagctgcttcagggccctgaacatcgctggatgtttgtacttcattccctcctcagcccagctggtcccactccgcagctgtgctctaggcatttcatctcaactgggtgatatatttgaatacagcaattataagaacagcaacctcagaagaacatctggcatccagacctccccagcctagttccacaaggtaccaacttccgtaagccttgaagagctaagtaagacatccgggccgggtgcggtggctaatgcctgtaatcccagcactttggaaggccaaggcgggcagatcacttgaggtcaggagttcaaaaccagtctggccaacatggtgaaacgccatctctactaaaaatacaaaaattagccgggtgtggtagtgcatatctataatcccagctacttgagaggctgaaggaggagaatctcttgaacccgggaggcagaggttgcagtgagccaaggccacaccactgcactccagcctgggcaacagatcccttggtatagatacggggagcttgggtggtctcatcacagcagaacctcagctcttggcatgttctttcctttgctaccagcttttgaaactgaagtgtagcagagtcatgaaccagactttgaaacatgaaccagacagagaaacattttaagaagtagcggctgaccaggagttggagattgcagtgcactatgattgcacctatgaatagccactgcactccagcctgggcaacatagtgagacccctatctaaaaaaaaagaaaaagaagggccaggcacggtggctcatgattgtaatcccagcactttgggaggccaaggcaggtggatcacaaggtcagatcaagaccatcctggctcacacagtgaaaccccttctctactaaagatacaaaaaattagcctggtgtggtggtgggcgcctgtagtcccggctactcgggaagctgaggcaggagaatggtgtaaacccgggaggcggagccgggcgcggtggctcacaactgtaatgccagcgctttgggaggccaaggcaggaggatcgcttgagcccaggagttttagaccagcctagacaacatggcaagaccccgtctctaccaaaaatacaaaaaattagccgggcatggtggtgcatgcccatagtcccaactacctgggacgctgaggtgggaggatcacctgaaccccggagccgtgagcacaccactgtactccagcctgggtgacagagtgagaccctgtctggaaaaaaaaaaaaagtagctgggtatggtggcacgtgcctatcgtcctacctgctcaggaggctgaggcatgaggatggcttgagcccaggaattcgaggctactcagcaattatggtaccactgcactccagcctgggtgacaaagtgagaccctcaaataaaacaaaataaattggccataaatgtaagagttttttcctgtattgttcattctgttccttgatctatatgtcttgtcctttttccatatcttatagatgtgattactagaagtttcatagcaagttttgaaatcaggtagtatacattctccagttttattctttttcaaatgtgttttggttattctaattcctttgcgtttccatgcaaattttaagatccagttttcaaattttttttgagatggatcttgctatattgcccaggctggtctcaaactccagggctcaagggatcctcttgcctcagtctcccaaatagctgggattacaggcacatgccaccaaacctggcctctcaattgctttaaaatacaacaacaacaaaaatcttttggaagtttgatgggcattgcattgaattaatagacaaatttggggagaattaccatctatcttaacaatattgagtcttcccctggccaacatggtgaaatctgtctctactaaaaatacaaaaactggccaggtgcagtggctcatgcctgtaatttcagcactttgggaggccaaggtgggtggctcacttgaggtcaggagttcaagacctgcctggccaacatggtgaaaccatgtctctactaaaaatacaaaaattagccgggtgtggtggcgggcgcctgtgatccaagctacttgggaggctgaggcaggagaatcacttaaaccgaaggggtggaagttgcagtgagcccagatcgcgccactgaactccagcctcagtgacagagtgagactctgtctcaaaaaaaaaaaaaaaaaaagaaaagaaaaaaaaagaaattagctggacatggtggcaggtgcttgtaatctcagctacatgggaggctgaggcaggagaatcacttgaacccaggaggcggaggttgcagtaggaagagatcacgccactgcactccagcctggacgacagagcaagactcagtctcaaaaaacaaacaataaaacaatattgagtcttctattccatgaaggtgaaatgtctatgcatttttttagatctttagtttctctcagcaatgttgttttacagttttatgtgtatggattttcttttttttttttttttttttgagaatgagtcactctgtcgcctagtctggagtgcagtggctcaatctcggctcactgtaacctccgcctcccgggttcaagcaattctcctgcctcagcctcctgagtagagtagctgggattacagttgcccaccaccacgcctggctaattttttgtatttttagtagagatgaggtttcaccatgttggccaggctggtcttgaactcctgacctcaagcaatccatctgcctcggtctcggaaagtgctgggattacagatgtcagccactgtgcctggccatgtgtggaactgtttcctcaatttcattttcagattgtttattgccaatgtgtagaaatgcagtggattttggtatgttaattttgtattctgagacctttattctagtagggtttttttttttttatacattcctttggattttctacagtagaattatgtcatctgcaaatgaagatagttttacttctttcttttcagtgtggatgcctttaatgtctttttcttaacttattgcacaaattgcgcattcaatagtacaatgtttagtgggaccggtgagaaaagacatccttgccttgttttgatcttagggaggaaagtctttggtctcactgttaagtgtgatattagctgtacgttttgcgtaagggctgtattcgtttgctaggactgccatacaaggtaccacacactgggtggcttaaaaaacagaatgtattttctcagagttctggaggcataaaggccaggatcaaggtgccggggggttggttccctctgaggacctctctccttggcttgtctacagccgccttctccctatgtcttcacaggatcttccctctgtgtgtctcttcttataatgaggccagtcagactggatcaggacccaccccagtgacctcatttaactttaattacctctttaaagaccctatctctaaatacagtgacacggaggtaatggaggtaggacttcaacatactaatttggggctggttgtggtggctcacgcctataatcccagcagatgacttgagctttgagaccagcctgggcaacatggggaaggcccatctctactaaaaatacaaaaattacctggcatggtggcgcacacccacagtccagctactcaggagcttgaggtaggaggatggcttgagcctgggatgtggaggtcaaagccccaggagcagaggtcacagtgaaccaaaattgtgccactgcattccagctgggcaacagagccagacttcgtctcaagaaaaatttaaaaatcaaatagacatgatttttttttagacagagtctcattctgttgcccagcctggagtgcagtggtgtgatctcagctcactgcaacctctgtctcctgggctcaagtgattctcatgcctcagcctcccaagtagctgggattacaggtgtgtgccaccatacccagctaatttttgtatttttagtagagacgggattttgccatgttggccaggctggtctcaaactcctgacctcaggtgatccgcccacctcagcctcccaaagtgctggtactacaggcatgagccactgcacctggcctaatttttttttttttcttgagacagaatcttggtctgttacccaggctggtgtgtagtggcacgattacagctcactgcagccttgacctccctggctcaggctatcctcccacctcagcctcccaggtaggtgggactatggacacgtgctaccacgcccagctaattttttgtattttttttagagacggggtttcaccatgctgcccaggcaggtctcaaactcctgagatcaagcagtccacccagcttggcctcccaaagtgctgggattataggtgtgagtgagctactacgcctggcctggacatgtaatttttaaaagaaaatgtggccacaactctcctagagttaaatgttttttttgtttgtttgtttgtttgttttttgagaccatcaacaagatttcaaggctttaaagaaaggagctgcttcaggaagagataaaatgactcaaacgctataaccttcaaatgtagactgggagaagaggtatcagctatgcatgagctggagaggggtgggatagatagagacacaggtgataaagaaaatatagcaaaatgtgaatcctacaatctgggtggtggatgtaaaccctgtagtagcctcacctggggaaagctgccttgcaacaatgaggctgcccattctccaaacccaccccagccaccgagcaggctccactaaaaagtctgaacccaggagggagtaccatggaaaccaagttgcaatgccctggttaggggcccagcagaggggtcatcccagctctacgccattggatactgagtttcaggagtgggagtgccatcctcagggtcacacagcgtgtcggttccagcctaggtcttccagtgtctcattaatcttttatccactcagcttctcttctggcccatgaaccttgctctcctgggactcttttttttttttttgaggggtcgggggtgggacagagtctcgctctgttgcccaggatggagtgcagtggtgccatcttgcttcactgcaacctccgcctcccagattcaagcaattctcctgcctcagcctaccgagtagctgggactacaggcacccaccaccctgcccagataatttttgtatttttagtagagacaggatttcaccatgttggccaggctggtctcgagctcctgacctcaagtgatccgcctgccttggcctcccaaagttctgggattacaggcgtgagccatcacacccggcctgggactcttcttgcagtgagccagggccatgggacccttcaaaagttgctccaccctaatccccaaaatatctttttctcccgcctgtcccaagtgcctggcatcatactatatgggtcaactggccatgtttgccatggaagcccaattgtaggaagtgggtcttttatcacccggcatagcagagctgtggaaactgcactgggaaagatcaggatgtgaattaaagcgttgggaatgggaaggcagagaccttggattagctgggatgctccatgcactcgctgagtgaccttggacaagccccttagacacactaagcccgtttcctcatctacacgacgggcatcccatctgctactgcaccaggttcttgtggcaataacttgaactcacacatgcaaacaggctttgtgagctccataaacacaggtggctcggccaggtgtggtggctcatgcctgcaaccccagcactttgggaggccaaggtgggaagatcccttgagcccaggagttggagaccagcctgggcaagacgatgaaatcctgtctctaccaaaaaaaataataataattagccaggcatggtggcacacacctggtcccagctccttgggaggctgaggtgggaggatcacttgggcccaagaggtcaaggctgcagtgagctgagattataacactccaacctgagtggcagagtgaaactgtctaaaaaataaaaataaaaatacatcaaaaaacaggtagctattaagcattgctaggacccacacgcagtgaccctgagggtgctgggtttctgtttgagggagaagaaactcctgagcccctaggtattgtgggggacatgcagttccagaccgccttcatggcctgtatgcctggcctcatccccatccctggcacccatgacgatagccacattccactggtgtttccccaggaaagccaaccctacctgcatctcagcagagcttccacggagttggaaccccgctccgagagggtgtgggctcaggggccaggggtcacacaaactccagaaggaggacgtagttggtttgcaaggctgtcctttgccctggttgaataacctttggtcttccccgagaggaacgtgggcattaggctgcagcccacaggaagctatgtattttctgagaaacttggcccatggtgcagatctgctccagctcactctggtgggatcacgccagccacggccgggccacggcacatcatggcaacgtgctgcccacctgctacgccacctgtttttctagaggcggacgtgatcccagcaggactggagtcagcccagggcatcacgtgctctggtccccgcctgctttgactcctcctgcctcactccccccctggcctgtagtcacgttggtgagggtggtgggcaccggggctgggcccagcccccgaccctgcccagacagactttcctaaggcacccttttcctcgtgcaggtgcggcctcagcccacccccctttgagcccacagattgcacccctctggtgtgcggttacctcttgcctatgtttaattcatggctggggggttgggacgagcttcccaagaaaggaaagaactcccctggggtcttgcccagtttctgctcaccagaaggaccatagccgaggtcctcctcccagggcccggggctggggagcggaagccatcagtgggctcggaggacactgtcccagccaggacacggccatcggtcactaatctgcagcactggaatgtccgcaggccaatcagcggggtctctgggggctccccaagggtgctaataatcccacaatgattagcaggggccgcgggtcagtgcacgccactctgcctgctgtcgggggcgggctggccaggccgaggccggagcaggcaggcatcccccggagttgtctcttttcatgccagcgccaacaggaggctgtctggacacactgattactcactcaccagcctccctcttttgtccaccagcccagcctgactcctggagattgtgaatagctccatccagcctgagaaacaagccgggtggctgagccaggctgtgcacggagtgcctgacgggcccaacagacccatgctgcatccagagacctcccctggccgggggcatctcctggctgtgctcctggccctccttggcaccgcctgggcagaggtgtggccaccccagctgcaggagcaggctccgatggccggaggtaagggacacctggtgaggaggtaggtggaggcaccattatgagctctgaggagtgggtgctaggagacttctggaagcccggtcccaggcctgagccccaggccgtgcgggtggtttaatgaggaagccctgggacagcccgggggcggtgaggggtggatgctggactggggaggaaggaggaggaaggaggaccagggctggggtcaaggaggaacgccgaggagcgctgtggctggggcctggagaaatccgtggcccggaggagccccagacaggggcctgcgggagccagggctggcccctacacccagcccgcaccgctgttccctcccgccaccccaaccccagcactcagcccacgcctgctgtacctggtctctctctcagcctcgctccattgctatgccccacgtcccctgcacccaccacactcctctcccatcttgttttccaagggcagggacacatgcttattctgccgtgtgttgggttcaggtccccccatcctcgggctgcctgaccttctctctccaccccagccctgaacaggaaggagagtttcttgctcctctccctgcacaaccgcctgcgcagctgggtccagccccctgcggctgacatgcggaggctggtgagtacccgacccagctgggctctgccaggggggtggccggaggcgcggaccccagagggcggctcaggaggccacgcctgtccaggtgcccttccacttgaccagggtgggcaggcacagccagccaccttgcccctgagggacggaggccctggttgctgggggtctctgcagtttcttaaccccccaccctcagttcaggaggtcgggccccttggctcccactcgcctgaagggcaggaccttgggccttccctggcatcttgttgccacagagaccaggagccacaggaggagccggatcccctcctccagggaaggggagcttcacgaggagccctgcaggatgggcggccgggccagggagggagaaggtcgtgctgggctggggaggggcttctgtgcggcaaggacccagcgcctcctcctgagcttatctgagccacgaggacgggccttgcccatgttctctgctcactcactcgtccacattttccacattttcagcaggggccgggggtcgggggtatagagttccccaccagcccggctggggctgcggggttgggactgtcatctggaggctcagaaacgctgccctccattgtctgggaccccagcagccccagcccatgttagcaggccagggagccagggcagggtggtgggggcgggagggttccccatggctgcttcccatgaactcctccaaggcaggtggccacagtggcgaccttgagcactctagggtcagtttcccaggaggtgggggtggggtggctaaatgcggggggtcgcttctcccccattcccagccctgagtggctctgcctctcctcaggctcagaccctgggcaaccaggggtgctcccagctgtgacctccgtggttgggtactcctgcctgggaccccaggaggggctgcggtggtcgttggctggcagctggcaccctttccagggcccttttgtcaaagtcttagaaaacttcatttccataaaggtgcaaatggagctccatggctcagcctccctcgtggcccggccccgagcaccctccgggcctctagggctccagggcaccccttctttggacacagtggagactgaaggtcttgtgggggtggagggctgctgagggaccccggggagcccccagctcctggccccagccttcatcagaggtaaaaccccgatggacattagtgcaggatgaagttggcttggggtgcagccccgaggggcccccctccctgcatccactcagtgcttgtgagtcctatcctgcaggcacctccctgctccgtttacagatgagctcagggagtctcgggagatcaggggactgcaccaagtcacccaggggtggtgattgccaggcccacttgtttaagaagagggagggggctgggcacggtggctcacacctgtaatcccagcactctgggaggctgacacaagcagatcacctaaggtcagcagtttgagaccagcaatggccaacatggtgaaaccccgtctctactaaaaatacaaaaattagccaggtgtggtgtcacatggctgtaatcccagctgcttgggaggctgaggcaggagaattgcttgaacctgggaggcggaggttgcagtaagccgggatttctccactgcactccagcctgggcgacagggtgagactctgtctcaaaaaaaaaaagaagagggagggggcggggtcagctgtgcgtggtggggagcatatgaggccaggctcctgggggcaggagactagggcagagaggcgtggctgtagggctttttgcatcacaggagggcagcatggccgggtgggagcagtggagcctttctgacaatggccagggcccaaacacagaaccagtctgcaacgcgtgggcactgctcacatgaccagatgggagaaagacagcaggagcgggtcccactgcctgggcagggccgaaggatgcccacgacaggatttggagatggaggctcagtcgtgagaggagctgggctcctcctggagggacatcagacaacaccagtgcttcctccagcaggactcctcatccagtgctctctttgccacctgacctggcacccggtggatgctcagagatggcaggggagttgaatctttgaggcctggcccagcagtcaaaggcctcccacagatgtctgtttgtgctgcccccaggactggagtgacagcctggcccaactggctcaagccagggcagccctctgtggaatcccaaccccgagcctggcgtccggcctgtggcgcaccctgcaagtgggctggaacatgcagctgctgcccgcgggcttggcgtcctttgttgaagtggtcagcctatggtttgcagaggggcagcggtacagccacgcggcaggagagtgtgctcgcaacgccacctgcacccactacacgcaggtgagtgtgctgcaggtgaggccagcgtgccagctcccagatacagacttccactggtccatctcagaagaggctacagtttgtcctaaatgttgggattccttttcctccaattggtttagttttactttttttttttttgatacggagtcttgctgtgttgcgcaggctagagtgcagtggcgtgatctcggctcactgcaacctccgcctcctggactcaagtgattcttgtacttcagcctcctgactagctgggactacaggcatgtgccaccaggcctggctaatggctttatacttttagtagagatagggttttaccatgttggccaggttggtcttgaactcctggcctcaagtgatccacccacctcagcctcccaaagtgctgggattacaggcgtgagccactgtgccccgccacattttttctttttttggagacatggtctcagtctgtcaccccaggctggagtgcagtggcgtgatctcagcttactgcaacctccgtctcctagattcaagcgattcttgtgcctcagcctcacaagtagctgggattacaggtgtgcgcctctacacccagctcatttttttgtatttttagtagagacagggtttcaccatgttggccaggctggtctcgaactcctgacctcaaatgatctgcctgcctcagcctcccaaagtgctggggttacaggcgtgagccaccatgcctggcctaagccactttttttcaatctgaaatataaataatttcaaacataaacgtatttatttatttatttgagacgaagtcttgttctgtcacccaggatggagtgcaatggcttgatctcggttcactagaacctctgcctcccagattcaggtgactgtcctgcctcagcctcccaagtagctaggactacaggcacgagccaccacaccccactaatttttgtatttttagtagagatagggtttcaccatgttggccaggctgggtctcaaactcctgacctcaagtgatccacctgcgtgggcctcccaaagtgctgggattacacgtgtgagacaccgcacccagcctcaaacgtaaatttaaaacggccccactcttacccactacctaggtttagaagatgctactaaactaaagccctgctcctccccttttcccgctgtccctccctggagggaatcttcccaaagttcaggagcatcactgccaagcaagtttccattttttctcttcattcaacaaatatttgttgagggtcttctacacacacctggtgctcttcagatgcactgaaaaacacaagcaaaatcccaggaaatatttaatacctccactacctgtgcaagtgggttgtgcatgtttaaatattacacaaggctgggtgcggtggctcacgcccgtaatcccagcactttgggaggccaaggtggcaggattgcctgagcccgggagttcgagaccagcctgggccacatggaaaaaacctgcctctacaaaaaaatacataaattacccaggtgtgatggtgtgcgcctgtagttccagctacttgggaggctgaggtaggagaattgctggagcctgggaggtgaagattgcagtgagctgagactgcgccattgcactccagcctgggcagcaggagtaaaaccctggcttagtaaaaagaagaacatgtgcccctacaactaggtgctgccaaagtgcttacgccaactgtgcagaccagcaaaccagttcccacttcccgaagatcttctggctccttaatttttttttttttttttgagacggagtcttgctctgtcgcgcaggctactgtgcagtggcgcgatctcggctcactgcaagctccgcctcctgggttcacaccattctcctgcctcagcctccctagtagctgggactgcaggcacacgccaccacacccggttatttttttgtattttgtttagtagagacagggtttcaccgtattagccagggtggtcttgatctcctgacctcatgatccgcctgcctcggcctcccagagtgctgggattacaggtgtgagccactgtgcccagccttggctccttaagttttgtcagactcaaaggtgtgaaaaacctaactctgttttgttgttggtggttgttttttgtttgttttgtttttgtttttgttttttcgattcagagtcttgctctgttgcccaggccagagtgcagtggtgcgatcacagctcactacaacctccgcctccccagttcaagagattctcctgcgtcagcctcctgagtagctgggattacaggcgcctgccaccacacctggctaatttttgtatttttagtactcctgacgtcaggtaatccacctgcctcggcctcccaaactgttgggattacaggcttgagccaccacgcccagcctctattattgtttctaattttcttgatgtgaatgtttagatcattaattttaaatcattttttgtttctactatatacatttaaagctataaatttccctttaaacgatttcagctgcatccaataagttttgatgttttttctatttccaatcatgatgttgtttttgtttgttttgagacatggtctggctctgtcgcccaggctggagtgcagtggtgcaatctcagctcactgcagcctcaatttcctgggctcaggtgatcttctcacctcaggtccggagtagctgggactacaggtgtgtgccaccatgcctggctaattttttgtatttgtaatagagatggggttttgccatgttggccaggctgatcttgaacttctgaactcacatgatccacccaactcagcctcccaaagtgctgggattacagatgtgaaccaccacacctggccatgatgttgttttagattttgaagtgtatctttaagtttctaaactatgttatcttctctatttacttgtaaattatttactttaaatttcattgcattgaattcatagaatgtgggctgtaggatgtgctgattctttgctatttgttgaaacttgcttagtggtctaatgtatggtcctcctttctggtttgcaaaagtcccatgcattcctaaaaacgatacatattctttaagtgttggatacatgtatatgatcacatgttcacatctgcctgctacaagccagtcttgtacatgtcatttttagtctctactggagagtttgtttcactcttcttatatattgcccatttgtgctatttccaagctgttgctgattctaagactttaaactggtttgcagacctgtatccattaggttttattgcatgacatactaccccaaaatttagcagcttacgattctgcaggtcagccacttgggttgggctcagcagggaggttttctggtcttggctgggcccactcatacacctgcaatcaactagggggccggctgggagctggctgtgcaaaaaggcctctaatggttcatctctgttccatgaggccttccaaactcctatactgagtttgttcatgtggtgactgagcatggttctatgagaatgagtggaaatggcaaggtctcttaaggcctaggttcaaaatcggctcagtatcacttctgtggcattctggtggccaaaccagttacagagccagccagattcaaggagcaaggaaagagacacctctctttgctgcaaaaagctgcagagtcacatttaaaggagtggcctggtgcaagaaatgaatggttgtggtcaccatgcagtcacaaggcccttgatgttccagtctttttttggctactcccctccacccatcaacaatctcccctcatttcaggtacctcccctctccatccccctctcaactaagaaagccttcctaggccgggcacggtggctcacacctataatcccagcactttgggaggccgaggcaagcagttcacctgaggttgggagttcaagaccagcctgaccaacatggagaagccctgtcgctactaaaaatacaaaaaaattaaccgggcctgtaatcctagctactcgggaggctgaggcaggagaatcacatgaacccaggaggtagaggttgtggtgagccaagatcaggccattgcactccagcctgggcaacaagagcaaaactccatctcaaaaataaataaataaataaataaataaataaataaataagccttcctgaactattcccacccatgcttctacccctgcccaggacagctgctgctcctgagccctcgaggaggtaagggagccctctgttcacctggatgatagcgaaagctgtgtccccctccccaggggtggttcacaatagggtttctgatcccctgtgtctcctgtagctcgtgtgggccacctcaagccagctgggctgtgggcggcacctgtgctctgcaggccaggcagcgatagaagcctttgtctgtgcctactcccccaggtaagccctgctacaccctctgctgggatgtctgggagacagggaggggtgctttcaccgagggtgagattcccacacatccacccgaaagtagagtccctgatgccttgctctgcacccttggtgggagaggggaggagaggaaaggcagagggtgctaaagattctggccacgcagaaggtgctgctctgcggatgtcccttcctggatactggtcctggtatcagggagtttgtccaggattggtttggaggccatctcttctctcccagggaatctccctatctcacccagctccctgactccctggcctggccgcaggagctgaaggggccaggggggcaggcagcagggccctgcctctgccttgcccaaggccaggccctcccacaccctgtggtgcctgctcgtcctcacagaggcaactgggaggtcaacgggaagacaatcgtcccctataagaagggtgcctggtgttcgctctgcacagccagtgtctcaggctgcttcaaagcctgggaccatgcaggggggctctgtggtgagtgcatgagggctcagtctggtgaccctggggtgggggtggtagcatcctactgggctgtcccagaagccctggcccttagcacccagggaggctcctgcccggcctgctgggaggagacccttttctcagagtcccctcctcctctgaccagaggtccccaggaatccttgtcgcatgagctgccagaaccatggacgtctcaacatcagcacctgccactgccactgtccccctggctacacgggcagatactgccaaggtgagggcactggagcctgggtgtgcccagccctgctctcgtggcaggtcctagggctgctacacttcctgagagtctcaagggtgtcagaggtgctgactgtgtactccctgagtctgcccactgcatacattctttcaacaagcattcactgagcactagctgtttgccagaccctgagctgtgcaggagattcaaagtgaaatcaggttcagccccttaggctctgggaggaggacagaattaggacccagaagtggattcttgccctactgcccctctaccctaacccactctgtgaccatgggcaggtcacctcccaaactccaatatgcctcactctgcaatggggaccaaaccaaagacaccaggcgtgccagcaatcggaagccttggtgggttctgtctatgggaggggtattcttgctgtggttggcattccctggatgttcgaggcctctggggggcagcgtggggtccagaaggctgggggctgagcctctgccccactgccctgccctggcagtgaggtgcagcctgcagtgtgtgcacggccggttccgggaggaggagtgctcgtgcgtctgtgacatcggctacgggggagcccagtgtgccagtgagtcctgccccagggcccccaaagagccagctcctctcaagaccccccttcaatggggcatcagctcccaggagcccgctgtgtgcctctctttccaactcattcagtgacaacacgttgagatcttgaaactggccacagcatggatatttacaccaaagaaattggcaaatgctataaaccatggatttttttttttcttttgagagagagcaagctcaatattccaacttaccagctcgctcctgaccctcaccacccactcttttggagcaggtggccagaggaaggggcaccctgagcttagctccccggcagggcaggaaagggcagggattctgaagtccacacacaaactcaggctcccctaccccagccaaggtgcattttcccttccacacctgtgacctgaggatcgacggagactgcttcatggtgtcttcagaggcagacacctattacagagccaggatgaaatgtcaggtgacagtcacccctagcttcctaggaaccccctagggcctcaagtgagggtcttaatgcagggaccctggagtgagaggtggttccttccacgtctctgacctcaccctattcatcagcataaagcaggggtcgtggactccaaggctcatagaagccaggaggtcacttattgacctgaggggccaaggtcaagaccaacctccatctaagggagttccagccactggttgccttgcaggaatgcaaggtcagggtggccagagctcggggttgttcaagaaaaccagcaacccagacttccactggcaactctcgaaaccacaattaattactggggttggcaatcaacttggatatatttaagacactgtgcaggtgaaacagaacctcctcaggggccagaccttgcctgggcttgtgggctgctggtcgcgcccccgtgcacagggagaagagaagcagacgggagcagaagggacccctgctcttggaagggaggctgtgcgggctgggggtgatgatagcccggccagcacacacacgtggcatcttaggccatgggcaggggtggcaggaaggggcagcctgggctctgggagccttgcctgtgtgacccagggtggggttacagaggaaaggcggggtgctggcccagatcaagagccagaaagtgcaggacatcctcgccttctatctgggccgcctggagaccaccaacgaggtgattgacagtgacttcgagaccaggaacttctggatcggtgagtgcccagctgattgggggtatggcgagtaaggggttgtgatgccccaccctgctgcaggaaccctgggccatggcggctgccagcagatggcaagggtgtgttgagggcctggagcccagagcggggccagctgctcaccccctttcccgggaagggcccaggtagggagcacatgggggctgccagcgctgggaagaggggccagaaaggcagctggcagcagactccagggtctgagtgggccaaccttgactaccccggcccagggctcacctacaagaccgccaaggactccttccgctgggccacaggggagcaccaggccttcaccagttttgcctttgggcagcctgacaaccacgggtaagtgtggggtgcctccctcccctgggcctccttctcacttgggcctgcctggtggagccccccatcccgctgcctggctgggccctttgagggtctgatccttccctggtgcctgcccaggtgccagagagttgtgggcacagctggtgtgggccggtggtggggtgagggagatgcaagccggaaggcacgtcacgtgggggagagagggacccaggaagcctccatccatctgtccatccccagtgtcccctggtgtgactccatccctccaattctcatccactcacccctccgtctgcatgccctctgcctgcatcagttacactgatgccagcattccttagctgtcacccacctgcactcattcacaatacaaccctgcacctgcagacccaccagccatcctgtagcaagaaccctctggtcacgtggccccaccctgctcttcaaagcccagcaatgcccagggccagggtggaggtggtccggctgcgaggccaccaagggctccagcgatttcagccagccctccttgccaacagccggcctgtgcccctggcctcttgcctggaggaagtctgggccttgttgggttcccaggtgtacctctcaagtgggctgtctattccagtccccaccatccccacaggctggtgtggctgagtgctgccatggggtaggcagagctgttaccccaggaaggggcttccctgagaagtggagcagggctgggggcttggggacgggcctggctcccggcagccccgtcggcaggtgggggcactggagcccctgagatgcagggtcctgatgggtggagggcttaggcctctcccggatccctgacttcactcttgcctcctgaccaccacaccatggcctgcaggtttggcaactgcgtggagctgcaggcttcagctgccttcaactggaacaaccagcgctgcaaaacccgaaaccgttacatctgccagtttggtgagggacttcctgaggctccccttctctgatctctgaccctgggggtgctgctgacccggtccagcctgcaagggtatctaggtggcaggttcagagtgggtctgggcacacggggccatagaggatgccctgttgatggccttgtacctgtgggctcctgagcccagaggggcaacgacgggcccagcttcatacagcaaggccacgcaggaaggactagagctacagctctgcaggggatttctccaaggaccctctcctgtcatgaaagctgctgcctgggaacctgttgggttccttggtgttcccgggagccccatgaactgtggtggaggcggaggtgaaacctagcatggcaccagctcccagcagcctctgctaggaaggcctggagcgccacagggaccacggccatgggcacttccagaccgagtgcaacagggctgccatcttgggactgcctgggctgccatcgagccctgctctcttctgcttccttccagcccaggagcacatctcccggtggggcccagggtcctgaggcctgaccacatggctccctcgcctgccctgggagcaccggctctgcttacctgtccgcccacctgtctggaacaagggccaggttaagaccacatgcctcatgtccaaagaggtctcagaccttgcacaatgccagaagttgggcagagagaggcagggaggccagtgagggccagggagtgagtgttagaagaagctggggcccttcgcctgcttttgattgggaagatgggcttcaattagatggcaaaggagaggacaccgccagtggtccaaaaaggctgctctcttccacctggcccagaccctgtggggcagcggagcttccctgtggcatgaaccccacagggtattaaattatgaatcagctgaacctgtgcatgctcatttcaaagggaaattcagatgatccaggatgaccctggagagaccagagggggcctgaggcttcactgcagcggcctccacccacctattccctttcctggtcaccttcatggtccaggacactctctggaagttctgggtctccccaagaagaggaagaccagactctgcctcagtgaggggcagttctcatggctggggcccaggcaggcagggtattaatagaagttgctctgaatgtctgggagacgacgcgtgtgtgttgcccccaccggcggagtgtcatcgcaccagggccaatggtagtcagagcctgtgcagtcccgctccctcacccagctcctcagacatcacccacaaggggttatcactgtcccagtttacagcggaagaaatgaaggcagagagattgagtaacttgcataagatcatacagctgggagtcaaacccagtgagtctggctgtcatttatttattttttttcttttcttttcttttttttttttttttttttttttttgagacggagtctcgctctgtcgcccaggctggagtgcagtggcacgatctccgctcactgcaaactccgcctcccaggttcacgccattgtcctgcctcagcctcccgagtagctgggactacagacgcccgccaccacgcccggctaatttgttttttgtatttttagtagagacggggtttcaccgtgttacccaggatggtatcgatctcccgacctcgtgatccacccgcctcggcctcccaaagtgctgggatgacaggcgtgagccaccgctcccggccctatttttttcttttttgagacagagtctcgctttgtcgtacaggctggagtgcaggggtgcaattggggttcactgcagcctcgaactcccaggctcaagcgatcctcctgcctcagccacccaagtagctggaaccacaggtccgcaccaccacgccccgctattttttgtgttttttgtagggacggggttgcaccatgttgctcaggctggtctcgaactcccgtgctcaagcgatccgccatcctgggcctcccaaagtgctggggttacaggcatgcggcccggcgccggcccagtctttccctctcccactgcttcccagggcttcgcctgtctaaccgggcgcgggcagttgtcctgtgtcctggctcagcgcggacctacgcggggtggtcacacagatgcccccagctctctctacctcccgcgaaggcgctgagccccctgatccctgcccgggcactggcgcaaggtcgcctgcgagcgccaggccttcctgcccggtgggagacgggagggcccgctctccggctcggtctggttcccgggtcagccagcagccgcgcctcttcctcccagacccgggacccgccccttggccggggccgcggccgcagcgcccggaggggccgccctgcgcatgcccgcgggaggtgggtgacccgggagcgcgctgcccgaggccggggggcggtggggacagcacaggcggggcggccgaaccgagaccttcccaccccgccccacgcctggttggggacctgacgcgccgtcgtgagtggggcgggtgcaggtgtccctgggggccgggggcagacactggtgcgggacgacctgctcccgagggggtccgcaggccacacccagagaaactggggcgcctccagtcaccgccgcggtccgccccgccggaggctttgaccccctgaatcagcgtcggggcagggatccgcgtggggtggaagaggctgggaaacttgggagtcccgggcctcctctggagccgcccgcccttggctggctggtccttctcttcctcggctcccgccgggctgggccctgggccgccctcactccctcccctctgcagcctcccttgcgtttgtcattcactctgccaggctctccttctgcctccgcatgcccaacgatccggagaaaaacacggaccatgacatcaaaaggccttggccaaggaatcgtgattattgtgatacaagattctgcacctcaaaggggatccctgtagtgagttttggaaaacgtacaaagcctgacttacaatatgcctgttatctgtggcgtttcatctggggaacttacttttccttgatagggtaaactattctcatccagagtatgtccctcagtctgtaaaagtccatggtgccctacatctattaggggagtgaggaagggcagtgggcattggatctgcttctttgaaagcccccacctgtgtttagcttctgttagaggcctttgaaccagagcaactccatcttgagtaggcgctgggtaaaatgaggctgagacctactgggctgtgttcccaggtggtggaggcattctaagtcacaggatgagatgagaggccggcacaagcagtaaagaagccgcggccaaaacccaccaaaaccaagatggtgatgcgaatgacctctggtcgtcctcactgctacactcccaccagcgccaagacagcttacaaatgccatggcaacgccagaatgttaccctatatggtctaaaaaggggaggcatgaataatccaccccttctttagcatataatcaataaataaccataaaaatgagcaaccagcagccctcggggctgctctatggagtagccattgttttatttctttactttttttttttttttgagagggagtcttgctcttgctcaggctggagtgcagtggcgtgatctcggctcactgcaatctccgtctcctgggttcaagcgattctcctgcctcagctttcgagtggctgggactacaggtgcccaccaccatgccggctttttttttttttgtacttttaatagagacggggtttcaccacgatggccagggtggtctcgaactcctgtcctcagatgatctgcctgccttggcctcccaaagtgctgggattatatgcgtgagccaccgcgcccagccctattcctttactttttttttttgaggtggagtctcacacctggcctccaatatgtttattcatattgctgaggcaggggattgcttgagcccaagagtttgaggttgcagtgaaccatgatcataagctgtatttcagcgtgagtgagagattgagaccttgtctcacaaaataaaagttaaaaagcccttatctggaggtgagaaagccaaatacaaaggtcttctcagttggttcccagtcttcccagtccagcagcctcagcatcaccagggagctggttaggcaaattctcggcggccccaacctactgaattggagaccctgaagatggggctatctgaattttaacaaggcctccaggtttgcatgctcaagattgagaaccactggcaaaagcaaacaatttgaatctgaagtcagcccacctgcatttgaatacaggccctgccacttaataactgtgatttagagcaagttagttacttaacagctaggttgaccaattgtccgagtttgcctggcactatcctgatttcagcactgaaagtactacattatcgctgtggctcacgcctataatcccagcttctcaagctgtccctgtggaatcctcaatatcggtacattcatccctatctagcatccccttcctccctcacccatcctgcaccctcagaattcattctcagatcagcttcccagatttttgccaatatcaattaaaaaaattttttagccaaccatgtactgtgagtaagccaatatcaattagcaaaatctttaagtttcttttggtgattcagtatcttccccctggagttttttgatgattcagtaccctcctagatttggcccctggggcctgcggggatgtgacttgtcatttaattctggagaaaatgaggggtagggcttataaggagactccttcggggcagggtcattacagggtgtgttacatagggaaatgctagctgctggctagctctcgctcttgaaaggctcttcctccctcaactgaaatggggaagggggaaccccggccgactgaggtcctgacatctttagcacatggcttcttaggtcacccagggcatccaggttaccagcttgggaaacaggagatgtaggttggaggaagaggctacagcccaccctggaaataactgccatccgtcccacccatatggttaggctttgtgtccccacccagatctcatctcgaattacaatccccacgggttgagggatggaccaggtggaggtacttgcatcctgggggcagtttcccccatgctgtgctcgtgacagtgagtgagttctcacgagatctgatggttttaaagcgtggcagttcctctttctcgtgcttacatcctcgtaactatcctgtggagaaggtgtctgctttcccctacctccatggttgtaagtttcctgaagcctccccagccgtgtggaactgtgagtcaattaaacttctttataagttacccagtctcggtgtttgcttttttgagatggagatttgctcttgttgcccaggttggagtgcaatggcgtgatctcggctctttgcaacctctgcctctcgggttgaagctattctcctgcctcagcctcccaagtagctgggattacaggcgtgaaccaccacacccagctagttttgtatttttagtagagagggggtttcattatgttggtcaggctggtctcgtgctccaagcctcaggtgatccgcccacctcggcctcccaaagtgctgggattacaggcatgagccaccgcacccaaccttggatgtttctttatagcagtgtagaaacagactcagccgtcgctgcaggccatacctcagctacatagaacacctaactgcccgcaagggagttcctgctactaggatcttcagagtgacaaagaggaagctttggctggcaagggtggtggggaggggaggggctaggtacctaaggcttccctatctttccacacagcctaattttcatagcctctggtctccacatttcactctttcccaaataaagaccttttaaggtgtgggtccccttggtcattctgtaaccattggatcaagttttcagttttttctgctctctcagctgcaaaataacacattcgagttttggtttttttttttttggagacaaagtctcactctgtcgcccaggctggagtgcagtggtgtgatctcagctcactgtaacctctgcctcctggatataagcgattctcctgcctcagcctcccaagtacctgggattacaggcacccgccaccacacctggctaatttctgtatttttagtagagacggggttttgccattttggccaggcacactcgggttttctaaccataccttgagccaagaatttggattctgagcttgtcttttcatttaagctatgtggcgctgttagcatgaccgccctgcccagcagatcttgacttcagtgtaatctttattctcttctatggcaggagccattaggtcccccaaagccttgcctttgatgggtactttgttcccggggacaatgggattagctgtcttgccagggcgtgccatggggctgctggtgtcctgtcccttaataccagctggattttcactgtcctctgaccactttccagccttcaattgctcctgtttcctttggggcttcttgctctgtccagtcctggtcctatttttgtgagaatcaaggttcttagttttaaccaacagaaactaattctggcaactctaaacagaaagggacttggtcagaggtcctggctagttcccaggagctcaaaagggtcagaaaatcaaatcaggaagaggacattgggcaaagctggccaggtgaagaccccacagcctctgctggcacagaagctacaattggcaccaccgaagtgggacagaagctgccacctgtgcaagctagatgtagtcgctgccgctgtcaccatcaatttttgagatgatgcttcttcctgcctgccactttaattcaaagcgaaggccaggtgcagtggctcatgcctgtaatgccagcactttgggaggccaaggcaagaggatcgcttgaggacgggagtttgagatcagcctgggcaacagggtgagaccccgtctagccaaaaaatacaaaaaaaaagagctgggcagaaagaaaatggctcatgcctgtaatcccagcacttcaggaggccgaggcgggtggatcacctgaggtcagaagtttgagattagcctggccaacacggtgaaacactgtctctactaaaaatacaaaaaattagtcaggttgggtggcgcacgcctgtaatcccagctactcaggagactgaggtaggagaatcgcttgaacccgggaggtggaggttgtagtgagctgagatctcaccattgcactccccgctgggtgacagagcaagactagtctcaaaaaaaaaaaaggggccacgtcgatggaaggacaagaataaagaaactgaggccgggtatggtggctcacgcctgtaattccagcactttgggagtccgaggtgggcggatcacctgaggtcgggagttcgagaccagcctgaccaacatggagaaaccctgtctctactaaagatacaaaaattagccaggcatggttgcgcatgcctgtaatcccagctattggcgaggctgaggcatgagaatcacttaaacctgggaggcggaggttgtggtgagccgagatcgtgccattgcactctagcctgggcaacaagagcggaactgtggctcaaaaaataaataaataaaaaatagagacattgggccaggcacagtggctcgtgcctgtaatcccagctctttggaagaatgaggtaggaggattgcttgagcccaggagttcgagggtgcagtgatcacgtcattaaactcccacttgggtgacagagtgaggagctgtctccccacccccatcccccaaaaaaagaaggtaactgggcaaagaagttatttttagtagagactggctttcatcatattggccaggctggtcttgaattcctgacctcaggtgatccacccacctcggccccccaaagcgctgggattacaggtgtgagccacggtgcccaacctcctcttctcatttaatcctcaaaatcatctcacaaagcaggtgctattaatacccgcgtcttacagaacggttaacagatgtgtccagggccgcatggagaacaccttgagagagcaatgagatctcgctctcctgcctcatgaccgatacacggtttcaagaagttagatgacatcacagatactcagggcacccagctccaggccttactgccttcgcacaaggccgctctctactagcttcaccccgcatggaatgcaatggtcaatgaggccctggtcagaacatgggactgacaaagccagcacttgtaggctgagtctcagatcacgtggcttgtttgttttgtttgtttgtttttgggagatggagtttcactcgtgttgcccaggctggagtgcaatagcaccgtctcagctcactgcaacctccgcctccttgttcaagtgattctcctgtctcagcctcccgggtagctgggactacaggtgcatgccaccatgcctggctagtttttgtatttttagtagagatggggtttcatcacattggtcgggctggtttcgacctcctgacctcaggtgatccacccaccttggcctcccaaagtgctgggattacaggcgtgagccactgtgcccggctggcttttttttttttttgaggagtcgcactctgaaatccaagctggagtgcaatgatgtgatctcccaccatgctagttgtgtttgttgttgttgttttttctttagtagagatggagtttctccatgttggtgaggctggtcttgaactcctgacctcaggtgatccaccccccacctcggcctcccaaagtgctaggattacaggcgtgagtcaccatgcctggcctcaatttcttgaaagacaaagaaaaaagacagaaagagagaaagaaagaaaaagaaaaaaaagagaaagagaaagagaacaagaaaaagagaaggaaagctccatgggtttaaatgcaagagtcagcttcaaggagggctgggaagtcaggtgacgccacccttgtgcttcccgcagccagatcacctggtggaggtaccgttggttttgggcccctctctcagcacttgctaccagagaggacagctctacaccagagagtgagggtgggaacctgctcactgctgtctgctcagggctgggcatgaggcaggtgctcagtaggggtctggagaataaatgaatgaaccatcacggggccaagcacctggaagcgggctggagatgcttgctctggactcctggctcaggagtggactccccaggtggacttcctcctgcatcaccacagctgagtgcatggagcacaggtagggcagctaatgagcagggtcatcatgaatgacagcagatgacaccaggacaggggaggtcagtagccagatgggaagaaagcagaatgaaacaggtcacccgggtgcagtggctcatgcctgtaatcccagcatttcgggaggccgaggtaggcagatcatgaggtcaggagatcgagaccatcctggctaacacggtgaaaccctgtctctgctaaaaatacaaaaaattagccggacgtggaggcgggtgcctgtagtcccagctactcgggaggctgaggcaggagaatggcgtgaatctgggaggtggagctagcagtgagccgagatcgcaccactacactccagcctgggcgacagagcgagacagtctcaaaaaaaaaaaaaaaaaagttctggcggagagtgtgggtgagcactagggtactggaaagattccatgcctgggaatcgtgcgtggattgattacatccccacttctggcaaaatgcttcatggccttgtgcaagttaactttgtctccctgggcctctgtttactcatctgagaaacggggtaaagacatttgctcttcttaggtcacagggctcctgtacacgatgtgaaaggactttggaaagtatcctccggtgtgcaaatttctctgagaagtgctgtggctgtttatccttagactggaatgagaagggggagatgtgacttttgtgactttcagggtgggccaggtgttgtaggtgacaggacaatctcaggctggtagcagtggctcatgcctgtaatcccagcactttgggaggctgaggtgggtggatcacttgaggtcaggagtttgagaccagcctggataacatggttaaactccatctctactaaaaatacaaaaattagccaggttggggtggtgtgtgcccggagtcccagctactcaggaaggtgaggcaggagaatccttgaacccgggaggcggaggctgcagtgagccaagattgctccgctgcactccagcctcagcaacagagtgaaactccatctcaaaaaaacaaagacaatctcagatgtgcagttcacaccctggggctctccgtgggatcaggctgagggtcgcatttaactgaaatcttcaggagttcagcgtcggggtagatattccctgagaagcagctgagaggtaaagcttcctccgggaagtactcacttgctccttgttgatttcatggggtctcaggtttcaggaggaaagtaaagatgaaaagcccttgctctggcatcttggaggacttctgggtgagagccaggaaggggaaggcgtttggactcattgccctcccaggcctggagtctgattttcctgctctgtctggttttggaggtggaggctgcgaagccgaagcagtgctggtcctgccagctcctcccagctcctcccctgccctctgcttccctggccttgcacagggacaaggagctccaaagagcggctctgtcctgtctcagcctgggagggaagagggaggtggcatagatggttccacaaacagttcagtacgtgccaaaggagggcctgggaagccccaggtcaggagagggtgcctgcccttcccgtgaaggccagggctgagctgcttcctgccagcatccagttttgctcagagcacccagaacgccgtcttggaggaacgggggcaggcgctgccgcagaaccctggagctgtgtctcctgcctccagggctggccgtagctgcaaagaccagctggcaggtggaggactcaggaagactctccctgtgttggccctgcagccccatgtccccttctctgcttcttgggaacaggaggcctgtgtctgcctgtcctgagcatctcaaaaggaaaagctattctagggatgatgagagggaatcagggcctgaggcacttggaggaacatttgctgagctccctgtgcaacagcccattccaaggccaaggttgcaaaggtggcttagatgctgtccctaaatggccatcgaggttccaagcctggcaggaagggctcgagtggtggggccacagcggagacaaggccaagcagcctgattcttgggagtggaggttaatgagcagcgtttgcacttggctttctatagggtcaggctgtagtgcaacatcctgaggtgcgtggctgcccacaggtgctcagccagcccagcctctgccaaggcagacagagcctgggctgggaagcgggggatcccactgcttggggagtccccttttcttctgcatagtggggatgccaggagcagtgaacaagctcagcaaagagttctccagcccgacccgaggtttccttcctcctgactttgtcacctcactgggagaatatacagctctgtctgaaacaagtttcctgcggggcaccctgtgcaggggaagctcgggcagcccaacctaccagatggaagggaaagatagaggctgtgaggttcttctgggcctgtctacagcctcttctacctggctgccctttgttcagagtaaaggatgcagttcccaagacataagcaccgcgggcttcagagtatgaaggatccttccaggtcagccactttgggcaactggtgagcaaggcgggtgtgcagggccggctacatcatttgtggggcctggtacagaatgaaaatgtggggcccttattcagaagttactaagaatttttttttttttagatggaatctcactctgttaccccggcgggagtgcagtggcacgatcttggctcactgcaacctctgcctcccgggttcaagtgattctcctgcctcagcctcccgagtaggtgggattccaggtgcccgccaccacgtctgggtaatttttgtatttttagtagagacagggtttctccacctggctggtctcgaactcctgacctcaggcgatctacctgccttggcctcccaaagtggtaggattacaggcatgtgctaaaaatttcaagatgaggacagcagagcataagtgaagcgcaggacccttgcaagtgggtccgtctgggtgtgactgcatttggggagaaggggatggggtcctgcctgtccctgcagtcacagcataccacgagtcctggggcagaggagcctggattcaggcccttggtgctcagcggtcctggctcacggacacccctcgttcagcagccagggggttcctcactgtgtcccagatgtcactctaaagattgcttcagaggctccctccccgaatcgttggagggactctgccagttccaatgaccagccagctgccttcaggtcacaaaagaatctggggctggtctgagaccaggtgtacccccagaccccatctctgtccagatcatgagagggggtccagggtcccccgcctcccacagttgggcttcactgcacagctggaactcagccaggcctgttccgggaagcagggctgtgagtgtgagcagtccaggaccttggcattttgaacaaagaattgaacaaaacccacaaagtaacatagcaatgaaacatgggaaggaagcagtgaaagcaggaatttatgaaacagataaagcactctgcagggctggagtgggcctaagcaagcggctcaagagcctggttacaaagtttcctaggtgttttgttagtttgtttttgtattttattttttttattattattatttttgagaagtctcttacccaggctggagcgcagtggcatgatcttggctcactgcaatctccgcctcctgagttcaagtgattctctggcctcagcctcccaagtagctgggattacaggtaagtacccaccacgcccggctaattttcatattttttgtagagatggggtttcaccatgttggacaggctggtcttgaactcctgacctcgttaatcggcccacctcggcctcccaaagtgctgggattacaggcacgagccatggcacccagcctcctgggttttaagtactgcttttgaggttctattggctaccccttatctggatgaaggatttggtctgtggctcataaaaggctaatgtgaactggcgccctgtgcagatgaagggatgacccatgcttcgcctgcggctaatccaggacactctcccttcccatctaagatgtggtggagacaggagggtgatagggtgtctctatattaaaaacacacacacacacacacacacacacacacacacacacacacacacacacacacaaaggcagccagactatgcactaggaactgccctgggaatcccgttgcgttctcacaacaatcccacttcacagataaagaaaccaaggcacagaaatattcagtaacgtgtccagatgcggtggctcatgcctgtaattccagtattttgggaggctgaggcaggcagatcacgaggtcaggagttcgagaccatcctggccaacatggtgaaaccccgtctctactaaaaatacaaaaattagctgggtgtggtggcaggtgcctgtaattctagctactcaggaagctgaggcaggagaactgcttgaacccgggaggcggaggttgcagtgagccgagatcacactactgcactccagcctgggtgacagagcaaaactctgtctggaaaaaaaaaaaagaaaaaagaaatactaagtaacttgtctgaggccacttagttaccaagacgtgggagctgggacttgaacccaggcagtctggctggattcatgcctgcagcctctgcactcctgctacttcctgtgtgagaagcgcctgttctgtggaaggttgtgggctgagatctttccatgacttccactcatttacccccaaggctgttcttaaagacgggcatgacagttatgcccattttacagatgggaccctgaggctcacaagggcatgccactcacccatctccacaaagctatagctcgtcagcagagggcagaattcggccgcctctcccctagctcgaaggctgtgattgacacagaggtttttttgttgttgttgctgttgtttgttcctttttcttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccatgcccagctgttttttgtagagatggggttagtagagatttgtttaatagagacgaggtttcaccatggtctctactaaaccctgtctctactaaaaatacaaaaattacccaggcgtggtggcacatgcctgtagtcccagctactcaagaggctgaggcaggagaatcactcgaacctgggaggtggaggttgcagtgacccaaaatcatgcactctggcctggggtctcgcttttgcccaggttagagtgcagtggcacaatcatagtggcttactgcagcctcaaactcctgggctgaagggaatcctcccacctcagcctcccaagtagctaggactataggcatgtgccatcatggcgagttaattttttgtgtgtttttattttctcgagacagagtcttgctctgttgctcaggctggactgcaatggcgtgatcttggctcaccgcaacctccacctcctgggttcaagcgattctcctgcctcagcctcccgagtagctgggattacaggtgcgtgccagcatgcctggctaattttgtatttttagtagagacagggtttcgccatgttggtcaggctgctctcgaactcctgacctcatgatccacctgcctcggcctctcaaagtgttgggattacaggcatgagccactgagcctggcctggggagctaatttttaaatttgttatagagacaagagagacaagagtctctcttatgttgcccaggctggtctcgaccccgtggcctcaagtgatcctcccacctcagcctcccaaagtgctgggattacagatgggtgtcaccgcagctggcctctgaggagggtttcattataaacctgccctgaagggagggaatccaattttacgagagggtgtagcctggtgaggcctggatgacctccgcaggcaggggcttgtgcctgggctgaggcctaagggacaatgggcagacatgaagttgccccaggcagagggtacagtgtgggcaaagtcaggaagtggcagggcttggatcactccaggaagagagaggactcacgtgtcacaggagctcgagacccagagagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggaggactgcttgcgcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagtgacagagagatacgctgtctcaaaggaaatacaaattaaaaaaccagccgggcatgctggtgtgtgcctgtagtctcagctacttgggacactgaagtgggaggatcgcttgagcccaggagttcaaggctgccgtgagctatgattgtgcctgtgcactccagcctgggcgacagagaaagaccctgtctcttaaaaaaaaaaaaaaaaaaaaaaaatcttagaggatgctgtgcctccctgggggtcttcagtcacccatggtcctggcagcagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcaccaccatgccacccaccccgagtatcccctgggcatcctggcatagccagatgacttccgtgcccgttgcaataaccactgcttccaactctctatagaccaccccttgggtatatctaatgtaagtgatatttattttatttattttttgagtcagagtctcgctctgtcacccaggctagagtgtgctgatgtgatcttggctcactacaacctctgcctcctgggttcaagccattctcatgcctcagcctcccaagtggctgggactacaggcatgcaccatcacgcccagctaatttttgtatttttttcagtagaggtggggtttcaccaagttggccgggctggtctcaaactccccacctcaagtgctctgcccgcctcggcctcccaaagtgctgggattacaggcatgagtcgtggtgtctggccctaatgtgagtgatctttaacaatgaagacttgaaaaagaaaaccctgaagaaacctaattctttgatgtctggacgacaaggaagaagatagatagaagtggcatcagataataaacagtgtaaatgtttatcagaaagaggctggtggttgggaccagtaggaggatcgcttgagtccaggagtgcatctctacaaaaaagttaaaggattttttaacattggccaggcatggtggcacacatctgtgatcccagctacttgggaggctgaggcaggattgcttgaagcccaggaggctgaggctgcagtgagctgtgatcgagccactgcactccagcctgggtgacagagcaaaacccagtctcaaaaaataataataatattttacataaccaaccacttctaaagactaaaaaaaaaccctacaattaaaaacctcaggtccctcaggcaatcataccagatattgaaacaaagcaataacataaggactgcagtatttattttatttttatattatttatttattctttgttagtttgtttttggagtgtgggttttgttttgttttttgatttttttcttttgttccacccacagatttcttcttattgcccaggcttgagtgcaatgacctgttctcagcttactcaacctctgcctcttgggtttcagtcatttttctgcctcggcctcctgagtagctaagggaggagtcttgagattatcatccacggagggtggaagaggagagggtggaaggggaataagaagacactccagtgaagcacttgccttgcgtgcaaaaatgtaagggggcctctccctctccctctccgtctccctctccctctccctctccgtctccctctccctctccctctccctctccctctccctctccctctccctctccctctccctctccgtctccctctccctctccctctccctctccctctccctctcactctccctctcactctccccacggtctccctctcatgcggagccgaagctggactgtactgctgccatctcggctcactgcaacctccgtgcctgattctcctgcctcagcctgccgagtgcctgcgattgcaggcacgcgccgccacacctgactggtcttggtggagacggggtttcgctgtgttggccgggccggtctccagcccctaaccgcgagtgatccgccagccttggcctcccgaggtgccaggattgcagacggagtctcgttcactcagtgctcaatggtgcccagactggagtgcagtggcgtgatcgcggctcgctacaacctacacctcccagccgcctgccttggcctcccacggtgccgagattgcagcctctgcccggccgccaccccgtctgggaagtgaggagcgtctctgcctggccgcccatcgtctgggatgtgaggagcctctctgcctggctgcccagtctggaaagtgaggagcgtctgcgcccggcagccatcccatctaggaagtgaggagcgcctcttcccagccgccatcacatctaggaagtgaggagcgtctctgcccggctgcccatcgtctgagatgtggggagcgcctctgccccgccgccccatctgggatgtgaggagtgcctctgcccggccgagaccccgtctgggaggtgaggagcgtctctgcccagccgccccgtctgagaagtgaggagaccctctgcctggcaaccaccccgtctgagaagtgaggaggccctccgcccggcagctgccccgtctgagaagtgaggagcctctccgcccggcagccaccccatctgggaagtgaggagcgtctctgcccggcagccaccccgtccgggagggaggtgggggtggtcagcccctgcctggccagctgccccatccgggagggaggtcgggggtcagccccccgcccggccagccgccccgtccgggaggtgaggggcacctctgcccggccacccctactgggaagtgaggagcccctcagcctggccagccgccccgtccgggagggaggtgggggggtcagccctccacccggccagctgccccgtctgggaggtgaggggcgcctctgcccggctgcccctactgggaagtgaggagcccctctgcccggccagccgccccgtccgggagggaggtgggggggtcagccctccgcccggccagctgccccgtctgggaggtgaggggcgcctctgcccggctgcccctactgggaagtgaggagcccctttgcccggccagctgcccagtctgggagggaggtgggggggtcagccccctgcccggccagctgccccgtctgggaggtgaggggtgcctctgcccggccgcccctattgggaagtgaggagcccctctgcccggccagccgccccgtccaggagggaggtggggggggtcagccccccccgcccggccagccgccccgtccgggaggtgaggggtgcctctgcccggccgcccctactgggaagtgaggagcccccctgcctggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaagaaaattaaaaaaaaaaaaaaaaaaaaaacaggctacctacaatttgtgttgaagatatgaatgaatgaagtttccacacccttatgtggagttctgataagtaagcaacaataaggaagggtccccaggttggggagaccccaagttgagaacaataatgaacaattattgtatgaacaattgttagagacagctaatcacaaacaacctgcgggcacaatgaccccattccacacgtagcacccttcagcaggaccctataaaactctcctccagcccttgcctctttgcaggtagccccttctgtgctgagctgcccattgcaacatattttcataatttctctaataaatctgcccttctttacctacaactatcttggtaaatggctttaccacctgcaaaactgaccctaggttgttgctacccgatatggtttggctgcatccccacccaaatttcatcttgaattgtagttcccataatccccatgtgtcatgggagggacccggtaggaggtaatcgaatcatgggggcaggtttttcccatactgttctcgtgatagtgaatacatctcactaaatctgatggttttataaagggcagtttccctgcacgtgctctcttgcctgctgccatgtaagacatacctttgctccttctttgccttccaccatgattctgaggcctccccagccttgtggaactgtgagtacattaaacctctttttctttataaattgcccagtttcgagtatttcttcatagcagtatgaaaagtaactaatacactacctgagacaccttaggagatttgtaatagctgtaatgccaggtccaccatatttttagcataaagcaaatgtttacccatgatatgactgcacaggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccgtctctacaaaaaatacaaaaattagctgagtgtagtggcacacacctgtagtcccagcaccttgggagggtgaggcaggaggatctcttgaacccaggaggtggaggccgcagtgagcagtgatcatgtcagaggtgtgtgaaccagagcaactccatcttaaataggagctgggaaaaatgaggctgaaactgctgggctgcattccctgatggttaaggcattctaagtcacaggatgacatagaaggtcagcacaaaataccagtcgtaaagaccttgctgataaaacaggttgcagtgaaggagctggccaaaacccaccaaaaccaaaatagtgacaagagtgacctcccatcatcctccctgctacattcctacaagcaccatgacagtttacaaatgccatggcaacatcaagaagttaccctatatggtctaaaaagaggaggcatgaaaaatccaccccttgtttagcatatcatcaagaaataaccataaaaatgggcaaccagcagccctcacggctgctctgtctatggggtagccattcttttattcctttactttctctttttcttttgagatggagtctccctctgtcacccaggctggagtgcagtggtgcgatctcggctttctacaagcttcgcctctcgggttcatcccattctcctgcctcagcctccagagtagctgggactacaggcgcccgcaaccacacttggctaatttttttgcatttttagtagagacgaggtttcaccatgttaaccaggatggtcttgatctcctgacctcgtgatccacctgtctcggccccccaaagtgctgggattacaggcgtgagccaccccgtgcccctcctcctttactttcttaataaacttgctttcacttcacactgtggcatcaccctgaattctttcttgcacaaaatccaagaaccctctcttggggtctggattgggacccctttcctgtaactatcatgccactgcactccagcctgggcaacagagcaaggccctgtctctcaaaaaaaaaaaaaaaaaaagtaacgtgacttaatacattcattttggagggtaagtctctcaaaataggcctttcactgggggaaaatggtaaaaatactccctggtaattcaagaattggagactcctgagatgctgctcatattagctgaacacttatcaatacttcactttcttccatatatactcaaggaacaagtgctatttaaagtgtttcactctgctgtgctaggtgcaagactataaagaggtgtgaggatcaacacttttatgaaaaccaatgtcattctgaatatagtttcagatgctagtgcaaaggaagctcttggtatacggaaaaagtattcaacaataaattaggcatggttgcttccattttctgcctcacatacctttttttcatggttaaagtgatataaagtctatgatattttagattggcagttgcaaactagtggtcctcagcgtgctttttatgacacctacaaggtttgaagactctgatttcatattaaaaatctgggtttcaggctgggtgtgatgttgcatgcctgtaatcccagcactttggaaggctgaggcaggagaatcgcttgaaccagggaggtggaggttgcagtgagccaagatcacgccactgcactcaagcttaggcaatagagcaagactccatctcaaaaaatgaataaataaataaaatctgggtttcaggccaggtgtggtggtgcactcctgcaatcccagcactttgggaggctgagatgggcagacagcttgagctcaggaattccagactagcctgggcaacgtggcaaaaccccatgtctacaaataatacaaaaaaattagctgggtgtagtggagtgtgcctgtaatcccagcaacgtgggaggctgaagtgagaggactgcttgagcctgggaggttgaggttacagtgagctgagatcaccctcctacactccaacctgggcaacagagccagaccttgtcttaaaaaaaaaaaaaaaaaaaaaaaaattctgggtttctggcatctcaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaattgaagcttcgtctgtatttctggctgctcctcattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagttccctatagactttgcttcctaccgtcttacgttctgccttataggcatctcagtttgcaacccttgtttttgtcagtatgctacgctggtgacattgaccaaattgaccacacattaatgataagcttagttggtgatgacctcaacggaataacgtgacataagtattgtgacaatacttcttgcatgtatctacaggtggaattgtaaacctggtggtccgagatggtctaattcgatcttcctatgtatctccttatattaatagtggtaacatttgtggtggtgattcagcgtttcaatgcctcttctcacggcaacaacaaacgttttccttctgaatcaacattaacctagatgttactgcagatcaaaattagtatctacattttcaaccacagaaatattgggcagtaaaaatttttcttaatattgattgcctacataggttgtgtaattagcatatgtttatagttctatgatttgtgcctggctgctacagagctggagggggtaaagcaacagtgttttctcagttgtgtgagcagcattacattataataaataggtaatattaaactgggctgatgagagttgcaaaagactactttaatgttcatatggaaccaaaaaagagcccgcattgccaagacaatcctaaacccaatgaacaaagctggaggcctcatgctacctgacttcaaactatactacaaggctacagtaaccaaaacagcatggtactggtaccaaaacagacatatagaccaatggaacagaacagagccctcagaaataataccacacatctacaaccatctgatctttgacaaacctgacaaaaactagaaatgtggaaaggattcccgatttaataaatagtgcttggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaacaaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatccagaactagaaataccatttgacccagccatcccattactggatatatacccaaaggattataaatcatgctgccataaagacacatgcacacatatgtttatcgcggcactattcacgatagcaaagacttggaaccaacacaaatgtccatcaatgatagactggattaagaaaatgtggcacatatatactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttttgtggtgggggagggggaagggatagcagtaggagatacacctaatgtaaatgacgagttaatgggtgcagcacaccaacatggcacatgtgtacatatgtaacaaacctgcacattgtgcacatgcaccctataacttaaagtataatttaaaaaaataagtaaataaataaaaaaagaaacaattgctggctttgcaattctctttcctccaaaatcaccaaggcctcaatttactcattgctgaaaaaggacgactgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccacttcttagtcctttaatacctgtttttctccttctcttattcagaccgtgtgtcttctgtttagtttctcaattcatacaaaaccatatccaggccatcaccaataattctatatgacaaatgctccttctaacaaccccacagtatcagcccttaccccaaaatctttcttcagttgaatctctcccactgtaggttcccatgccgcccctaatcccgctcgaagcagccctgagaaacatcgcccattatctctccatatcacccccaaaaattttcgccaccccaacactttaccactattttgttttatttttcttattaacataagaagacaggaatgtcaggcctctgagtccaagctaagccattaagccatcatatcccagtgacctgcatgtatacatccagaaggcctgaagcaactgaagatccacagaagtgaaaacagcctcaactgaagacattccaccattgtgatttgtttctgccccaccctaactgatcaatgtactttgtaatctgccacactcttaagaaggttctttataatctcccccacccttaagaagtttctttgtaattctcctcacccttgagaatgtactttatgagatccacctcctgcccccaaaacattgctcttaactccaccgcctatcccaaaacctataagaaccaatgataatcacaccaccctttgctgactcctttttcagactcagcccacctgcacccaggtgaaataaacagccatgttgctcacacaaaacatgtttggtggtctcttcacacagacacgtgagacaggagttcgagaccagcctagccaatctggtgaaactctgtctctactaaaaatacaaaaattagccgggcatggtggcgggcacctgtaatcccagctactcgggaagcggaggcacaaaaattgcttgaacccaggaggcagagtttgcagtgagccaagatcacactgtctggcatctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactgttcaatatactttgtaatctcccccacccttaagaaggtactttgtaatctccccaacccttaagaaggtcctttgtaattctccccacccttcagaatgtactttgtgagatctacccctgcccacaaaacatggctcttcaccccctatcccaaaacctgtaagaactaatgataatccaccaccctttgctgactctcttttcggactcagcccgcctgcacccaggtgaaatgaacagccatgttgctcacacaaagcctgtttggtggtctcttcacacggacgtgcatgaaacacacgactgcacttcaggctgggcgacagagctagattccatctcaaaaaaaataaaaaggagtcacctcccctgagaggcctctggaccaacccatctgagcaggccactcttccttctctatcttaccatcttgtttctgtcccagtagttagggctacctccagtaatcctatttgtccctttactgtttagtgcgtctcacttgactagaagctccatgaaagcagagatcctacctacctccttcaccactagacccccagggcctggtatgtggtgatcgctcagggcccattttcttcctttcctcctcctccaagggtggggaaagagcatcagaaggtctaggtggccccaggcccaaacaatcctcctttaaaaggaaaccagattgttacaaaggtcagaggctgaaaagttatttccgccttttatccctctaaattcttcacttcctgaaaaaacaaacaaaaaaaagccactgagggcccttggactaaatccaggcctgagttgctgggcagaggtcagtcttgtccagacatgggaaaaaaataactcgagtcagacaggtgggtcaccagagaacgaatccagcctgcaaatggtgtgtgcaatcttcagctctgtccagacctgcctccctctggggatgcctttaaaggtgatgaatgacctggatgaatgggcttagaagagggaaaaacaaatatcacaggtcaaatcattatttgtcttcaagtttaacaccgtctactggactgaaagatgtccaaagaatagttgttcaactatgtaaattcctttttttttttttttttgagacagagtctcgctctgttgcccaggctggagtgcaatggtatgatcttggctcactgcaagcaacctctgctcctgggctcaaaccattctcctgcctcagcttcccaagtagctgggactacaggcatgtgccaccacgctcagctaattttagtattgttagtagagacagggtttcatcatgttgaccaggctggtctcgaactcctgacctcaggtgatccacctgcctcggcatcccagagtgctgggattacaggcatgagccactgtgcccagccaactacataaattcctaacaacgtatctccagaaagtataggcacaacagcacatgcagtcattcctgtaatcaggtgctccgggaggccaaggcaagaagatcccttgagcccaggagtttgagaccagcctggacaacatagcaagactgtgtctctataaaatatacaaaaattgggctgggtatggtggctcatgcctgtaggcccagcactttgggagaccaaggcaggaagatcgattgaactcaggagcttgggaccagcctggacaacataatgagacccagtctctactaaaactcaagaaaattagccagatgtggttgcatgtgcctgtagtcccagcactttgggaggccaaggtgggtggatcacctgaggtcaggaggttgagaccagcctggccaacatggcgaaaccccatctctactaaaaatacaaaaattagcccggtatggaggcatgtgcctgtaatcccagctacttgggaggctgaggcaggagaatggattgaacccaggaggcagaggttgcagtgagccaagatcgcaccactgcactccagcctgggcaacagaacaagactccatcaaaaaaaaaaaaaaaaagaaagaaagaaagaagaaaagaaaattagccaggtgtggttgcatgcacctgtagtcccagcactttgggaggccaaggcaggaggatcaatcaaggctaggagtttgagactgcagaaggaaaccctgtctctaaaaacaaggtccagctaaaatcagggtccagctccaccacaagcgcagctccagggtctgttgagttttgcctctaccattccaagtagtccctgctccagaccaagtcccaccatctggcagtcaggtcagtccaaccacagtcatatcagggcgcttcccggttctttcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaagcaaagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaggctaaggcaggagaatcgcttgaacctgggaggcagatgttgtggtgagccgagatcacgctaccgcactccagcctgggcaacagagtgagactccatcaaaaaatagtaataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagaaacccaacaggaaaaggaagagactgctctatggccaggcacggtggctcacacctgtaatcccagcactttgggaggcccaggcgggcggatcacgaggtcaggagatcgagaccatcctggctaagacggtgaaaccctgtctctactaaaaatacaaaaaaattagccgggcgtggtggtggatgcctgtagtcccagctactcgggaggctgaggcaggagaatggcgtgaacccgggagacggagcttgcagtgagccgagattgcgccactgcacttcagcctgggtgacagtgagactccatctcaaagaagaaaaaaaaaagaaccaagaggagtccaggagaagagaacagcagatgcaaaggccctgaggcagaaacaatcttggtatgcgggaggaataggaaggcagccagtgcagctggagcaggataggttaagagaggatcaaggtgatgagggcctggaaagaggggctggggtcaaatcaccagatcctgttggttgcaatggaagagcctggagtttattctcagggcagtgagaagccactggaaagttgttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacaggccaccacacccatctaatttttttttttttttttgagacagagtctctgtcacccaggctggagtgcagtggcacaatctcagctcactgcaacctccacctcccaggttcaagcaattctcctgcctcagcctcctgagtagctgggactacaggtgcatgccaccatacctggctaattttttgtgtttttagtagagacaggatttcatcacgttagccaggatggtctcgatttcctgacctcgtgatctgcccaccatggcctcccaaagtgctgggattaacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctacctcagcatcccaaagtgctggattacaggcatgagtcaccatgcctggtcacacttctcattctttaaaccagacctcatttgtccacctcccccatcccccgccccaccccacggactgtcctataatgcccatacaacaggtcactgtttagaaagtgccacaaagttacaaacacagtcccttctgagcctcccaccaatgttggtgggtgcaaggtcaaaaaaaaaatctcatctatctaaggggcataggagactttttagttagagggcccaattatagtcctcctgaaaagatgccaaaagtccccttaaacacttagcaaagattcaagaaagatgaatctcacattctttgtatgggaaatgaggaacttgacatcttcaatataatagattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgggaacaatccaatttgaaggcctcaatgcccaaatctacactcgttttattctatatccttggtttctttttttttttttttgagatggagtctcactctgtcgcccaggctggagtgcagtggcgtgatcttggctcaatgcaagatccgcctcccgggttcatgccattctcctgctgcagcctcctgagtagttgggactacagatgcccgcccccacgcccggctaatttttttgtatttttagtagagacggggtttctccatgttatccaggatggtctcaatctcctgacctcgtgatccacccgcctcagcatctcaaagtgctgggattacaggcattagccaccgtgcctggcccacacctgggtgatttttaaaattcttctagtagagacagggtctcactatgttgggtcaccgtgtttgatgtcagttttccctgacagaatctacaatctccttgatcaccattatatcccaacacagagctcagtacctggtacaaagcacatttgatcaatacttgctgaataaagaaataaaaatgaagaggcattccagcctgggcaacagagtgagatggtctcaaaaaaaaaaaacaaaaaaaaaaaaaacaaaaaatgactggaaaggagatgagggtacttgtgaagccatattatatgacacgctctgtgctaggacttttatataccttgtctcatctcttcatctcatataatccttacaagtatctcaaaagtggggaaatccccatataactgaagaggaaggcagttcagaagttcactgatttgccctaaggttcctcaatttgtaaacatcaggccaatgatccaaccccaggtatgtttggcagtgaaggaccagttgagtcatagctgcaagtaacaaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcttatgtcttcattaaaaatgggtgaagaatttgaacaaacatttgcaaactaaaatacaaatgaaatacactcaacatcattaatcatcaagaaaataaaattatgagataatcctaataatcactacatatgcaccacagtgattaaaatttttttaagttaagccacgtgacccaataaggtgcattcactcaagagaaacgcaaatatatgtccactcaaagacttgcacatgaatgttgagagcaggtttatactgaatagtgcaatgtgaaaaaaccccaaaatctagcaaagaatgaagggagaaataaactgtggtatatacatacaatagaacactactcaataataaaaaggattgtattcctgatacatgcaatatgggtgaaccttaaaaatatcatgctgagcaagagaagccaaacacaagagaacatgttgttatgatttcacgtacatgaaactttagtaaagacaagtctaatccatagtgacagaaagcaaatgagtaactgctgacagggccaaatgaggagatgatcccaagggaaccttctggggtaagacggtgttctgtatctcaatcgtattggtggtcacacaagtgaagacatgttagaactcatcaaaccatacacttagaatgtgtaatataaacctcaataaagcaaaatttaaaaaaaaaaacacctttaattttctcttacaaaaaaaaaaaggaaaaccacttaactttaatttttctccaacaactgattctggtacatagtataccttactgcctgcatccatggcctcacatcatgctgtttacatgaacgtaaagcttcaccgaagagtggaataagacagtcctgccagagaaaaaccaaaattactcaacgtaaaacaggctgttgatacgtttgcagatatatagcaagtcttaagtcaaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaagtcacagcacatttactataaagcagactgcagaaaaacattacaactaatgctttataatgaagttctcgaagatcatcattcattcagaagcccccatctctggttgaactttaccccatttaggatgaagaggagagatctttgtttgcagcaaatctaaaatttacgtaatctgcctaaaggaactgtctttacatacaccacctcccactccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctatttcaaaaaactcaaaaaataaggtctttgttctacagtaatgaccattaatagtcataagaatgtgcttgtaaaaatatacagacctctgtttaaagtctgttagaaactgtgttctccaaagcaggtgagcaatacagctgcaaggtacttagaactggcaaagactgtgaaactgttaaagtagaaagtctcagaggtccaacagcgatgcgggatgtttgcttcaagtactttaccacatttctgaaacaaaatatttactgtcaattaataaaaattacaattcataaccactcaaagaataaagcaattgataagatgctatcaaactgacatccaaagttagggggcagtaagaggagcagcctgctctataataaaatgatattagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttatctccgtaagagtaacttactcagttatagactgccacttctgatcttgttctatcgggtttaaagcagttgccaaacaaacagaacttcttaacaattgaacttcaatggatttctgaggttcccttggatctggacttaacatgttacgaagcaggtttttcatgtctacagaagttaaatgaaatgtcattaattaatgtgcttttattataaattttgatttatgtttggcattattaaaaactaatcaccaatgaacagctcctttaatatttaaggcagttaaacactataagcattactgagagctatataaaaatcatacttcatacaaaattactgtacctcagacccctaaaaagcagttgccttcaaaggctcaaaaatcagtaagtcgaggccaggcgtggtggctcacgcctgtaatcccagcactttgggaggccaaggtgggtggatcacgaagtcaggagttcaagaccagcctggccaagatgatgaaaccccgtctctactaaaaatacaaaaaattagctgggcacagtggcagacacctgtaatcccagctactcaggaggctgaggcaggagaattgcttgaactcagaggacggaggttgcagtgagccaaaatcccgccactgcactccagcctgggcaacagagtgagactctgtctcaacaaaaaagaaaatcagtaagtcaatctactatttaagggaacaaatctagacctgcattagcaaatcttgctcaatccagaatactcattaaactttttaataacattttataaagtgttccatttgtgataaagaacttaatgagccacatcaagatgaaaatcaagaaaaatatttagctgaaacactactttgtcctttatcaaacaaaatggctagataaatctcaaagcattaaggtggtcatttttttatttgacttaattttaagtgcttttcatttcccaaatcaaacttaaatagggcagccctaaatttgttgcttcacatgggattctgccccccaaaaatgtaaaatgacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcagtacattcaacaaattttccagactcgaagctgcttaatgatctgtaattaaaatattggttagcttgtattcctacgcagcctgtggaaccattaaaaaaaaacaaacaaacaaaaacagaacaaatcctaggaagacagcaaagtacacagcatttttctgacaaaattccttccacgaggatgtcattattttggtttttatgttgaagatgtgactaccacttaattagtactcaaattggagtggcaaaccagaaagtcacagctacagactttcagtagagctgactcgcccctgtgtctccttcctgttttcatgtgttgcagcctgttctcttcagagcctaacacactgacagtagacctctgcaggacaactttgacacccagttctctccaagctgccagtgagctccttgtgcagcctcactcctcacctacagcatgagcccttgcagctctcccagcatcataatcttgtatctcagtcctggcttctttcactgctggcatccctccatctctccctttttcacctacttttcttttttcaaagaattcttctctttcatctgcttttatgaaaaataatgacacctctgaaattctttcctgtagtcctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacattcgtcatttctgccattaaaaggtcctaagtcctctccagtgacaggttcctcaagtccccactatgctctataatgccctatgctttcagctaatgactcagtcctcagaaaaacaaacaaataaaaaaacacaggctttaatttcctctacccctacccccaatccaccatacactgccaaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatctccctccagcaatagcttcctatcctcgacttcaagaaaaactcactgaccaaataacttacctcaagcttttcattttcaaatgtctctaccactcaatagtattcaatctagcttcttctgtctctctacaaaactctttttccttataatccctagagcatctgacaaggctgactactcccatctggatgtcctatatctaggacacttcccttctcaatgtccctgtatttttttgaatggcttcctcttctatactttcacaaaaatgctaaactaggattctgacccaggccttccttcctcttcactcactattctccagaggcttctctctggtttggttgcttacaaaggctctagagtatagagactgaaaaggaaacagggccttttctgtgtactaatgatgtgcaaatctctcaagcttagactttctccttagttcaaaatccaattttttttttttaattgatcattcttgggtgtttctcgcagagggggatttggcagggtcataggacaatagtggagggaaggtcagcagataaacaagtgaacaaaggtctctggttttcctaggcagagtgtgtgtgtccctgggtacttgagattagggaatggtgatgactcttaacgagcatgctgccttcaagcatctgtttaacaaagcacatcttgcaccgcccttaatccatttaaccctgagtggacacagcacatgtttcagagagcacagggttggggataaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcaatgagctgttgggtacacctcccagacggggtggtggccgggcagaggggctcctcacttcccagtaggggcggccgggcagaggcgcccctcacctcctggacggggcggctggccgggcggggggctgacccccctacctccctcccagacagggcggctggccaggcagaggggctcctcacctcccagacggggcggcggggcagaggcgctcccatctcagacgatgggcggccgggcagagacgctcctcacttcctagatgggatggcggccgggcagagacactcctcactttccagactgggcagccaggcagaggggctcctcacatcccagacgatgggcggccaggcagagacgctcctcacttcccagacggggtagcggccgggcagaggctgcaatctcggcactttggggggccaagacaggcggctgggaagtggaggttgtagccgagatcacgccactgcactccagcctgggcaccattgagcactgagttaacaagactccgtctgcaatcccggcacctcgggaggccgaggctggcggatcactcacggttaggagctggagaccagcccggccaacacagcgaaaccccgtctccaccaaaaaagtacgaaaacccatcaggtgtggcggcgcacgcctgcaatcgcaggcactcggcaggctgaggcaggagaatcaggcagggaggttgcagtgagccgagatggcagcagcacagtccagcttcggcttggcatgagagggagaccgtggaaagagagggagagggagaccgtggaaaccgtggaaagagagggagagggagaccgtggaaagagagggagagggagaggagggagagggagagggagaggagggagagggagagggagagggagaggagggagagggagagggagagccaaaatccaattcttaacagcttacccaacaatctcatctgcacatttcattagaaatcttaaaacatagcttgttctctgtgtgctcctactccagttaatagcattgtttctcttccctctaccattgcccccacaaattaatggtctccatgcttccatacttgcccctcacctccagtctcttcaccatagcagaatgaaccaccaagtcagatcacaacacatctctgttcaaatcccacctgaaattttcagtcttactagaataacagccaaagttcttttctcagttcccagctacttctctgcccttatatcctactgtttaaggtgctcctaaacacacaggcctcccagctatttccagaacactccaagcccatcattctcacatcaggtctaggcccaaagggcatcctgatgggcatgccttgaccttgtgtcttccctccaaagaaggtcagctttacctaactgctttccttatggcacagaaaaggtgagtgaggtccaattaatccttctatcaataatctttatctaatctttgctttaaaaggttggaatttgtgtctgttttatgtgctgcctgggtcatagtatatgctcagtgaagcaattacacattaacccatttagcagtagaaagcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttagaaacaaagccatcaaatgtgattctttctaaatcagtacaaatttttccttatattcactctggcataatcttcaaactctattaaggttttagaatgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaattcagctttcaggttgagggaagtgctactggtactctttttcaagtcatggatagcattctgccattcctgcacagcagcgcaatcggcaattgagatgtagcactcacacatgctttatttcctaaataatttataacctcaggggaagagtcagtcggtttggacagcacagtttttctggattcacctgaaagtattttataaaataagaagagattcagatcaattagaaatatttcaaagagcacagaaacctaaaaacatgataagatcatcagtacaaaatatatcactataacttttgctttatttaaaaatactgaacgctcaccattcagacaatgtttcgggctggcactgttacacccagcattggctaaggtgagcaccaatttgtcaaagctggagatgcagcaatcaacacctgtcatggcacacaggtgctcctggtactccacagaggccttttcaaacctgaaaagcaaattgaagcagtcttatttctttatttatctacttacttactttcttttttgagatgaagttttgctcttcttgcccaggctggaatgcaatggcactgtctcagctcaatgcaacctctgcctcctgggtacaagtgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccgaagtgctgggattacaggcatgagccaccgcgcctggcctttacttacttacttacttattttttgagacagtcttactgtcacccaggctggagggcagtggcatgatcatggctcgctgcagccttgccctaccaggctcatgcaatcctccaacctcagcctcccaagtagctgggactataggcacccaccaacacacctggctaaaacaaggttttgctctgttggccagggtggtctcaaactcctggactcaagcgatccgctcacctcagtctccccaagtactgggatttcaggcatgagccaccgcgcccagccccaaaggaggctgttattttaaacacacatatctcatttcccccccccacaaaaaatggtgcaagaataaactgagctaaaacagtgagttgactatggtggggggaggtttgatgtcttcctcacaactgtgaaactaaatttaaaagtggttaaatgtttttaaaaaaatgtaagagtataaaagaactagtggaaaatattgataagtaactgatgtcagtgtgtggaaaggctttgtagaaggataaaatgcaagaaaagatgcacaagtaacagatctagatgcataatgctgaaatacaacactaaacattaaaaacaaattataaatcaagaaattggatagcatcaacaatcttagtatttaataaaatttcacagattaacacaggaaaaattgagaggccatgaagacatgatccatgttttaaaaaatcacaaaaggtcactatatggggcaacttctactattagtcattaataaatatagaaatgtaaagtacaataactattttcgctgatggtggtggcagcattcttgtttctcagtgactctcagtatccacaaagatgaagggaagggggtactctattattaagggtatacattgcagccatcttttctgtagagtaacttaccaatagaatatattataagacttatggtttggcagcctttcttctagtaaatcagtttatgagaatggattccaagaaagtaatcagaaatataagcaaagatattaagtgctatggtacatttagtaaaaaaaaaaatcagaaacaaccttaatgcccaacagtaagaaatattaaattatggtacactcataaatacaaacctttattaaaaataacactgtagaatatttaacatggcaatttttttttttttgagacagagttttgcttttgttgcccaggctagagggcagtggcacaacccgggctcacagcaacctccgcctcccaggttcaactgattctcctgcctcagcctcccaagtagctgggattacaggcatgtgccaccacaccccactaatatgttttgtatttttagtagagacggggtttcaccatgttaggctagtctcaaactcctgacctcaggtgatccacctgcctcggcctcccaaagtgctgggaatacagatgtaagccaccgaacccagcctacctaacacggaaaattttttttttttaaatattgagtgggaaaaacagatcataaaaccatgtgcctatgtacactgatgttttggtgaagaatggagaaaacgacatgaaagaaaaaagaattacaaagcatatggatatggaaatatgggactacaaaaggacacacaacagaagttactacaaagatatggaagtatgagcagttcttttatcttcctaaatttgcaagatttcattaaactaacataaatggacacagaatattatggtacaagctcctctacctggaggaagcaatgagtctgaatgtagagttcacaggactaatgagcaaatactctgacaataaagggtaatttgtatcagactctgagggggaaggagctcaactagggatcaagttcaaaagcgtttataaaacaactgacaggtcttgttttacagtgtgatttgccactaattcttaaataagaaaggcactccagtattgcggctaactaaagaacaaactgaagatgcctcctggtgaagtgatttatagcaagcttcaatgctgaaagcaaacaaagctgttttaagatttggctacaatgtcagtgagtaatacaaagaatttaaacataaagtaattctgtcacccatttccttccctccaacctacctcccttcagcctgttgagccactgagttaatccacagaagattttttccaacaatagatgatgaccagacagcaattccctgtatagcttcaggacaatgaagttcacatagtgcttctaccaccatcataatggttatttccaattcattcccctgaaaacgcattcagaaaagttagtcacccaataccattaaaacataaatccctataaaatttacaactgatcacagtctgtgcctgcttaaagccaaatgtatttaacaattattttcacaattttcacattatttagctcagaattctttaaaattttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaattaaatataaataaacaggaattaaggaatgattaacttcatgtgtttgaatactgcttgacattacctgaattgctaaacattttgttatttttggattccagttatttattgtgagcccacttgcaagccaggaattactcaagcatttgtcatacgttataaaaacaatttctcctggccaggtgcagtggctcatgcctgtaatcccagcactttggaaggccgaggtgggcggatcacttgtggccaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaataatttcccccataaacaaattttcagaattacctttaaagttctaaactttgcacgtaagaaatatagttttaacgtgttctaacatgaatattgttttaacatgaacaaaaacatgaacattattttaacttctaacactgttttaacatgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcaactggtatagaaaaaagctctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaatgcattagcacatccctcatatacattatacattaatttctccagattttccagatactgcagaagaagaacaagtctaagttggttgttaccatggccttcatcattgtctgcagttgtccactgactaacatcctgatcagggtttaatgtgtgagctgcgagacttcgaatgatacctgaaagcaaagacaacattctgaatttttaaaaatcttaaagttcctagaataagtgtgagttttttatgacaaattcacatttatcaagtatcctctgtctacccatcatttaaaaataaaaaatcccaacatgaaagatctttcattttaggggaaaaaatatatatatattttccacacaactcccataagttttggaaaaaaaccaaacatatttccaatgcaattattcaatgaaagcttattctaacaaacatacctgaaaattattgactttttttcaaaaaaaatcatatactctcaaatctttaacaaagatttaaaaatccattatttcttaataaggctttgaaagtattcacatcacaaagcttgagcgagttaccttcaattgtctggaaggtgtcttgagctctgcccagtggggttctcagcttagaaagaacagtgaattgtgcagcttcccatatggcccactgccaaaagatagcatctgtcttcaggagattgcgtggaattgttgactggtcacacttatccagtctctggcagctatagaacagtctttccaaccaattgtccttcctgggaaaagtagtttcatatttaaaagacaatgacaacttcattttaataatgaaaaaaaaaatgcaaggggaatgggaatacggaactgtaattttccctactccaaaaaaaggcaaaacctatgaaattgagaagcattatgtccccccctctcattttgaggtcttttatagttaacaggatgaggtacagtgtggaaggatgattagggtaaatggctcatgccagtcaggaatgaaactcattcaatgcaactaagcatctctagaatatctccacccccaccccactccccaaagtgttaatgacatcacatcagttaattgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattatctttcccagataaaatagtcaaagaaatgccttaccctgttctatgagagttcccatacaaaataaaactaataacatcagagaaatcttgggggtggaatgtattacttggtgctttactcatgtgacttcttaatgctaaagaaatttcttgaatttctgtgtgattgttattgctgtagacagaaaataaagttgttgttatgcaaaatattttagcttaaaaggttagcacctactgtaagtggattatttacttattaactcactggaggtaaaaatatagtaaaatagagactttaaaatggatacagagatgtgattacaactttagatcctttttttattcacctcagatgggtaatgtgccgacatcataagaggatttgagggaggcatatcaaacatgtgaacataaaaacccaatcattatgcttatgtattacaaaaggatcaagtttaggctcttaaaagctcccaaatcaacttgatcaaaaacaatgaaagattactgtttagtttttcaaatatctgagctactaagaaacatattttggcactacatgagttattctatactaattattgtgagcctataaagctcattaaaaatttttaattttcttgcagaactgcaaaatttgattatttgacatcacttcaatcactggcaagcagggccataaaagatgtgtcattaatgctctaataggtgatctgtcttctcctaaagtagacaaccagtagaggctgtaaatataacagaatgtctttgctccaaaacaactgttataccttaggacaacatctaaaggaattgatttcaacagttttccaaatgcttgtcgaatacgagttccacggtgcactagttgaacacggcaaacatcaacacatctatgaaagaacgaaatagacaaagcaggtgtgttaacatttccaggttattagggttaatgtcaaaagacatgatcttaatttcatacctctgtaaaagatcatctggcaaggaagaggacagagcgtgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactacagactaggcactgttcttgtccagaatccttattgactgtcacatttggaaaaatgacacattcaacaaaacccatgtaatgtaactgatgggtcatcacacaaacctttttctgagagaaaatgtaaaagtatatgcaaaatataaacattcacataagcttaaaaatgtgacaatcacttcaaaacatttttctaatactaagaatgaaaaaaatcaagactgtgtatctgtcattaaaatgaggattacacatcttcaggtcaggaaaagagctcgattgatgaccatctcccattaccaaagacccttttaaggactgataaacaaaatagaaaaaaaaaaaacagagtcttactgttggctaaaaggcctttgcaaaatttatggaaagacggaagacagaataaaggtgcatatgtttcggacttcttcattaaaacagctacttccaaagcccaagtcattaacagtttcctgaaacacaaaatatacagttgactgtacacaaaaaaaacaacaacaaaaacaaaaaaacgttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcataatagcaaagaggccgggcatggtggcttacctgaggtcaggagttcaagaccagcctggccaacaacatggtgaaacaccatctctactaaaaatacaaaaattagctgggtgtggtggcggtcacctgtaatcacggctacttgggaggctgaggcaggagaattgcttgaacctgggaggcagaggttgcagtgagcaaaactccgtctcaaaaaaaaaaaaagcatagaatattaaaaatctatatatattcttctatgaaacactgggggtgagggattgaggtttttcatgtatttcttttcagaaagaataagaaagcctagattaaataataaaaccaaattataaggtgtttgacaataaagaagctgctctacctcacctctataatccacatttttttaaatgttttgtaatccacatttcttattctcaaattataaaggcaaattaacaaagttaggaatagttaatactatataatatctgttacctcgtgtcctggttaaggttatctttcttaagtaatattcccagaagatttaacataattgagaaatgtttctttgtggccgtagttacagtgctaatcacagctccatcaaacaaaggaggagaggaagaactgaggctactagagataaagtgatcatgcctgaaagacaaagcatagattatcttttcatctttaatcaaagaaagcaagcaagcccaaagttaaatcaacatacatctttaaaatctatccattaaaaaaataaaatgttttgtggggttcttttgttaagaaaaatttgtgaatacagtacctggtacaatgagaatacaaagtgtagagcacagcatactgaatggtagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagactggaagggatctagtacactacacctgggacaaatactcttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccgcatctctactaaaattacaaaaattagctgggcatggtggcgcacacttgtaatcccagctactcaggaggctgaggcaggagaattgcttgaacttgggaggcagaggttgcagtgacccgatatcataccaatgcactccagcctagatgacaaagttaagactctctctctcaaaacaaaacaaaacaccagccacatacaaaacacaggaatgagagtacctgtgttccaagaaaactttcttgagtcggagtctctcgctctgttgcccaggctggagtgcaatggggtgatctcagctcactgcaacctctacctctggggttcaagcaattctccctgcctcagtctcccaagtagctgggattacaggtgcccatcaccacgccctgctaacttttgtatttttttagtagagatagggtttcaccatgtgggccaggctggtcttgaactcctgagctcgggtgatctgcctgtctcagtctcctgagggattacaggcgtgaaccactgcgcccagcccgagaactttctttacaaaaacaggcactagtgttgtgatggttgtacacttctgtgaatatactaaaaatcagtgaattatacacttaaaataacaaacaaaaaacaggtgctgggctgtatttggcccacggaccatagtttgctgatctctgatctaaacagagccctttgtatgtgccttttgtggaagtagactgtatttcctcaattttccatatactgcaaatggcaaggtgccctgttcaataaggaaacaaaggcacaccctgccactctacaccttttccatccatctttttcctttacactgccaagacactccattccacctgactgccccatccccacccactttctccttatttctagagtacaggacataaacatctttgaatctgtaaataatgtgaataattttcctcaaaaatcaagctttcatgtttgaagaagagtttattgtgacttcaaacataagctgtaactggtaataagcgaagcagctatggaattatacaaggcaatccaatcaaacaacacggagcacattgaagcgcaaacatcaaattttaccttcttcctcctaaaaactttattccctaattacatccattactttctttctttgtttctttctttttttttttttttcttttgagacagagtctggttctgtagcccaggctggagtgcggtggtgtgatctcagctcactgcaacctccacttcctgggttcaagcaattctcctacctcagcctccaaagtagctaggattacagctgtgcaccaccacccctggctaatttttctatttttagtagaggtgagctttcaccatgttggccaggttggtctcaaactcctgaccacaagtgatcagcccgacttggccttccagagtgctgggtttacaggtgtcagcaaccatgcccagcctacacctattattttctattaaaaataatgtttttcaactctgtgtggtccaataggaagaagaaatacacaaaccataaacaataaatacaaatcaagagcagggccacgtcaaattacttaaaaaaaaaacacacacaggctgggcgcggtggctcatgcctgtaattccagcactttgggaggctgaagcgggtggatcacctgaggtcaggagtttgagaccagcctggccaacatggtgaaatcaagtctctactaaaaatacaaaaattagcccgtcatagtggcaggtgtctgtatctcagctactcgggaggctgaggcaggagaattgctggaacccgggaggcagaggtggcagtgagccgagattgcaccactgcactccagcccaggtgacaacagcatgactctgtctccaaaaaaaaaaaaaaaaattcccccccccccaaaagaaagactaaaggttgagtatcccttattcaaaatgcttgggaccagaagtctttcagactttgtatatgtttggatttgagaatacctgcatatatataaaatgagatatgtgggggatgggacccaagtctaaacacgaaattcacttatgtttcatagacaccttctattcatagcctgaagatcattttatgcaatattttaaataattttgtgcatacaacagtttggactcatcacatgaggtcgggtttggggttttccacttggggcatcatactggtgctcaaaaagtttcaaattttggagcattttagatttaggattttcagattagggatgctcaccagtaagtgttatgaaaatattccaaaatccggctgggcatggtggtgctcacctgtaatcccagcatttttggaggccaaggcaggtggatcacctgaggtcaggagttcacaaccagcctggctaacatggtgaaaacccatctctattaaatacaaaaaaattagccaggcgtggtggcgcatgcctgtaatccgagctacttgggaggctgaaacaggagaatcgcttgtacctgggaggcggaggttgcagcgagccaagatcgcaccattgcacttcagcctgggcaacaagagtaaaacactatctccaaaaaaaaaaaagtattccaaaatccaaaatcaaaaacacttccagtcccaagtatttcagataaggaatattcaacctgtatgaatgtttctagggaaaaagagacagccaaaatataagaccatgtataagaactaacttcagtagacagaaagaaaaaagtaccaggggaagaagaaagagaccgcattttaaaacaactatacaaatttgagctgtaagaaacactgacattttctataagcatgctagagcaaacaggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatggagaaaccttaaatgcatactggtaagtgaaagaagccaattgaaaaggctacatactatatgactccaactacatggcattctggaaaaagcaaaatgatggagacagtaaaaagatcaggggttgccatgggcttaagatggagggagggaggagtggggagagggaatgaggaaggagtgggtagaacataaaagatttttagggaagtgaaactatcctgtatgatactggtaataggggatacatgtcattacacatgttaaagtccatagaatacataacacaaagtaaactatgaaattagttaataataatatatcaatattcactcctttgtaataaatgtaccacactaacacaatatgttaatgagggggaaactgttgggatgaagaaggtatatgggaactcattgttttctgctcaattttctgtatatctaaaaaataaagtcttttaatttagaaaaatatatctaagctatattttaaggccttaatactgtgacattaaagtgtttagacacctaaataggacacacttattttacagttatcatgggcattttttcacattagcaaagagaggtgtaattctggcagaaatgctcagcagaatgtcatctagaatttgctttaaaataagccagttagagatgaaaggatagcaaagaggcctagatgaaaccagatgggccgtttgcttctaattatagaagctgagtgttaaatatgtacaaatttattatactatgctccctatttttatgtgcttcagaatgtccataataaaagtggggggaggatatttatggttaagaaattaaaggaggccagccgggcacggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcgaaagagtgagactccgtctcaaaaaaaaaaaaaaaaaaaaagaaattaaaggagaccaggcatgactgctcacacctgtaatcccagcactttgggagggcaaggcaggaggattacttgagaccaagaattcaagtccagcctagacaatgcagtgagaccccttctctccaaaaaatacaaaggttagccaggcatggtggcatgcatctgtagtcccagatagtcgggaggctgagtgggaggatcacttgagcccaggagtttgaggctgcagtgagctctgattgtaccgctgcactccagccaggggaatatagcaagatcctgtgaccaaaaaaaaaaaaaaaagaaaagaaagaaaagaaaagcaaaaaacaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggatttcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcttgtgcaacagagtgagaccctgtctcaaaaaaaaattgcattaaaaataaaagtaaatagacactaaaatgaaggcatagattataagactgatgaatgtactctaaaaaaataatataataaagcaaagcccttatgttttttcttttttggagacagggccttttttgtcaccttggctgagtgcagtggcacaatcagagctcacttcaacctcaagttcctgggcttaatcgatcctcctccctcagcctcccgagtagctaggactgcaggtgcacaccactacaccaagctaatttttgactttttgtacagatggggtctcactacattgcccaagctgtgccagaattcctggatgccagcaatccttctgctttggcctcccaaagtgctgggattacaagcataagccaccatacccagacaaagcccttaatttcttacatatcgatttaagggcctgaataaaccaacacattaaaaaggaaaagaataattcacataccagcatgagtaaattcaagactgagatgatataatcggtaccacaagtctggcaattctccagttggtctaatccatatgtaatgaccatgtcacaatgtatagtcatgctaggatccaagctgccgagcaaaacaccaacacactcattagcagctgtcaacacagcctcagaaaaaaacacctggtttgcagccgtcacacatctcattactctgtacagaatctgtaaatggggaaaacaagcagctttttaaaaaaattcacgtgcttccacaaagcaaggaaatactttttatttaatgcaatttcaactgaaaattaactgcttgccttgccagcagtctcttaatattctagttctcagtagctgaataatgatacctttactacaatatgtaaacatgatcttggctaaaaaatcctaaagtgctactatgacaggaaatggaatctgccatcctctatttcccatatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaactttctatctactgatggtctcttttgaaagataagcactctcatgcttaccacatagtatcttcaaaaatcatatgatttccaatacacacacaaacaaaatcccccacttaactataatggccaataattgtgtactaaatttctaataaaataggggagaaaacagagcaaatgttaaaaaatacttctataatatttaacaaccaatacatacaggattttatttagtctacccataattttcattaaaagtatccttggaggttgggcatagtgactcacatctatcatcctagcactttgagaggattagctggaaggttctcttgagtccaggagtttaagaccagccatgtcaacataacaacacctcatctctaccaaatttgtttttaaattggttgggcgtggtggctcacaccagtagtcccaccaactacttgagaggctgaggtgggaggatcacttaagcctgggaagtcaaggctgcagtgagccaagatcgtgccactgcactccagcctgggcaacagagaccagtggctcatgtctataatcccaacactttgggaggctgaggtgggaagactgcttgaggccaaaagttcaagaccagcctgggaaacactgagacgccatctctacaaaaataaaaaattagcaggagctatggtgggaggatcacttgagcccaagagatagaggctgcactgagtcgtgatggcaccaccccactttaaaaagaaaaaaaaaagagctgggtatggtgacacccgcttgtagggctgagtgaggtgggaagttcacctgggcccaagagttcaagactacagtgagctatgattgcactactacactccagcctgggtgagagagtgaggctccagctccaaaaataaataaaaataaaataaaaaaataaaaaccccaccattctaccattctcaaaggcctaaaagatcctcataaatcaatatacacctatcctataaattatgtcccttttattttatgtctgaattaacagctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcacagccgagtacaatgcctggggttcatttcttgtgtcttttccactgaaccctcattggatgtgctatatacagtgcagctaatgtttgaggctgctgaagtgtggcaatctatctacctcatttttaatttgtttatgttctttgatatcaggctatcaaagaatataaagatatacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaataagatttaaaaattcagagtggccttttgtcatgggagggtagggaagttggatgaaaggaggatgagatataaaaggattccctgcttttctggttatttaagaaagcagtcagacaatatatacatatacacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaatcggaggacccgaattgggctgaagcgttccccaatgctcctcaccacagtactaaatacccggagaagcgcagtcagctttggtaatgacactgatggaggagggacgtcttcatccactgattccccagaggccacatggctgaggtcctagatgtgaattcacagcattcttaataagtagtacattgtttaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggatactagaaccaatctatacatttacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacacagaagcaaaacatttccttgcttttctaggaaagagtaaacacatcagtacagctaaaggtactgaattcctgttgactacaagcagcaaagatgataaaaacaagatgaggccaaaatctttatgggagccttgattggttgatctgaataggggagaaacacaaagagattcagataagagatagcacagagttaagccatgacagtggggccagaaaagccaagtaccagtaacagaggcttcagcagtgctcttaaagctcctatgctatattcgtacagccacaaaagctggctgaagccaaggcctgtcctccaaagtacgattcagatctcccgtacatatgtaagaggaaaatctttaggagcttttggtgttttgtgtttttttataacacaacatcaatttgctttaagactctgaagactgggaacaaaaaataaaaataaataacaaaaaatgtctttagaaaaataccagctaccaagagtatgtaaagctttgcgaaatacgaagcttgcaacgtttcttttagtctctccagtaattctcctggtaacttaaatacatctgaaataaatgtttaaaatactgactgagcacgggggctcatgcctataatcccagcatttgggaggccgacgcgggtggatcaccagtggtcaggagtttgagaccagcctggccaacatggtgaaaccccgtctctactaaaaatacaaaaattagctgggcatagtggcgggcacctgtaattccagctactcaggaggctgaggcaggagaatcatttgaacccaggaggtggaggttgcagtgagctgagatcgtgccattgcactccagcctgagtgacagagtgagactccgtctcaaaaaaaaatttttttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaaatgaccaagaagagtcgtagaaaatgcaagatcagctacccaaaatggctccaaactctgcaaccacccttggaatcgtataagaaattgtgaaagggtggggggagaaaaaacaccaaaaaatccaaattaaaaaaatataagaggcttgttttaaaaagtatccggttttcaagcagcataccctaaaacatgtcctatatcataaaattaagactgctaaacatgctgatcacgattaaccaatacctctttaattaatacctctttaatttctgcaaaaattaacatgtaaatgttatttccttactttttcagtaaatttcctatctatattgtcactacacatgacttaacactaaaatgccacaatctaccattggcctggctaatcccagggccacatctaaccattaaaggtgtatacttatctcctcagtgaaaatgaaacagaccactatcacctgaatatcctattttcaaaagtttattacaccaagtaagttacgagaaactatgacacttgaaacaagctgaaatgtgcaaatgagccatgctagtcattcacttaactccaaaaaaatgggaaacaaaaccatttctcatttatgacaattctccaaattaaccctatttccttttttaaaaaaataaccagaaaaacaataaaatgttacaaataacttggatcttccattgtccacttcagggtattgccactgcaatatattcttaccatatactttttcctaccagtacaaactacaaataacttgggtaagtcctgtctgtacttattctacccacctactagtaatttcttctgaaaatatatatttagctaacaagtaatgttcatttacaatataacatttctctgaattagttttcttgcattattaaagaaatgttattgatagatggtcactgggggaccactgctcctccccgacagtatttaaataactggtataggctgcaagacttaccagatacctgctgcgtgagcgaaggtttctgagtatgatctatatgccatccaactaatatatcaactgtatccttgatggaaacaaagagagagggggccaatcattttaagatattactgccattcacctgtggaccattccacagcaaaagatcctaaaaggagcatctatgttctacctactcaacattctagaaacttagaaaggggagaggggcaggaaaataaaagaactacatttctgacaacaatgaaatagtttattttcttcaaatattttaaggtacgaacgtcagaaataaaaatgcagcatttaaccctggaacctcaaatatcactgattatactcaaaggagcagaggcattgttttccatctgattcctcagttcctcacacacacaaccatccccctcaccccatgatctgaaaagcgaaatgaggaattcaccctaaaattagtgtggagaaaacaagcaaattaggttatttactaagtgactacataaaaaactgagtatgagaccaagaaaaatagattctgtagttttagttaaaaaaaaaattgacttgtaaatcccaactactcgggaggctgagacacaagaatcgcttgaacccaggaggcagaggttgcagtgagctgagattgcaccgctgcactccagcctggacaatacagccagactccatctcaaaaaaaaaaataattaataaataaataaaataaatatactgaaaatatttcactccactaagatgttaagctaaaaacaaatactgttttctcttcttcaatgtttgttaacattagtccttaataacatctgtttacaatatccctaaatgctctctttaagattccacctgtgattaaatttcaaatacaaaaaagtaaaacggatttgggaaacttttctataaagtacagcaattaatttgcaatccaaaatataaagcaaattttatataatttatgctttactatattagtacttgcttcacattaaaattaaagatcagtatggcaccacacatgaataacatgcaggctcaggttaccattatacataaatttttaaaataaatatatggcaaaaataataattgtcattccattgaaagaatatttattttgcagctgttaaaagacatttttccctaaaaaaagaaaagctgtgctttacatagcaatcttataaaagaaatgctagaatcagaaaaccatcattttaggctgggtgcagtggctcacacctgtaaccccagcactttgggaggacgaggcaggtggatcacttgaggtcaggagttcaagaccagtctggccagctcgatgaaactccgtctctactaaaaatataaaaattagcagagcacagtggcacctgcctgtaatcccagctactcaggagggtgaagcatgagaactgcttgaacctgggaggcggaggttgcagtgagccgagattgtgccactgccctccagcttggacaatagagcaagatttcgtctcaaaaaaaaagagaaaaagaaaaccattattttgcaatagccaatgttataatctacacaggcacagactatcaatgctaaaaatcatttaaaagacatcttaggggtaattacagaaatttgaatatagaacacatatgtaataaaattcattttcttaggtatgattacaatattcttgttatacagaagaaaaaccttattcttgggagatgcaaactaaaacattatgggttgaactgtcatcatgtgtatggttttcagatgctcaacaaaagtgtgtgagaaaataaaactggcaaaatattagtaactggtaaatctaggtgaagcatattattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaaatgttttgttttgctttgcttttttgagatagggttgcctataatggagtgcagtagcttgaccatagctcactgtagcttcaacctcccaggcacaagcgatcctcctgcctcagccttcaagtagctgggactacaggtgcataccaccatgcctgacttattttttttccttttttttttttttttttttttttgatagaaacagggtttcaccttgttgcccaggctggtctcaaactcctggactcaggcgattcaccagcctcagcctcccacagtgctggggttacaggagtgagccaccatgcccagttaaaaatacactttttatttaaaaaaaaaagagaacactccttatatttcctttatattttgtaaactacatacccaaaataaagcatatcaaaaactgtaaaaaaaaaaaaaaaaaaccctaatatcagatattccagacacaacaataccataatttaatcacttaaaatcttactcaaaactaaatcaatgatcttttaggccaggtgtggtggctcatgatagtaatcacagtactttgggaggccaaggcaggaggatcacttgaggtcaggagttcaagaccagcatggccaacacaatgaaaatccatctctactaaaaatacaaaaattagccaggctaatggcacactcctgtaataccagctacttaggaggctgaggcaggagaatcgcttgaacctgggaggcagaggttgcagtgagccgagatcatgccactgcactccaggctggacaacagagcaagactccgcatcaaaaaaaaaaaaaagatattttaatatattcagatacacaaatatgaaataaaactaagtagagctggtattcatttacacataattatcttataccgtttggaataagaatttggggcacgttagcaaaccaaaaggctcagaaagacgtcgtgatatttagttcttgtctccctctacaaatgtgaagcactcttctatccggcattcctagtggagttcctattttcaaatttgcaaatcattctggtgctaagcaatctcaaaaaaaacatttactaaaaaccagaggaaaaaaatcttataactttgggaggctgaggcagatggatcactgagatcaggagtttgagaccagcttggccaacatgatgaaaccccatcttctctaaaaatacaaaaagttagctgggtgtggtggcaggtgcctgtagtcccagctattccagaggctgaggcaggagaatcacttgaacctctgaggcggaggttgcagtgagctgagatcgcgccattgcactccagcctgggcaacagagtgagactctgtctcaaaaaataaatataaaaaaataaaaagctgctattctccattaatacctgcaggcccgacaaaggcagcctaggaattctagatgaatggaatgaatacaacttgctggaagttcttaggaaacaaaatgactattcacagaaccaaataaaagccttccactagaaactaaaaataataataataataataatggttttatatatatgcatacacaagcaaagccagaagagaataaatagcaaatgaatgaaaactagaagcaaaaacaaacaggaaaccatctctacattttttttactcaatcgaccctgaatgctacagcattatccagggccgcagaaaacacacataatactttattcctgataaacaattcgatgtccttaagtccgccaatatcaccgtacattctgtgcaatcaagaaatttactcagctgggcacagtggctcacacctgtaattccagcactttgggaggccaaggcgggtggatcacctgaggtcaggcattcgagaacagcctggcccacatggcgaaaccccatctctactaaaaatacaaaaattagcccggtatggaggcatgtgcctgtaatcccagctacttgggaggctgaggcaggagaatggattgaacccaggaggcagaggttgcagtgagccaagattgcaccattgcactccagcctgggcaacagaacaagactccatcaaaaaaaaaaaaaaaaaaaaaagaaagaaagaagaaaagaaaattagccaggtgtggttgcatgcacctgtagtcccagcactttgggaggccaaggcaggaggatcaatcaaggctaggagtttgagactgcagaaagaaaccctgtctctaaaaaaaaggtccaggtaatttcagggtccagctccaccacaagcgcagctccaggggctgttgagttttgcctttatcattccaagtagtccctgctccagaccaagtcccaccatctggcagtcaggtcagtccaaccacagtcatatcagggcccttccaggaattctcgacgcaaactggaggccgatggcgcgggtcttttcgtggacggcggcagcacggtcctcggcttgcgtccgtagttgctcaggcttctggttcagggctgggcggcggcgcccctgcggcgggcggcccgcaccaggctctgctgcagcacggggtagaggcgctggcagccctcgaggcccaggcgtacggcctccgcccagctctctgtcaggccgccctcgccgctgcccagcagcccggccacctgattcagcacaggcatgagcgccacggtgaggccggcggcggcgcgctcttcctcgagccgcgtggggtccaggagccaggtgggcgcgggccccggcgcgaggctgaggccgcagcccaccaccaggtcgtacatctccacgcccgcgtcggccagggcgagcgcggcggcggtgagcgcggcggccagggccgagccaccgtcctccagcagcagcgccgacacctcgagctgcgcgcgcgggtagcggcccaggcgcacagccggctccagcgcctcctgcagcgccagcgccagctcacgctcctcgcagccgcccgggggagcgcggcgccggcggcccgcgaagggtgcgcggcggaagtcgcagagcaggcgaccgcgcagcgcggccggggcctcgccgcctgctccggccgggccgccgccgcgctcgccgccctcggcctgtcgcgggcccgacacggcacacagcaccttggtgcctcccgcctccaggtaggccgagcccttggcctggctcagcagcccggcgcgcgcgtacacgggccgtagccgcgttgggtcgcgggtgccgggcgcctcctcctcgtcggccgcgtacagctgcggcggctgcgattcttcagggccgcggatgcggcggtgatccccaggcatggcggttcttggcgtgcgaaccccttccgcccaacgccctgccgcatccactggttcttccgttgtttaaagacgcgcggctgcgcatgggctgtcgagagagcggcgggaggcactacagcgcccctggaggcccggagggagaacggcccggtcccagttgtgcagggtagccggatccatccatcttgctggaagggaggggggagagcagctccaagaaaggcttctctgcttccaactacctccacccctcatctactgaattatgaacgccttgctccaagtcaccccacctatttggcctccacctccacagacgtttgaggcagccctaggggctgttcccaaaattttgggttctggggctggactaggtgaacaccacagcagccagcaggagccacagcatttattctacagacgccaaaggctgtcaaaagagccagcccctattgggaagagggatagagatcatgcggcattaagtattgcacgtggtccttttattctctgcagcaaaaacgattcctacttgctgacgcggaaagctcaggtctggagagccgttatctatagatgcgagcgtgacgatcaacagcaatgcggggttagtggttctagaccgatggcactgacgtggagggctcagggcagaaatttaaggggcactgagacataggactgctcccaagtgtgttccagttactgctgggttaggaggggctctttaaaggtcccaagattcaaatgttcttgtagcagatgaagagctcttggctggacggatggatccagtgggagcctcctccttccccactcagttctttacatccccgaggcgcagctgggcgaaggaagtggccagctgcagcgcctcctgcaggcagccaacgttcttgcctgtggcctgtgcagacacatccttgccaccacctttaccgtccatcaagcctgacacctgctgcacccactcgctggcttttaagccccgattggctgcattctagaagacaggaagggaagggggagtcagcacagaagatgggattgagggaggaatgcagggaaagaaaggatggaggagccatcacccactccttgccctgggtgatactgctggaggccgagacagactttacggctggtacagggggcggccatggccactgccaggacaggacagagtggcaaagccaggtatcaaccagatgtcttcaccaataagaaggcctgggtaaggggtactggcaaaggtaaccaaccggtgggcagaaaggctgtttcgaatgcaggctgtacacacacaggcctcagccaacaaccttaagacctaacacttcccactggtgcgaggtggtgctgacctggggaacttgacacaggcacgtgatcttgccagcctcattgtccaccgtgaagagcatggcagaagtctgaggggagtgcatcttgaagagcttcaaggcttcattcagggcctgtggggaggacctggctcaggccacggtgctggagcagggaccctcactagtgtgagcatttgcagccctcagaaggcctgccacccacccctaccccttcccagagcaggggctgtgcccagggcctgtggggaggaccccagcgccgggccctgcccctaccctggcccaggtatgcctcccacatgcagggagctgctgctcctcccaatctcaatcccagaccgtgggcccttaggcaaccacttcgctcagagccacagaggccacatgtcagccaccagagagctgatgagccctaggggaggggaccctggcccctgggttgccttggctgaggcgccgctctccatctccaggatgacaagaggctggttggggttgctgtcgatgaactgcttcgtcttctctaacacctgcaagaaaaaagtccagaacagcagctcagaccaaaagcccaggccccgaacccctggctgttctgccagcctttgcctaggaaacactctggccactggtgctgccaggactcactcgtttctggacatcggctttgctggctcggtccaagtcatccatgaccttctttagggatttgagagtctcccgcaattcatccttctgccactgggggatgactgcagtggccagggcctggaaccaatagacgaccatctcaatctgggccacaacttgctgggatgtcagggtccagcccaccccacccgaacccaagtcctccctgactagtgtcctggaaaggaaagcaaggaaagctttgagaccagtccctttaggagcagctgtggcaggtgaaacaagcagggctagagagaaaggagcagcagaaagctgggctcccaaatcaggcccggtccttaccaggctgggaacagcctgtgataagcttcctggcagcttgaaatgcaaataaataccaggcaggcttggaagcaggggccagccttagcccattccccaaatccctccaccccagtgcccatacatgcttgggaagagctctcctgctagcagcactgggagcagcagggaatgtccagggtccaaggacaggatccatggggtccctgctacaaggctacaggacaacagaagtcagcccaaaggcccattccaccaagaaccagggcctgactgactacagatgatttcctgaagacggggcatgtttcatgcaccaggccctgaggacggagggagggaagccgcccctacctctccaaggtcagcgatctccctctgcacatccttgtttggagcagtctgagccttcactttggcttccatgacagagagacatttcttcaagctctctgctttcctgagggcctgggaggggacaccgggtcaaccccaagcaggaggtctgagtcagactcactatcctgtgtctgagcagctgcggaagccccggcggtaggccttgcagcaacataccccaacaccccaaaagtgtctgtggggagtaggtgctggcagccccaggccccagcaaggagcacagtgctcacaggcccattggcaaaggctgcacccaactcagactcaggggtgatcaagctcgagaatcaggagccccttcccccaggaagtggccacccctggggctttagcacaagtcagacacaccagttcccatgaaagagcacccatcctctactgcacggcctcagactaagcacgcccctaggagtacatggatcagcgctgggggccccgatgccacagcgaatctatgtcttaccctcctccacatggagacaggagggggtagatggccagattcacattttttttttttttttttttttggagacggagtctcgccccgtcacccaagctggaacgcagtggtgcgatctcggctcactgcaacctctgcctcccaggttcaagtgattctcctgccccagcctcccaagtagctgggattacagacgcgcgccactacacccagctaatttttgtatttttagtagagacagggtttcagtatgttggtcaggctggtctcgaactcttgacctagtgatccacccgcctcggcctcccaaagtgctgggattacaggcgtgagccactgcgtccggcctgattcacatatattttaaaagactaaacataggaaagctaggagatcttgtgtggtggcaggtttcttctgccactcaggggtaggacactggggcagggggagtggcccagcctgtactttcactctgactgcagcagccacgcagagcagtgtttgctctatggattcgcagactgggctcctcttgccttcttcagataagccacaaaccagcctgacctgctcaccttctgggcctcggcacctgtgacagccacaatcctccggatacccttggcaatggcttcttccgtcacgatcacaaaagctcctgcatgactcgagttccgcaggtgcctgaatggcagaacacaaagtccatagtgaaagaggccctggcagcccttggctggggggtcacactagcggacaagagaagcaggaatgggttgacagtcagggaaagcctgggcttgagagtattctgacaccaagcgggacaccagctcgctgagcctgagtgttctcagttctcaaatggggatgattctccccacacagttgctgtgaaaatcaaatgaggtaaacatgaaagtgctttgtggtccctaatatccaatacagtcttacccttaggctctacgtgacagttttggtcttgtagtggaacttaagctccatttttgtattctgctcactaggtgacaattttggaggattacttttaaaatcttaccacaaccccttaaacaggctttatttctcagttcagagaacctcaaatgttcattaattcatcctcattctttgaagatagtatagttttttttgtttgtttgttttgagacagagtcctgttctgttgttcaggctggagtgcaatggtgtgatcttggctcaccacaacctctgcctcccagtttcaaatgattctcttgcctcagccacccaagtagcttggatacaggtgcccgccaccactcctaatttttgtatttttagtacagacaggttttcaccatgttgcacaggctggtcttgaactcctgacctcaagtgatctgcctgcctcagcctccctaagtgctgggattaaaggcatgaggcaacatacccaacccttggtataaagtttttgaaagctgtttcctgtagtctaaagggtatgagcaaacaggtaatcaggcaaagtgggactcgtttgaaggcccaattcagctgggcagaaaagccttgaactcaatcccccaggcccctatcctactctctgcacatcctacttgctccctgcctgccagaggcctgcaggagaccctggagggtctcaaccatgacattaagaatgttcttttcagccgggcgtggtggctcacacctgtaatctcagcactttgggaggctgaggcgggtgggtcacctgagatcaggagttcaagaccagcctgaccaacgtggagaaaccccctctctactaaaaatacaaaattaggccaggcacggtggctcacacctgtaatcccagcactttgggaggctgaggtgggtggctcacgaggtcagaagatggagaccatcctggctaacagggtgaaaccccatctctactaaaaatacaaaaaattagctgggcgtggtggtgtgtgcctgtagtcccagctactcaggaggctgaggcaggagactcgcttgaaccctggaggtggaggttgcagttagccaagattgcgccattgcactccagcctgggcaatgaaactccgtctcaaaaaaaaaaaaagaatgttctcttcatggctgggcatgggggcacatgcctatagtcccagctacttgggaggctgaggcatgagaatcgaagccaggaggtagaggttgcaatgagccgagactgtgccactacactccaccctgcgggacagagcaagactccacttcaaaaaaacaaacaaaaaaaaccacaattcttttcacaaggcttcatttggaagcagaaactttccaggccaccatgaccttcccaaaaaggcccagagagatacagaggaatccaaattggcagaagtggctatcccaagccaaactgagctgagtcaaccacgtggcctgctcgggggctctgagacaatggagctacattccccagatgccgcccaagctgtcaaaggaaattaggtgagataccaggaatgggaagggctaggcccacatcaagagctcaacaagcactccaggccttgctgaatcccaaattcacacaagccttcttgctagtttcagcccagcaaacaacagcaagcaactgtgtggtaatgtgaatacaatgttttcccccttttcctcctgggaatgtttcgtcaggaaatgttaccttcagatacagggatctaatgagcatgctaggatgctgagattcttgggaacgctatttagcaacggcatttctgaggacttcacttcaaccttagacagacaagagttggtccagcctaagacctacatcctcagaggatgaaggtagatgacctgtctactctgcccctctgcagtactcacgttcccccacagaactcaacagaagtcagggagccagcaggcccagaggggtcatccagcaactcggacaccgggaccccaatggagacgactcgcacagggtcaggataggtctcatcaaacacagcccgtaggccctggatggctttcgctgctgccagggggcaatcctgggtatagacggcctgccagaccaagaagacagaaaagagctggaagagatccctggaggtgcggtacgacgaggcaggaaagcatggtcctgcaggcaggactcgggttccaacctggcttggcctagcacgtgccatgagcttcctcaatcacacgccacgtgcaaagtcaagggcatcagtatgggaatttccaactattttgttaaactgtggaccaaatctcatatgtgaacagacttaactagaacagctctggttctcccaaggtggggtgggacaaatgcctctccctctcccctccaccaaccaccaccactgcccccggcaaaagcacagatggagaatcactgctttaaacaaactttttttttttttgagacggagtctcgctctgtttcccaggctagagtgcaatggcgcaatctcggctcactgcaagctccacctcccgggttcacaccattctcctgcctcagcctcctgagtagctgggactacaggtgcccgccaccacgcccggctaattttttctatttttagtagagacagggttagccaggatggtctcaatctcctgacctcgtgatccgcccgcctcggcctcccaaagtgctgggattacaggcgtgagctaccgtgcccagcctgctttaagcaaatctacgtgcaggacgaatctgatacaacagagtgagagcaccgcactgctaagactgtggacagacagtgacggtgtggggagggggggcattcagccgtcgcccatcctaccttggctgcctcaatcatctcattagcaatctcttcagccttcttgatctgttgggtggacatggctcccttggcagtaaagtcaaatctgaggcggtcaggagcaaccaatgagcctttctggtcagcttccccaagcactgagcgcagggcgaagttcagaatgtgcgtagctgtgtggttgctcatgatgggtcttcgtcggggctggaaagggcagaggggctcatggagaggtctgtaatagactgctagttatctcctcgttatctgctcccccgagtgctacaatttttagttggaaatatggctgtgcagaataaaggttacatttcccagcttccctatggctaagtgtgtccatgtgactaagttcgggtcaaaaggttttgaacagaagtgatgtctaccattaaagggatggggcaggtcctcccatttcttttccaccgcctagaacaggaattgccaaatgacggccgatggctaaatctagcctgtcatctgtcttttcatttttagagacagggtcttgctctgtcacccaggatagagtacagcggcgcgattgtagctcagtgccacctcaaactcctgggctcaagtgatcctcttgcctcagcctcccaagtagctgggactacaggcacacaccactacccccaactaatattttttatttttttgtagagatggggtctcatgttgttgcccaggctgggtctcaaactcttggcctcaagcaatcctcccacctcagcctccccaaatgtatgtgtttataaatttttataaacagttttttttttttataaggagtttcgctcttgttgcccagtctggagtgctatggcatgatctcggctcactgcagcctccatctcccgagttcaagcgattctcctgcctcagcctcctgagtagctgggattacaggcatgcaccaccacacccggctaattttgtatttttagtagagacagggtttctccatgttggtcaggctggtctcgaactcccgacctcaggtgatctgctcgcctcggcctcccaaagtgccgggattacaggcatgagccactgtgcccagccataaacaggtttattggaacacagccacacctgttcatttacatatggtcaatggctgcttgaacactccaactatagagctgagtactcatcaccaggaacatgtggtcagcaaagccaaaaatatttagtatccagttatttacacaaagtttgccaacccctggcctagacaatggatctgatagctatcctctgaaccaggaaatcaaaggcaatgccccaggaaagaaggtggagtgacaggtgaggagaaaccaggccctctgactgtggggcagagcctccgtatcagcttgagctttttagaacatacactgctatcctggttttaagctactcttactctggagctctgtcacatgccagagcctacctcttcattcttcagcatccttggctcccaaagaagtaggtgacgttagaaaagcaatccgtgaaaacaagtccacgggatcttaactgaaatcactggtgaaatcactgacttgggaacatatagattaactcttagttgcatccctcacaatccaccaaatgcacctaaattaacccctgcggtctacttacactagggagtgataacagtgacaggacaattttttttttgaggcggagtctcgctctgttgcccaggctggtgtgcagtggcgggatcttggctcactgcaagctccccctcccgggttcacgccattctcctgcctcagcctcccgagtagctgggactataggcgcctgccaccacgcccagctcattttttatatttttagtagagacggggtttcaccgtgttagccaggatggtctcgatctcctgacctcatgatccacccgcctcggcctcccaaagtgctgggattacaagtgtgagccaccacacccggcccaacagtgacaggacaatttaaagccagaggagaagataattactaaccagatccaatgggggccacagtaacccaactcacctcatcaataaacagccagacctgatcccccactttcaggtcaccgtagatggttccaatgtgtagcacataccctcctcggacctgagcattcttcactgtaaactctgttttctaagaggggtcaaggaagagaccaataaataaatccttaaaaacatacaaattttcttatattttcaatataaactcgtgtatataacttctctttacatatgtaaattgcacacacacacatactcccttaatatcattaaatatgattaaataggccaggtgcagtggctcatgactgtaatcccagcactttgggaggctcaggtgagtagatcacctgaggccaggagttcgagaccagcttggccaacatggtgaaatcccatctctactaaaaaaatacaaaaattagccaggcgtgaaggcaagtgcctataattccacctactcaggaggcagaggcaggagaatcgcttgaacccggaaggcagaggttacagtgagccaagatcatgccactgcactccagccttggctacagagcgagactccatctcaaaaaaaaaaaaaaaaaattaaatatatttgtgcacacacacagacataaccaatattaaggagcatcttagaattttttttttttttttgagacagagtctcgctcagccacccaagctggagtgcagtggcgcaatctcggctcactgcaaccaccctctcctgggttcaagcgattctcccctctcagcttcccgagcaggtgggattacaggcatccaccaccatacctggctaatttttgtatgtcagtagagacagggtttcaccatgttggccaggctggtcttgaactcctgacctcaggcgatccacccgccttggcctcccaaagtgctaggattatagtcatgagccaccacacccagccgcatctttgagtatctaaaagcctccataaggaacctgaagcctagggagacaaagtaactcattcagcagcggcagagctcgaggctgagttttctacaaggacatctccccttcagagagctgcctctcctttttaatgtgcaaagcttgtaggaaacttgtaccctggctgcaaaaatactcctacgagggtacccgatggccaggaaagcaacaggtacaagcaacagctccctcggcttcagaaataccatggaacccaacccaaaggtgtgtcaggtctgctcccaaggcctggagcactgtggggcaaaagcagctccccggctccacgcctggccctcctcggctaacaaggaagaactgttggctcacatcttcactgctgtcatccaccttcaccaggtagccttcgtcatagatctggcctccttgctcagcatagaaacaggtcttgtccagcaccactccacactcctggcctgtggacacctcttccacgaacatcttctccctgcgcagagccatcaccgtagccactgtgttctcaaatactgctcaagggaaatgcatagaaaggggacagtggggtcaatgaccttttcactccttcttggctgacttttgctggattctctttcgcaaactcttcttagctcctaattgtccaattgtattttggaagcaaactcattagacaatatgaaagggcttcgcggccgggcgcggtggctccccctataatcccagcactttgggaggtcgaggcaggcggatcacggggtcaagagatcgagaccatcctggctaacacgctgaaaccctgtctctaccaaaaatacaaaacattagccgggtgtggtggcgggcacctgtagtcccagctactcaggaggctgaggcagaagaatggcgtgaacccaggaggcggagcttgcagtgagccgagattgtgccactccactccagcctgggtgacaaagcaagactcggtctcaaaaaaaaaaaaaaaaaaaaaaaaaaaaaaacaacaacaacaaagggcttcgcatgctggctttccatcaaagaatgcaacactctgtcgggtgaccaactgtcccaatttttaggactgaggggtttcctgggatgcaggcttcagtgttaaaactgggacaatgggttaccctaactctgagctactgaacagaaacttggtgcatcagattagtagatctttaagagtagtaataaattccctagtccaaggtcaactcacaaagaatgtactcattttgtaggcttgcttgaatagatttaggtgtaagattgttctcagccgggcacggtggctcacacctgtcatcctggcactttgtgaggctgagacgggtggataacctgagctcagcagtttgagaccagcctggccaacacggtgaaaccccgtgtccactacaatacaaaaattagccaggtgtggtggcacatgcctgtaatcccagttaattgggaggctgaggcaggagaatcacttcaagctgggaggcagaagttgcagtgagccgagaatgcgccactgcactccagcctgggtgacagagcgaaactccatctcaaaaaaaaaaaaaagattgttctctaccagggcaaaaaagctgcaaaaacatgtattgccaatttatttttatgttttttttgagacagggtctcactctgtagcccaggctggagtgcagtggcacaaatatggctgactgcagcctctcaatctcccaggctcaagtgatcctcctgcctcagccccacaaatagctgggactacaggcatgcgccaccacacctagctaatttttgtatttctggtagagacagggtttcgccatgttgcccagactggtctcaaacaccagagctcaactgatcagcccaccctggcatcccgaagtgctgggattacaggcatgagtcattgcactggctttgtttcttaactttagaatactattatccggtcgggcgagatggcttacgcctgtaatcccagcactttgggaggccaaggcaggcagatcatgaggtcaggagtttgagacctgcctggcaaacatggtgaaaccctgtctctactaaaaacacaaaaatcagccgggtgtggtggtgcgtggctgtaatcccagctacttgggaggctgaggccggagaatcgcttgaacccaggaggtggaggttgcagtgagccgagatcacactattgcactccagcctgggcaacagagggagattccatctcagaaaaaaaaaagaatgctattaggataatagcattctaacagcattaggataatagaatcctaatagcattctttttctttttccccgagacggaatttcactcttgttgtccaggctggagtgcaatggcatgatcttggctcactgcaacctctgcctcccaggttcaggcgattctcctgcctcagcctcccgagtagctgggattacaggggcacgccaccacgcccggctaatttccgtatttttagtagagatggggtttcatcatgttggtcaggctggtctcaaactcctgaccttaggtgatccacctgccccggcctcccaaagtgttgggattacaggtgtgaggcacagcgccaggcccctaatagcattctgatagtcactgtggattgtatcaatgtcaattgcccagtttcctgcatgatgttacaattaggggaaactggataaaagggtgtgagacccttcctacaaattttttttttttacaacttcctgtgacaataattatttcaaaatagagttaagaaaacctccagccaagggtgcctatgtgtataaaagtgcatagcgtgactgtacggcactccaggagaggctgtcagcagtctgctggagagctaatcttgagaaacaatctttcaaataccccccagatacggggcagaatgctcagatgtggaaggagcacagcaacataccatagctaccactggagtccaaatggtaattgtactttggggaatcatctgtgacctccagaccccgtgcccggagctcttcgatagcgtaaatgtccagcataatgaggtcttccccaccagctcccttgccctgtgatttcagctgtcagcaagagaaacaagcataagttaccgtaaagtaggagaaaagggactccaaaggactggaacttgctaaactatgcccagcataaactgccagaacagggtttttcaatcctggcactactgacatttggggccagatcattctctgttgtggaaacttctcttgcagtgtgggatgctgaggggcaccctggcctctaccaagtacgtgacagcaggatctgcccctagttgtgaaaatcaaaaatgtcttcagacattatcgccaattactccctggaaggcagactcgcccccacttgagaaccactgatctaggggaaaaagcacttcaaagactttaatggaaggaaactcatgctcagtctgcagccaagtggtgctgggttggaaggtgttgggtttcctgttcactctccaagttctttacctgggccagtttcctctcctcttcaaagccatccatgtctaccaccaggcccttctcttcagcaatcagtccagtcagatccactggaaacccataggtgtcatagaggagccaagcagtgtctcctacacagcacaaaggaggtgtgtcaaaaaaaacagacagccccttttccatgccaagccctccaaaaggatgctgggactggcagaaggaattaaagacacaaggctatcagtatcggccctgtgtgcccatcagaaaatccagcacatctttttcagttaacctgggggaagcacaatggatgtcctgatacaattctgttttgttttgttttgttttttaaacctcacctgggctgggcaccgtggctcgcgcctgtaatcccagcactttgagaggccgaggcgggcggatcatgaggtcaggagattgagaccatcctgactaacatggtgaaaccccgtctctaggaaaaatacaaaaaatttggccaggcgctgtggctcacgcctgtaatcccagcactttgggaggccgaggcgggcggatcaggaggtcaggagatcgagaccatcttggccaatacggtgaaaccctgtctctactaaaaatacaaaaaaattagccgggcatggtggcgggcgcctgtagtcccagctactcgggaggctgaggcaggagaatggcgtgaacccgggaggtggagcttgcagtgagccgagatagcgccactgcactccagcctgggcgacagagcaagactctgtctcaaaaataaaaaataaaaaaaaataaataaaaaaattgccaggcgcggtggcggacacctgtagtcccagctactagagaggctgaggcaggagaatggcatgaccctgggaggcggagcttgcagtgagctgagatcacaccactgcactccagcctgggcaacagagtgagactccatctcaaaaacaaaaacaacctcacctggacaattttctatttctttttttttgagagtctcactctgttgcccaggctggagtgtactggtgtgatctcggctcattgcactctccagctccaggattcaagcgattctcctgcttcagtctcccgagtagctgggattatgggtgcccgccatcatgcatggctaatttttgcatttttagtagagatggggttttaccatgttggccaggctggtctcaaattcctgacctcaggtgatctgcctgcctcagcctcccaaagtgatgggattaaaggtgtgagccactgtgcccagccttacacatctatttctttttctttttctttttgagatggtgtttcgctcttgttgcccaggctggagtgcagtggcatgattttggctcaatgcaacctccgcctccccggttcaagcaattctcctgtctcagcctcccaagtagctgggattacaggcgcatgccaccacacccagctaattttttgtatttttagtagagacggggttttgccatgttgggcaggctggtcttgaactcatgacctcgtgatccgcccgcctcggcatcccaaagtgctaggattacaggtgtgagccaccacacccagctgacaaatctatttcttgatctgaatgtgtgttcaatttgtgaaaattcatcaagcttttcccttgttcattatacttcaataaagaatctttggaaactggggagaaaatctttggaattaattttccccaaattgcaaaacagtacataccaaatattcccacttttgcttgaaaaatacacacacacaaatatctacatgtatttgcatgcaaacagagaagaatcctgaagagttctacaccaaaccattaagagttgttccctctgagaaatgagtgtggaaaagaggattttcattttctgaacacttttgtattctgtattgtttgaatactttggccacaatgatgcattacttttaccattttactataaattccagtttgcaccaaaagcaattcaatcaagctatgttcagcctcagagacatgagagcccacagtcagtctgtcagaaagggcttgtctttcccagaaagatcaaacggccaggatggagaagggcaaaaactggtacctaccgggaatggtcttgctgtctcccaggctctgaattttcctgtccaggatgcgacgccctctgctgagagtcttgagaaactgcacctcttcttcattaatgatgtccttcaccatgtctgggtccttcttcagctcaggaaatgcatctccctgacaaaggggaagcaagatgaggggctggatgaagccagagactgttccctgccccgtcttaaaaaagctccttagctgggtgcagtggctcacgcctgtaatcctaccactttgggaagccgaggcaggtggattgcctgagctcaggagttcaagaccagcctgggcaacacggtgaaaccctgtctctactaaaacagaaaagattagccaggcttggcggtgtgcacctgtaatcccagctattcggaaggctgagacaggagaatcgcttgaacccaggagacagaggttgcagtgagccaagatcactctattgcactccagcgtgggtgacagagtgagactccgtctcaaaaaacagcaacaaaaagctgcttaacagtatgccctctcccactccatccctcttaacggactgctttagcacagaagggtaagcagagaaataaacctaccagggactggacgacaacatccactaacgtagcaaagaagcccctgctggcattgagcttttcatgggcgtatcggacagctcggcggagaatccgtctcaacacatatctgtaagaggcaaaaactagtccccaacgttcccagctgagggttttgtcttgagtcccttggaatcctacccaaagcaacacctctttcaggaactttcttttatcctaagcctgcttctttcgcattccccaagg

SEQ ID NO: 593 - DNA, 159427 bp, Homo sapiens
actctcagacatttcagatctgatgcaaagagaactttgagagtaattttagtttctcaaaatcatgcagacatttgtgcgtcccaaaaattatggaaaagcagccacactgtgcagtctcttatatgtcatgaagaggactttggctctcactgtgaacttgaaggaagctcactgaaagaaaaggaaaatccttagagaatttaaaagcataagacagaagatgcccctttgtaagcaaaattaaaaaagaaaaaaccaaacaaacaaacaaacaaaaaatagctgcccaagaactatttcctttggaacacagctccccaaatcacactttaaggactggctttctctttgaccttgggaccccttatctgtgtcatctgttgtattcattttcactcacacctacctgagggtttggctatcatctcatttctcttcatggtcaaaggttttcttccttgctccagacaggtgatcaggtctggcttagaaacagtaatacctgttttattaaaaataaataacataaatcttgcttatgttctccaattacaagctagtaatgtgctcagcacagaggatgtgataaaatattctagtaaattaatacaaaaatactaagttgtaacagaaatttttaaataattagaaaatactttcaatttgtaggtttcttaattttactacctggtgctactgaatcaaaaattggtggtggcaattagattttcaggtggagcaacaatattttatgccactaaatttctggaattaccactaatttagagtgaaaaatacagctcaactcaggaaagtggaaagtttggattaagataaaacatgttgaagaaattcttttctaaacgaacaaattctgaagattttctggaaaatggggatctgaaactcttttatgcaaagaataaattactaaaaaacattctacaaaaaataaataaataaaatctatagggtatattatgtactcaagttatcctcaccaaggaagaccaggttactgtagttctctaacatcacattcctatataaattccgctgtgcagtgtccaggcaatgccactcctccagagagaattctatggccacatctctaaattgcaatggtccctgaaaaacacacacacacacatttttaccaagtggccatgggcggaatttttaatttgacttaaggtgaaataagagagtaaagagaactggttctgacttataggactgactaaaattatccaataaaatgatttcaaaacagaaatattctctaatgtattctctaactctgagaagaaagagcagcataagatccacaacatcaattcatgtatgtttctagataataaagtataaaattaagggcaagaacaggaacatgtaaatttttcagtgctatagttacattatacagaatgagttgtgaatatttttcagatggaaaagacatgtttagttagaaggcatctctaaagttttaatatgtacaataagctgaagacatcgttatgcaggttttttttcccccagaagatctggaataaagtctgatttatttatttatttatttatttagagatggagtttcgctcttgttgcccaagctggagtgaaatggtgccatctcagctcaccgccacctccgcctcccgggttcaagcaattctcctgcctctgcctcctgagtagctgggattacagacatgcatcaccgcacccggtaatttttttcgtagttttagtagagatggtgtttatgttggtcaggctggtcttgaactccctacctcaggtgatctgcccactttggcctcctaaagtgttgggattacaggtggagaaaccacacctggccaatgtggtgaatttctaataagctcaacagtaatgccaatgtctttggcccaagaaggatattttgtcaaacatttagtaagtggaacagcctgtgtttttcccactttttctagcctgtaaacaaacagccctcatttaccaaagaaacatgtgtagaaaaaaaaataaggacagttgccagattaaatgtgatggtttatgcacatcagctgcataaagatacgtaataataaagaggaaaaataattaactctatagtgaaaaaaatatgtcccagagatctttaaccaattaattaatggttaatgcattaactgttaactgcactaggacaatggttttttttttttttttttttgagacggagtcttgctctgtcgcccaggctggagtgcagtggcgcagtctcggctcactgcaagctccacctcccaggttcacgccattctcctgcctcagcctcccgagtagctgggactacaggcacccgccaccatgcctggctaattttttgtatttttagtagagacagggtttcaccgtgttagccgggatggtctcgatctcctgacctcgtgatccacccacctcggcctcccaaagtgctgggattacaggtgtgagccactgcgcccggcctaggacaaatttttatgatgtgctaatgcacacagaagaacacagcatcactgttgtaatattcctcccaaaaaaagtaaattatagtccgaatgtaaccataaacatcagttttaggccaggcatggtggctcatgcctgtgatagcaatttgggaggctgcggcgggaggatcacaaggtcaggagttcgagaccagcatgactaacatggtataaccccatctctattaaaaatacaaaaattagccgggtgttgtggcaagcacctgtaatcctggctactcagcatgctaaggcagaattgcttgaacctgggaggtgaaggttgtggtgagccgagatcatgccactgtgctccagcctcagtgacaaagccagactccgtgtcaaaaaaaaaaaaaaaagaatcatcagttgtatacaaactttaaaatacagaaaactctatgttcagtaacttttagtagtaattttaagtaggcttcatttagcatcctaaagagcaggtatctcctaataatttttttcagaactttctgggtaataaatgccatcccatttaaataagcattttcttcttcttcttcttcttcttttttttttttctgagatggagtctggctctgttgcccaggctggagtgcagtggcgcaatctcggctcactgcaagctctgcctcccaggttcacgccattctcctgcatcagcctaccaagtagctgggactacaggcgcctgccaccaagcccagcaaattttttgtattttagtagagacagagtttcaccatgttgaccaggatggtcttgatctcctgcatgatccacctgcctcagcctcccaaagtgctgggattataggtgtgagccacggcacctggcctaaatcagcattttcttaatcctcttctgcatagagctaatggaacacacagctggagcctcaacattacatgttctccatctttactaaggaccacagttttccccaatagaaatcttgagtatccacatctttccatgttcaacagccacaaagggaacatttttaatattgcagatcataaattcttgctgagaattctgcatggcatataagaagctatgatgcggagaataaggagaaggctctgaaatataggaaagaaatatttttcagactcttgactatcgtaagaatttaaagaagtaattaagccaaactcattagggaggaaaaacacaagtagacaagtaaaggtttgtgagtactaaacgcatggcagtccaggaggcagagtcgacatagctcttcatctgacacatgtttacctgaagaaaagccacttttttttctttctcctccttctctggattccttctcagatgagattctctagacaagttacacctgttatcttgagactatgtctttaaaggtgtcagtaccacatgtttacctgctagcataacatcaactggcagaaaaataaagacagaaaaagtccacccatttctgtcctttacaacagaagacattcaggaacaatgagctgctccatgaagataaaaatataaatttctctttgctgtcctcagatgctctcccctgccacggacaccagccatttctgctacagtaatggaaataagcgccacactgacttgtccctaccaaacgcaaacagaacaggccctgtgaccaccctttagggcaaaggtggaacttaactctcatgaatgtattttgaacccctcatacttggttctggtctcaccttagagtcacataagggactccatggatgcttccacccagaacaataaacagaagctgtgcggaggacacaaggaatttctgcaaattggccatgtgattctaatgagaagcctgggttgataaccacggagctaagcattttctctcaagctttaatgagcttataaatcacttggtaattttggccccaatttatgtaatgtgactctggaggtttgaaaagggtccatgaatgggtgttttaaacaagttccctttcaatgctgatgttgctccccccgccccttggcgcattagcattagttagagaaagcaggtacagcacaaggtctcttattacttagcactcttgtcacaaccaaatacttctcgtacaaataaggacaacccatctccatccaaaagttttatatcctttgctggttctttaaagtttacagaaaaaacagaaggcagcaatgtctgaagaagtctggatttaaaaaacaacatgtacacacgtactaatgcaatgtttattaagcaggtactatgtgctcaagagtatgatacagagcactgtgctgggcgtaacatattacgtgatttaattctcataacaccctgggagccggtactaagtgtatgataattttcaggatttaggtaaagggcccaggatttttattgcttcttctgtttctctgccatcaaatttgttaaaaaaaaaaaccataaaaaattaaaactaaatatagacagatgaaagaaatatggaaggcaagagtttaatgtagttcagagaaaattttattctgtttatatttacatttttgtgacttgtggagcaattactggatatgcaagaatggaaaacaagtccctaaatagaatgtctctgcaaacactggttttaatataaaatttaaaaactaagaccctataacacataatttatttttcccatttatctgcttttggatttcaggaaattctaagcaccagctctagaaagacaacaggattcaccagccaaaactctgacctcttctacctgtgagacaagactccagggtagggtcagacgtaaataaggcctccaaaaagggtgaatctcaacagaactgggtcaggaagtggaccctatgtagaattctgttctctatgtcactggggtatttccagttttgttttttctaaacttacctaaaataaacttaaatcccagagtctgtgtaattttaatcttttccagccactgccctgtcaactttatattatatgctaatatgcaatttaaacaaatcccttaaggttttcaagggtaagtttattaggaaacaaatatgttcacttaacaggatgaaagaaatagaaatacggctgggcctggtggctcatgcctgtaatctcaacactttgggaagctgaggtaggtggatcacgaggtcaggagttcaagaccagactaaccaagattttgaaaccccgtctctactaaaattacaaaaattagctgggtgtggtggcaggcacctgtaatcccagctacttgggaggctgaggcaggagaatcacttgaacccaaatgtcagagtttgtggtgagtcgagattgtgccactgaactccagcctgggtgacagagggagactccatatcaaaaaaaaaaaaaaaaagaaattataacaacaattcttctgttcataaatatcctttcaagtacagacatcagaagtcacaacaatataaagtggcaaataatgtccaatattttggacatatctatttgttataccaaccatatgatgcataattcaagtatttatctagttgctagtctagactaagtttctggattgtaggaaccatggctgcttcatgttttattttaacggtcatatgaaatggaagctactagtttatctgtttgggtctccagatctcctccttgtttatcatcccagtaccaggaaactggagaaactctcatctgggtaccaacctaagacacctcttgtatgaggggatgaacaaacaggatgattcatttctcttacactgagaaagaagcagaattaaccactcttgtcagcctgacacaattctgctctggacatcctcaaatgtctcaaagaccactagatgattgtgagagaattcccagtgacctggggctggtggcccaatgataagccaggctagagactcaggctgattctaaataggaaatagaactgccttggtggagctacagaacctggatcacctgtcctgatttgctagctcttgtgtaagagaaagaacacaaatactctactccagtatcacattttacaggtaaatatagttgtggtcataactggatattttgtggccttgttctctcactcttaagatgctttttttttacacttacacatattctgtcatcagattctatttccttctggaggttctcacatcactgtagcaggtcaatgaacaagatgtgaaaaatctcacagaaccacactcccaaatgggagctgtaagctgtctaggttgacatctcacaatgcagaaaatgccttttcttagttttctgtacattctctatccaaagtccggtccttttttgtaaatcccaggcagaggccagatgttatctgcagattctaggtaggatccacctggctctgcatcctttggtgttacagcaagtggagtacaaacgaaggagagatcccccccatagaggctgctctagcacattctaaatgataagtctacatgaaaaaaaaaaaaaagctgacacaacatgaatataagtagacagtttatttgggtaaagtttacagattatatataacctgcgagcaaagattaaagttgcctggaatctacactttgagtagcagcatttacaagaagatttgtaaagacaataagagaaacacagagtgggcaaaattgtttgtcagaaatttctatttatttacaaaaataacattgattattgattagatacatatcattatagtttagggtatgggatatagtgtccaatgtagcattattagtttaatttatagctacatgtggcaatagtgaacagtctcaaaagatgaatacagaattcaaagggaggagaaagacataattgcacttttattttaacgtctctgagtttgataactaaaaggacttgcatttttcagataaaagttttttaattcccaaatctcaagacctggattcaaaatatggagctgcagatttagggcttgagtggctggagtagcacgcatgttacctgcacatttgtgagctttttagcaagagaaggaagaaagaaatggagattttcttgtctacatgtctactcactacacacgttactctacttgggtttgttggccccatggtctctgaatcagtttcaggtttgaagataaaagagtcactgaaagaggtaaaatgattgattgctgccctgtgaaatttatagaaatctgatctagactctctagaagtgactgtagaggactatagataagaaataggcagaaacacaattcggcctgcacatttagggtatggcatgcacttttctgcacaagtgtgaatttactggaagcctgagagggaatgtcccctcgagtaaattctggttggcccttatgtgtttatatcatgtctggtaattctagactgtttggaaacaataattaaaagaaaaattttctccagccccagagaaactccacaataacagaacagaaagaaaatggttttattacacaattaaacttgaatgtgacatgcatcagtcaatctgcttaagagactgcaaagatagaaagatggtcaccataattagttcacaagtagaagaatttccagcaccatgtcatacatagttcatcctaaattcacctggagattgaagaggacatctgtgtatgctaattacttatattcaatgacaaataaacttttcacctctttataacaggtggtagtttagcaggataatcgcttgaacctgggaagcagaggttgcagtgagcccagatagcaccactgcactccagcctgggggacagagtgagactctgtcccctgccctcccagcaaaaaaaaaaagaaaaagaaaaaaagaaaaagaaaggaaaagaacagggacatattttcagaagaattttataaagtttcatttccatctctgctgttctctcctctcctagccattgaatgggggtctatattgaaatacatcttacaacttccaacaacacattttgatgaaaaaatagaatctgactgtgttcatatactggaatatattagaacttgcaacatagctaattgaagagctactatagtttttgggtggccacatcacctgtctttatttgtcctgtaacagcagcatacaaatttagtgaaataaaagatactaaaattgtgtttcctcataattatcctgaatgaataaagtaataaacatgtctgactaatatctactaactgtaacaatttggttgtaaatattctttggatattagatataaatatctaagtatgaacaattttaatgaactagtcataatgtatgtagcattaaaaaaattaaaaccatacatcagttaggctgggcgcagtggctcaagcctgtaatcccagcactttgggaggccgaggcaggtgaatcacgaggtcaggagttcaaaaccagcctggccaatatagtgaaaccctgtctctacaaaaaccatataaaaaaattagccggacctggtggctcacaactgtactaccagctacttgggaggctgaggcaggagaattgcttgaacctcggaggcggaggttgcagtgagccaagatcgcaccactgcactccagcctgggcaacagaggccaggcgcggtggcttacactgtaatcccagcactttgggaggctgaggtgggcggatcatgaggtcaggagattgagaccatcctggctaacacggtgaaaccccgtatctactaaaaatacaaaaaaattagctgggcgtggtggcaggcgcctgtagtcccagctactcgggaggctgaggcaggagaatggcatgaacccgggaggcggagcttgcagtgagccaagatggtgacactccagcccggacgacagagtgagactccggaaaaaaaaaaatccatacttcagttaaaacattttatatttcaaaagcataaataacagtattaaaataaccatttaagtgattaattcaaagtaaatattgtggctttgtattcatactattttagaaaatactgtttatggctcacgcctgtaatcccagcactttgggaggctgtggtgggtggatcacctgaggtcagcagttcaagttcaagctggcaaacatggtaataccccatctctactataaatacaaaaattcagccaggcatggtgatgcatgcctgtaaacccagctactcagggtactgaggtaggagaatcacttcaacctgggaggcagcagttgtagggagcagagatcacacaactgcactccagcctcggcaacagagtgagactgtctcaaaaaaaaaaaaaatgaaaatatggtttaatttatatgaatgcagattatctacaaagataactgctaattgctctgaaataataaacagaaagcaaggtacaactacagactcaactgttcagtttataccctgaactgttcttgctttcgcagtataagtacttcagcctgcaaatattggatagttaccttggattatcaggtttctgtcaaagaaactgagtatcatttagtctttattattctgtattgctacctttactcctatctttgtgctaagcttctgtgtgctcttaaaatgagcttgtatctaaacaaatctgtgtctaccttaaaggaataaaaatcaaaaaaataaacttttcggaaccaaaaacaaagcaatacatcttaagtacttataataatctggagtcagaaaaaatgacaaaacttttatttagctgttgacatgatttacatatatttcaaacaagcagagaaaaatatctacatatattctaaatcccttaagaaaagagggaatagcggccaggcacggtggctcatgcctgcaatcccaacactttgggaagccaaggcaggtggatcacaaggtcaggagatcaagaccatcctggcaaacatcgtgaaaccccgtctctactaaaaatacaaaaaaaagaacaaaaaaattagctgggcatggtggcgggtgcctgtagtcccagctacttgggaggctgaggcaggagattggcgtgaacccaggaggcagaggttgcagtgagccgagatcgcgccactgcactccagcctgggtggcagagcgagactttgcctcaaaaaaaaaaaagaaaagagggaatagcaaaatttttttttggaactttttgaagagtttgaactcttggacatctgaaattagcacactgtatgcacttgaaataatgtttacaggggaaaaaccagaagagagaaagatatatgaaatccgtaagtgcacaagaccaacacaacagaatagagagcccagaaataatgtcaccctcctacactcatcagatttttgacaaagctgacaagaggaatatgggaagaattctctctttaataaatggtgcaggaataactacctagcactatgtagaagactgaaactggaccccttcattacaccatatacaaaaatcaactcaagataaattaaagacttaaatgaaaaacttaaaattataagaaactctgcaagataacatagagaataacattctagatatagacactggcaaagacttcatgatgaagctaccaaaagcaattgcaacaaaagcaaaaactgacaaattggacctatttaaactaaagagcttcttcacagcaaaggaaactataaatagctcaaacaaacaacctacagaataaaagaaaatatttgcaaacgttgtctatgacaaaggtctaacatacagaatttattaagaatttaaacaagtttacaagaaaaaggcaaacatctcattaaaaagtaggcaaataacacgaacagatgcttgtcaaaagaagacatacatgtggctaacaagcattattaaaaaaaaaaaaaaggtcatcgctagtcattagagaaattaaaagaaaaaccacaatgagataccacctcacacccatcagaatggctgtttttcataagtcaaaaaataacagatgctggcaaggttgcagagaaaagggaatgcttatactcttctggtgggagtgtaaattagttcaacaacagtaaaaagcagtgtggtgattcctcacagaactaaaaacagaattatcaatttgacccaggaatctcataattgggtatatagccaaagaaatataaattattatattataaagacatattcacatgcatgttcattgcagcactattcacaatagcaaagacgtagacaggccctgaatgcctatcactggtagacaagataaagaaaatatggtatggtcagatgcggtggctcatgtctgtaatcccagcattttgggaggccgaggcaggtggattgcctgagcttagaagtttgagaccagcctggtcaacatggcaaaatcctgtctccacagaaaatacaaaatgaaaaattggccaggcatggtaatgcatacgtgtgtagtcccagctacttgggaggatgaggtaggagagaactgcttgagcctgaaagatggaagctaaagtacgccaaaatcatgctatggcactctagcctgggcaataagcctatctccaaaaataaaataaaataaaagatttagtaaatacaaaatatggtacataaacatcatggaatactctgtggccattaaaaaaaaatgaccatgtcctttgcaataacactgatgaagctggagacaattattcttagaaaactaatgcggagtccaggcatggtggctcacgcctgtaatcccagtactttgggaggccgaggtgggataatcacctgagttcaggagtttaagaccagcctgaccaacatggagaaacccctctctactaaaaatacaaaattagctaggtgtggtggcatgcgactctaatcccagctacataggaggctgaggcaggagaattgcttgaatccaggaggcgaaggttgcggtgagccgaggtggcacaattgcactccagcctgggcaacaagaacaaaaatccatctcaaaaaaacaaaacaaaaaacaaacaaaaaaaagaaaattaatgcagaaacagaaaaccaaatgcatgttattatttataagtaagagctaagtaataagaacacatgaacacaaacagaacagacactgaggcctagttgaggggggagggtgggagcagtaagaggatcagaaaacatacctgttcggtggtatgcttagtacctcagtgacaaaataatctgcacttcaaacccccatgacgtaattttagttgtataacaaacccacatgtgtacacccaaccaaaaatcaaagctaaaaaaagaaaaaaaaaaaatccctgcgtgggagagagtgcaatgtaggtgaatggactgattttcattacagatagtggcccaggtggggctgttttctgatttatctttgtttgcatgcagacagatgagattataaccgggaggtccagaaccttaggttggtggaaaaaacaggttggtgcggcagattctgtatctaggggtggggatatgccaggagacctgtagagacttttgggttcttggcaagaaacgctaggatcaaaaatgccatggtgaagttcctgagggtggtgcccagtactgggaggagtgaggacatgtcaatgtctactgtgtgtgtttaggagtgggtgggaatcctgtggtggcagctacaagaaaacagggtctgtcatcagaactctttcctctaagttttcagtcttctgtcaccctggaagaagaccttaaatcacaggacaacaggcagtgtgacagcctgtgtacaggagagcagagcctcccattttcaaatacccagagctttgttccaggtctggccccagtgatatcttttttctggcaccaaatctatagagtttgctgaatatcaaacaattctccaacaccaactcattgcctaataattgaattctgacaccacctagagacagcacagaccctgatccagggctgggtcccacaacattgtcctcactgcagaggccaatcaaaaaccccataggcccatctatgcttctgagctactgtttgaaaactgaggactcccaaaacctccctgaagttcaataatttggtacagctacttacagaactcagcaaaacattgtagttatgtttaccggtttcatataaaagatgcagcccaggaaaagccaaatggaagaaatgcatagaacaaagagatggggaaagatgaaacacatagaaaatcctggaaaatatttgtgattaataaaattctccaccttttgtgtgctccaggaacagtatacggaaagaaacgcctttctcattatgacttagatggtgctctcttttcttacctatcacacagccagacacacactctgtacattttctcctttttctcattaagaaattcagctgaatttgtcttcagtggtcaaaataattttttttttttgagatggagtctcgctcggccacccaggctggagtgccttggcaccgtctcagctcactgcaacctctgtctccatggttcaagcaattctcctgcctcagcctcccaagtagctggcattacaggtggccaccacaactaccagctaatttttgtatttttagtagacacagggttatcaccatgttgaccaggctggtctcaagctcctgacttgcggtgatccgtccgcctaggcctcccaaactgctgggattacatgcctgagccatggcgctcagcctaaaatatttcttaatcaaactttacttaagtttatctccatccctcaggctagtgagggatggagataagccatctccaatgtaggagaaaagcccttttctgcctacatttttgcaacccatgaagattttttagttagctggtacttcttcctgttgcaatacttcttaggaattcattttttttttacataaatctaatattcttattttagaaagcgtaaaaagtgcctcaaaaccataacaacttcattaccagtaagaccctcccagtttcctttcatcttaatcttgactgcatctgcctgtggggccccagctttccaaggctttgtagcttctttcagaatgaaggctccttccgtggctggggtgagcagtcttgagatatccgcaagggagactccccagaaaaaaataacagggcctttaataacctcctgttggccgggtgcggtggctcacaccgataatgccagcactttgggaggccgaagcgggtctgaggcagagagttcaagaccagcctgacaaacatggagaaaacccgtctctactaaacaccaaaattagccgggcgtgatggtgcatgcctgtaatcccagctactggtggggctgaggtaggagaatcgcttgaacccagtaagccgagatcacgccattacattccagcctgggcaccacaagcgacactgtgtctaaaaaaaaaaaaaaaaaaaaaaaaataccctgttgcaggcttaatattagccttagcttggagtcactaggttcaagctttaatgtccacatcagttattcacttggtttttgaaactaagtgttagaaactccagtgaaattactcacaatgtttacataaaggaatttttaagatgcttactttttttttcttttttttgagccggagtctcgctttgtcacgcaggctggagcgcgatgattggatctcagctcactgcaacttccgcctcccgggttcaagcaattctcgtgcctcagcctcccaagtggctggtactacaggcacgtgccaacacgccgatagttttcgtatttttagtagagacgggtttcaccacgttggccaggctggtctagaactcctgaccacgtgatccacctgcctcggcctccgaagtgctgggattacaggcttgagccaccgcgcccagcaagaaaggggttttgaaccctaatgcagttcctgtttttgtttccatcccctattggctgggatcagaccgcacaatctaagctgatcctggtaagcttagacccaaactttttccaaataaagtaaatgcgcgatttgcgagaaaaggaaaagggggtagaagaagaggtagggttgatttacaacttttacaacttatgaccagaaagttgagtcatttaaaaggaacttagttgtcctaacacctctttacctcaagtgatccgcccgcctcggcctcccaaaacgttgggattacaggcgtgagccacagcgtccggccccatacatttttaataggagaaaagagaaactgtaaacccaaaggaacaaagctcttcccattcatgaacccgcaccccgagtcaggattctcccctgcccaccctcccctggtccctgcacaatctgggagagacgccacgctgcgggtgcagagctgcccagagagggctccaggccagggtagtcaccgcgcagtgaagagacaagacgcccgggtgccggctgtcagcgcagctgccattttatggctgaacaggactgaggccgagctgagcaaggagaactgggggagcagactgtggagctgactgcggggaggcctgagtcccgccacagccacttttcaccggttccaaccagtccctctcctctctcgggatgtcggaccctcactctcaccatttttggcttccaggaggtcccggtgtcttagctgtggatctcccaatacctgcaggacacggggccacacagcctgggcctttaggagaagaaccagacctggagctctgactgcagcgagagacaaaggccgcaccaaacccggaaaccgtcctcttcgctccagctgcgttcctgattggatggtttccagcccaccatccctgattggataatgcttaaggccccgccccctgaggccctgagtgacagtagatgtgatcagacgctgagctgagtgaagaaagagtgacagcctaagctgcagccttttcaggcagggcttccttcctgagctgagccaggcccaccccagagcatgggagaattctatcttttctttactctctctctttttgaatgtattcaaaaggtgaacagaagtattttgctctcatattaataatacataaaatttttgttcaagagaaaatcaacttttactttggcaataatgtattatcaatactaaaggtaattttgataaaaccttataaaaaatcaaatttgtcatttttgacctctcgagatttacatacatattttgtaatctaatgtaattttttaactttttatattttatttttatctacattctttttattttttcaatttgaaacaacctttaagtaatttcaaactgttacaagagacaaagaaatcatttagggccagtccgctggtgcacgcttgtaatccaagcactttgggaggccaaagtgggtggatcacttcaggtcaggagttcaagaccagcctggccaacatgttgaatctcatctctagtaaaaacacaaaaaattagccaggtgtggtggtacacacctgtagtcccaggtgctacggcggctgaagcaggggaatcgcttgaacccaggaggcggaggttgtgtaacggcctaagggcttcatcttgcctagacagagatgattcatcaagacaggggaatttgtggaggaaaagttaaatattaaatttgaactcagttgaacatggacacaaacaatggtcaccaagtcctggaacaggttatgtgagccccttgaggcattcacctgccgaccttcccctggtccctgcacaatctgggagagacgccatgctgcaggtgcagagctgcccaaagtgggctccaggccagggcacagtcacagcgcagtgaagaggcaggacttctgggggcctggctgtcagcgcagctgccatcttctggctgaatgggactgaggccaagctgggcaaagagaactgggcacagattgttttggagaaatctctattttaatctattcctatacgttagttattgaaaaacaatagccaatcgcaaaaaaaacaagttgacttttttgtgttccttgagcccagttgcaaagagcccagttgcaactgggcctcatgccaaacaacttgttacaaaaagagctaggatcccagactgcaccaaagctccaaagacctctccttgtctgtacagggatgggtggccgactctggagcccaggctgttgcttcctggtctgctgatgaatcctccatagtctggtgagtgtaaagatatatattttttctcttctccccttcccattgcaatgctcttattatatcaatttgcttattatatatgcattgccatttacctgggataaagcttgtttacccttaaaggtattgtgtgcgtgtcttttcttctcccctcatgtgtttcctgcacagaacatatttctcaaaggcttcatttgttcctttttattcatttttgtttaatcttgtctgcatgccttattttggcaaggtggtcttcaaactctgatgttctttcttctgcttggtcaatgcagctacaaatacttttgtatgcttcaggaggttctcatgctgtgtgttttagctccatcagatcatttatgttcctgtctaaaccagttattctagttagcagttcctctaaccttttatcaaggttcttagcttctttcaattggtttagaacatgttcctttagctcagcagagtttattacccatcttctgaagcctacttttgtcaattcatccatctcatcctctgtccagttctgcacccttgctgaagagacattttgataacttggaggaaaagccgcactctggcctttcagagttcttttgttgattctttctcatcttcatgaacttgtctagttttgatctttgaggctgttgacaactgaatggttgtttctgttttgttttgttttgttttgagacagagtctcactctgtcacccaggctggagggcagtggcacaatctcggctcaatgcaaccttcgcatcccaggttcaagtgattctcgtgtctcagattcccgagtagctgggattacaggcatgcaacacaacgcctggctaatttttgtattttttagtagagatggggttttgccatgttggccaggctagttttgaactcctgacctcaagtgatctgcctgtctcagcctcccaaagtactgagattactggtgtgagccaccatgcccggccttggatggggtttttgtcggtacttttttgttgttgatgttgttgttttctgtttgtttgtttttctttcagtggtcaggtccctcttctgtagggctgctgcagtttgctgggggttcacttcaggctctattcatctggttcactcctgttcctggagatgtcaatcaaggaggttggagaatagcaaagaagagtgtccgctccttcctctgggatctctgacctcaagaggcaccaacctgatgccagtaggatcgctcctgtatagggtgtctgacaacccctgttgaagggtctcacccagttgggtggcatggagaggagaacccatttaatgaagcactttgttccttggtggaggggagtgttttgctggggggaaacccactcatgtgggctgcccacatttttcagaactagcaggaggaaaggctaagtctgctggtccacagagactgcaactgtagcaggacgagccacagacaaaactcctcagacactgagttaaagaaggaagtggtttattcgaccgggagcatctggcaagactcctgtctcaagagccgagctccccgagtgagcaattcctgtcccttttaagggctcacaactctaagggggtccacgtgagagggttgtgatggattgagcaagcagggggtacgtgacaggtgctgcatgcaccggtggtcagagtgaaacagaacagaccgggaagtttcacaatgtcttttctatacaatatctggaatctatagataacataaccggttaggtcaggggttgatctttaactaccaggcttaggtcaggcaggctcaggcctggtttcaggtctggttccctggttttgtgtctggttttgtttcgcttttcttttcttttcttttctgagtacaaaacaatataaaacaatatgagagggtctgtctctcttctctcacagccaccccttcccctaggggctcaggtccagggacatcagaattctgtccctgagttcctgactggagctgttggagttcctgcagggaggcccagcccagtgtggagggatgagtcagggtcaggcctgaagagacactttggccgctgtctgccacagccagtgtgttgggctgtgggggacacctcttgagaccaagctgtccaacctccctggctctagcaggggaaaaatgcagccaggagctctagaaatggctgctgcccttcccgtgccgagggagcttagcctattaggcaactgggagtctcagtgctggctgctgtccctcctccaaggagctcaaaatgctgagactgcaggcagccacagccatggtgctggtcgcccctccctcgggacctcagcaggcttaagcagactctagctgagaggctgttaatccgttcaactccggggttggaatctgaggctccagtgccgtgggttcacgagcggaatcttctgatctgtggattgcacagtttcatggaaaaagcacggtttcctaggctgggtagcctgctcagtcaccgcctcccttggctgggagatggctgtggcaggactcaggcctgccgcactcagctccaaaatctgctcccggagtttttctcgcccagctcggcctctgttcccttcagccataacatgtttctcttccctgcgcagtgactgcgccctggcctggagccctctctgggcagctctgcacccgcagcgcggcgtctctcccagattgtgcagggaccagggcagggtaggcaggggagattcctgactgggctgcgggttcacgaatggaaagagctttggcccgtggggttcacagtttttcttttctcctattaaaaatgtatggggccaggtgctgtcgctcacgcctgtaatcccagcacttcgggaggccgaggcgggcggatcacttgtcaggagttgaagaccagcctagccaaaatggggaaaccccatcattattaaaaatacaaaaattagctggatgtgatggtgaatgcctgtagtcccagctactcgggggtcagaggagagagaatcgcttgaacccgggaggcagaggtggcagtgaggtgagatcgcgccactgcactccagtctgggcgacagagcaagactctgtcaaaaaaaaaaaaaaaaaaaaaggaagtcaccgcaaaaataacaagtaatttaaagagtgattcaagaattgtagagcacccagctacagtttgtagtttgtggtccatgggagaggcttgaagaaaagacatttataaggtgcatgatgaagaacactaaattcaataattggttagatatagttaggtagtttcttaatttgtacaatcaaggtggaaatttcctgattatgtaatcagagcttaattggcattttatagttgtttaagcttgaattgtgtttcccctaatgtagcgatttaccaaaaaatgcactcgagtttatatttttttcttagaagtagcaatccagggaatagagcctcttcagtctctcagactcctaaagtctaattgcctgccacttaattattttcacaccccacaggggactgattttctctggcatttttcacatgtgtcccaagtggggcctcaagtgtaccccatgttcctcaattaatcatttttaacactattaaataaatttgttttctgtttgtaaatatctcccctgagaagaaagaaaagaataatcccctgacactgtattgtaaaaatatttgtgcctctttttcttctatttttccagagaacttaccggaatgtttttaggtcaagattacccttcggaaactttatagggtgatgtgtcctcagctatccttcagttttttttctgggcctgggttttagtactttctggggataaaccaagatacccaccatggctatgtctgctggagtgtctagtgactattagctcttgggtcattttctcccataggaccacgtgaagtatggagtgtagcctctcaagggagcaggtggcagccctggggctgaaaggcatctcctggtgcacttttttttttttttttttttttttgaaaaactaactccttgagacatgaagattgtcttcaaccaacctagcttccatttcttggagacacattgctgggcagccaatcagatgctgatattgaggggaaaacagataatttctgccccctggattctcttgagtggggcagaaaaatagtgacaaaaaatagtgaaaaatttggaaaaaaaaaaaaaaaaactccaacagacaaaaaaaactgaccccagtgtgatggcataaaaacttatgaagtaaaatgtacctggggcactcactggggcatagcgcactatctcctgggagggtggttattgagcatgtaagtgaacaggatgggataggtaattggatgtgtaccttgaaaagatttgttcacttattttgacctcaggtatttatttatttatttatttatttatttatttatttatttatgagacagtctccctctgttgcacaggctgtaattcaatggctcgatctcagatcactgcaacctccacctcctgggttcaagtgattctcatgcctcggcctcccaagtagctaggtctataggtgtgcaacactgcgccttgctagtttttgtatttttagtagagatggaccaggctgatcccaaacttatggtcttaagtgatccacctgcctcggccacccaaagtgctgggattacaggcattagccactgtacccagctgcatcggttttttttactgtaatttgcattttattcatagggcttaaaaggtaagaaaatatttacaaaggacagaaaagagatgagtttcaaaaaattggtatttaataatatattccatttattaataattctcatttacctttttctttcccagagtaagcttaggaattttttcagatgtgttttttatggctgagttatttcaaacaaaattccaagccttagctttaagaatgctagctaccagctaagcgcggtgtctcatgcctgtaatcccagcactttgggaggatgaggcaagcatatcacgaggccggcagttcaagaccagcctgtccaagatggtgaaacaccatctctactaaaaatatgaaaattagccaggcatggtggtgggcgcctctaatcccagctaccctggagcttgaggcagataattgcttgaacctgggaggcaggggttgcagtgagccgagatcacgccactgcactccagcctgggtgacagagtgagactccatccccatctcaaaaaaaaaaaaaaaattagagcaaatctttctttcattttgactgtggacaatgaatatatttccacaggaaaatgtggtagataatttatggattacatagattcgtcaaaacaccagttcctctttttgcagggtaaatttgtgacagtgaatatcttagttctatatcatgttgccttgatttcttagtttaatgctaaattatatatgataaaacttatgtaccttctacaagtgtccccatatgactaattttttacaacactatttttaatagaaataataaaataatacatgtattttctgaaagaagtagacatatttgcttttcttatggagatacaaaatgcaggcaccttagccattttcagtggttcacacctgcaatcccagcactttgggaggccgaggcaggttgatcacttgaggtcagggtttcgagaccagcctgcccaacatggcgaaaccccgtctctactagaaatacaaaaattagccgggtgctgtggcacatgcctgtagtcccagctacttgggaggctaaggcaggagaatggctagaacctgggaggcagaggttgcagtgagctgagattgtgccattgcactccagcctgggtgacagagcgagactccatctcaaaaaaaaaaaaaaaaaagtaagcaccttaaaatttccttcccttatgtaaacacttagagtaatttcactggatttttcaagcagttagtttcaaaatcaagtgaataactctgacatggaaattaaagctttaacctagtggcttgaatctaaggctaatattaagcctgcaacagaaggttattagaggcagagttagatttttttttttttttttttttgagacagagtctcacactgtcgcctcggctggagtgcagtgccaggatctcggcttactgcaacctctgcctcctgggttcaagagattatcctgccccagccttttgagtagctgggattacatgtgcccgccaccatacctggctaattttttagtatttttagtagagacagggtttcactatgttggccaagctggtctcgaatgcctgaccacgtgatccacccgcctcagcctcccaaactgttgggattacaggcgtgagccactgcgtctggccaaaggcccagttacttttttctggaaagacttccctgcagatgtgtcagcctgctcaccccagccattgaaggagccgttgttctgagagaagctacagcgccctggaaagctggggtcgcacaggcagatgcagttgaggctaagatgaagggaaactgggagggtcttactgatcatgaagttgttattgttttgaggcactttccagattttgtaaaataaaaatgttagatttatgtaaaaaaaagaattccaaaaaattattgcaacaggagaaagcaataaccaactataagatctttatggcttgcaaaaatgtaggcataaaaggactttcttccctagggaggagcaaacaagtttagaaaggaggtgggagggaaatggcaaatggaggatgaaaaagtcagattttggatcagagaatgtcttaccctgaaatcagcatgttcttaggagggatgtaaaataaggttgtatgttgactcaggctgagggtagctcaaagttcaggagcctgagggagtgagataaccctaagtaaagtttgattaaaaaatattttattttaagctgggcacggtggttgacacctgtaatcccagcactttgggaggccgaggcaggcggatcacctgaggtcaggagtttgagaccagcctggccaacatggtgaaaccctgtgtctactaaaaatacaaaaatgagtcaggcatcctggtgggcacctgtaatcccagctactcgggagacttgaggcaggagaattgcttcaacctgggagaaggatgttgcagtgagccaagactgtgccactacactccagtctgagcgacagaacgagactccatctcaaaaaatatatatatatattgaccagtgaagacaaattcaattgatattcttaatgagaaaaaggagaaactgtgcagagtgtgtgtctggctgtgtgatatgtaagaaaaagtcataacaggaagagtgtttatttccataaactgttcttggagtacacaacagatggagaattttattaatcacaaatattttccaagattatctatgtgtttcatctttccccatctctttgttctacacatttcttccatttggcttttcctgggctgcctcttatatatgaaactggtaaacattattacagtgtttttctgagttctgtgagtagctttaccaaattattgaacttcagggaggttatgaaagtacccactttttaaacagtagctcagaagcataaatgggcccatggggtttgtgactggcatctgcagtaagaacaatgttgtgggactgaatcgctgtctgtgctgactttgggtagtgtcagaattcaaacgtttgacaatgagttggtgttggagaattgtttgatgttcagaaaactctacagatttggtgccagaaaaaagatatcatggaggcctggcctgtaataaaactctgggtatttgggaatgggaggctttgctctcctgtacacaggctgtcacactgcccattgtcttgtgattcctcccaaggtgacagaagactgaaaacttagaggaaagagctctgatgacagacccccttttcttgcagctaccaccacaggattcccacctactcccaaacacacacactagacgtgacatgtccacactcctcccaggactaggcaccatcctcagaaacttcaccatggcatttttgatcaaagtgtttcttgccaaaaagccacaagtgtctgcaagtctccttgcatatccccatccctgaacaatgaatctgcagcagcaacctgttttttccaccagcctagggttctggacctcctgttcataatctcatctgcctgcatgcacacagaaatgaatcagaatacagccccacctgggccactatctgtagcaaaaaattattcctttcacctacattacactctgtcccacccagggacattttttttcttttagcttttattttttgtttgaggtacacacgtgggtttgttaaacagctaaaattatgtcacaggggtttggtgtgcagattattttgtcactgaggtactaagcatagcaccaaacacgtatattttctgatcctctgagtcctcccaccctccgcccttaactaggctccagtgtcttgtttttctcctctttgtattcatgtgttcttattacttagctcttacttacaaatagtaacatgaatttggttttctgtttctgcagtagttttctttttttgttgttttttgttttgttttgtcttgagtaggagttttgctctttttgcccaggctggcgtgcaatggtatgatctcggttcaccgcaaccttcgttttctggattcaggctagtccattgcctcagcctcccaagtagctgggattacaggcgggcaacaccatgtgtggctaattttgtatttttagtagagatggggtttctccatgttgatcaggctggtctcaaactcccaacctcaggtgatccacccgccttggcctcccaaattgctgggattacaggtgtgagccacagtgcccggcctctgcattagttttctaagcataatggtctccagcttcatcaatgttattgcaaaggacatgatcattttttaaatggccacagagtattccatgatgcttatgtaccatattttgtttttactaaatcttttattttattttatttttggagacaggcttattgcccaggctagagtgctatggcatgatatttgcttacttcagtctcaacctcccaggctcaagcaattctgtagccctcatccttctaagtaactgggactacacgtgtgcgttaccacacctggccgatttttcattttgttttccgtggagacaggattttgccatgttgaccaggctggtctcaaacttctaaactcaggcaatccagctgcctcagcctcccaaagtgctgggattacaagcatgagccaccgcatctgaccataccatattttctttatcttgtctaccattgataggcatttagggcctgtccttgtctttgctattgtgaatagttctgcagtgaacatgcatgtggatgtgtcttgataatataataatttatatttctttggatatatacccaattatgaggttcctgggtcaattgataattctgtttttagttatgtgaggaatcaccacactgctttttatagttgttgaactaatttacactcccaccagcagagtataagcattcccttttctctgcaaatttgccagcatctgttactttttgacttttaaaaaatagccatcctgatgggtttgtagtgttctgaccagtgtgatgtggcatctcattgtggtttctcttttaatttctctaatgattagcgatgagcattttttttcatttgcttgttagccacatgtatgtcttcttttgaacagcatctgttcatattttttccctctttttaatgagattgtttggttttttcttgtaaacttgtttaagttcttaagaaattttgattattagacctttgtcaggcaaagtttgcaaatattttcttttattctctaggttgtctgtttactctgttgatagtttcttttgctgtgaagaagctctttagtttaaataggtcccatttgtcaatttttgcttttgtggcaattactttcggtagcttcatcatgaagtctttgccagtttctatatctagaatggtatttcccaggttatcttgcagggtttattataattttaagtttttcttttcagtctttatcttgagttgatttttttatatggtgtaatgaaggggtccagtttctgtcttctacatagtgctaggtagttattccagcatcatttattaaagagagaatttttcccacattcttcttgtcagtttcgtcaaaaatctgatgggtgtaggagggtgatattatttctgggctctctattctgttgcgttggtcttgggcactcatggattttttataacatctttctctcttctgctttttctcccataaacattctttcaagcgcatctagtgtgcaaaattcagatgttcaagagttcaaaaactctttaaaaagttccaaaaaatattttgctattccctcttttcttaagggaattagattatttgtagatgtttttctctgcttttttgaaatacaggtaaatcatattaacagctgaataaagcttttgtcagataatctgactccagattatctttctctagtacttcagatttattgctttgtttttgcttctcgaaaatttattttttttcatttttagtcctctaaagtagacacagatttgtttggataagagctaattttaagagcacacagaaacttaacacaaaaataggaataaatttagcaatacagaatgataaagactaaaagacactaagtatctttgacagaaacctgatgatccaaagcaattatgcagtatttgcaggctgaaggacttatactgcgaaagcaagaacagttcagtgtataaactaaacagtggagtctgtagttgtaccttgctttctattgattacttcagaacaattagcatagttatgtgtagtgtttgtagacaacctgcattcatatacattaaacagtactttctttcttttgagacagagtctcactgtgccacccaggctggggtgcagtggtgtgatctcatttcagtgcaaccactgcttcccaggttcaagcaattctcctgccttagcctcccaagtagctgggattacaggtgcaagccaccatgccaggctaagtttttgcatttttagtagagatggggtctcaccatgttagccagcttgatcttgaactcctgaccgcaggtgacccacccgcctcactcttccaaaatgttggaattacaggtgtgagacataaacagcattgtctacaatcgtatgaagataaagctgaaatacttactttgaatgaatcatttaaatggttattttagtatttttttatacttttgaaatataaagtgttttaactgaaatatatttgtaatttttaaaaatgctacatacattatgactagttcattaaaattattcatacttagatatcaaatatccaaagaaaattactatgaaattgttacagtaagtagatattcgtctgaaatgtttataactttattcaatagggataattataagtaaacacaatttaagtatcttttatttcactaaatttgtatgctactgttacagggcaaataaagacaggtgatatggcccctgagaaattgctagagtctgtggcacaggagggcacctgagaacaggaaaggagaaacttatatttttatcttcatggagcagctcatttttcctgaatctcttctgttttaaaggacagaaatgagtggacattttctgtctttgtttttcttccagttgatgttatgatagcaggtaaacatgtggtactgacatctttaaaggcatattctcaagatgcaggtgtaatttgtccagagaatctcaactgagaataaattccagagaaggaggagaaagaaaaaaagtggctttccttcaggtaaacatgtgtcagatgaagagctgtgtcaacttttcctcttggactgccatgcgtttaatactcacaaacctttacttctctacttgtgtttttcctccctaatgagtttggtttaactacttctttaaattcttatgatagtcaagggtttctgaaaaatatttctttcctatattccagagccttctctacattctcttcatcatagcttcttatatgccatgcagaattctcagcaagaatttatgatccacaatgtaggatacgtaaatttatcttcaaaggttttagcttgttaactttaaaatccaaaaggtgaagatcattaagtacaatgagttctgaggtcctcttcaaagaatcaatatgtcagtatgttctgctttcctgttgtttattctccattttaaagtttaacttcctcaatctttatgttccttgctcctagtttagtaaacaacccccttctaactcacatatttagagtttttagtcatccctcatcacctgctgtatcctgagtcaccccagtcacctgccttgtaactctcctttctgccaaaactactcaccatgccactctggcttgtacccttggtccctttaaaatagcctatcaaaattagcttaaactgtgtggtccaaccctacccaataggggaaacacacagaagtagggactagccgccttagggataagacccccttctcctcccttgtccaaaagtactctcaccattgttccatccacgagatgctgccttctatagaagtaaatttgccttgctgagacgttctctgtttgagtgcttgttttctgtttgactctgagcaattgtttccaacatgcaatatcaaaaatgttccctttgtggctgttgaacatggaaagaagtagatactcaagattcctattaggaaaaactgtggtccttagtaaagatggagaacatgtaatgttgaggctccatctgtgtgttccattagctctgtgcagaacaggattaagaaaatgcttatttaaatgagatggaatttattacccagaaagatctgaaaaaacttattaagagatacctgctctctagggtgctaaatgaagcctacttaaaattgctactaaaaattacagaacataggagtaatctgtactttgaagttgacataacacatgtttcttcatggttaaattcagattttatttacttttttgggaggaatatttcaacagtgatgctgtgttcttgtgcgtgtggtcttccttggtgagtataacttgaatacataattcataatataccctaaaggttttatttctctttttttctagaatattttttactaatttattctttgcatagaagagttttggatgcctttctccagaaaatgttcagaatttgttcatttagaaaacaatttcttcaagaatttttatcttaatccaaacttttgacattcctaagatgagttgtattcttaaccctgaattagtggtaattccagcagtttagtggcataaaatactgatacccccacctgaaaatctcattgccatcaccaatttttgattcagtagtaccaggtagtaaaatttaaaaacctacaaggagggtcaggtgcggtggctcattcctgtaatcccagcactttgggaggtttaggcatgtggattgcctaaggtcaggagttcgagactagcttgaccaacatggagaaactctgtctctactaaaaatacaaaattagccgggcatgatggtgcatgtccataattccagctactctggagggtgaggcagtagaatctcttgaacccaggaggcagaggttgcagtgagctgagatcacgccattaaactcctgcctgggcaacaagagtgaaattccatctcaaaaaaaaaacaaaaaacaaaaagaaacctacaagttgaaagtattttctatatatttagaagtttctgttataacttagtattttggtaataatttactagtgttgcaggaagtcagggaccccgaatggagggactggctgaagccatggcagaagaacataaattgtgaagatttcatggacattttttagttccccaaattaatacttttataatttcttatgcctgtctttactgcaatctctgaacataaattgtgaagatttcacggacacttatcacttccccagtcaatacccttgtgatttcctatgcctgtctttaatctcttaatcccatcatcttcataaactgaggaggatgtatgtcacctcaggaccctgtgttgattgcgttaactgcacaaattgtttgtggagcatgtgtgtttgaacaatatgaaatctgggcactttggaaaaaagaacaggataacagcaatgttcagggaacaagagagataaccttaaactctgaccgccagtgagccgggtggaacagagccatatttctcttctttcaaaagcaaatgggggaaatatcactgaattatttttctcagcaaggaacatccctgagaaagagaatgcatccctgagggtaggcctctaaaatggccatttcagggggcggccatcttttatggtcaagctgtagggatgaaataagctccagtctcccatagcgctcccaggcttattaggatgaggaaattcccaccaaataaatttttggtcagaccagttgtctgctctcaaaccctgtctcctgataagctgttatcaatgacaatgcatgcccaaaacttcattagcaattttaatttcaccctggtcctgtggtcctgtgatctcaccgtgcctccatttgccttgtgatatcttattaccttgtgaagcatgtgatctctgtgacccacaccctatttgtacactccctccccttttgaaaatcactaataaaaacttgctggttttatggctcaggggcctcccggaacctgctgacatgtgatgtctcccccagacaccaagctttaaaatttctctctttgtactctgtccctttatttctcagactggccaacacttagggaaaatagaaaagaacctacatgaaatattgggagtgaatttcacccaacatctggctgaatttcccctgataactggaatatatatgcatatatatatatatatatatatatattttttttttttttttttttttttttttttttttgagatggagtctcgctctgttgctcaggctggagtgccgtggtgcaatcttggctcactgcaagctctgcctcccgggttcacgccattctcctgcctcagcctcccaagtagctgggactacaggcacccgccaccatgcctggctaattttttgtatttttagtagagacggggtttcactgtgttagccaggatggtctcaatctcctgaccttgtgattcacccacttcggcctcccaaagtgctgggattacagtcgtgagcccctgcgcctagcctaatttactagaatattttatcacatcctctctgctgaacacattactagcttgtaattggagaatatgagcaagattcatgttatttatttttaataaaacatgtattggtgtctctgaaccagacctgatcacctgtctggagcaggaaaaaaaacctttgactatgaagagacatgagataattgccaaacccccaggtaggtgtgagtgaaaatgaatacaacagatgacacagattagagatcccaaggtcaaagagaaagccagtccttagaatgtgatttgggaagctgtgttccaaaggaaatagttcctgggcatctgttctattgtttgtttgtttgttttttaaattttattctcacaaaggggtatcttctgtcttgtgcttttaaattctctacaaattccacttttctttccgtgagcttccttcaagttcacagtgagagccaaagtccacttcagggcatataagagactgcacaatctggctgcttttctattgttttggggacacacaactatctgcatgattttgagaaactaaaagtttttaaagtttttttttgcatcagatttgaaatgtgtgggagtagttgtttctgttgaatatttttgttcatttttctgcccagcccattctgtttttattactatatagccttgaaatatagtttgaaattataagtatgatatttttctgctttgttcttttttctcaagattgctttggctattcaaagtttattttagtttcatgtaaattttagaattgtattttccgttactgtgaaaaaaataccactgcaattttgataggaaatttattgaatctatagatcactttggataatatggcactttaataatatttattctttcaatctgtagacacaaaatattttaaaatttatttagatcttctctaattttttcattgtttttttttattgtgaagatttttacctccttggttaattttttctcacaaatttattatttaatgctatagtaaataagatttgtttcatcttctattttatctggtagttgaagtttctgaaaccatatatatacttgcatgttaattttatattttgctaatttacgagtgtatttattagtttatgtagcttttaatgttctgtgatggtttttctaaaatataagattgtatgatctacaaacagcaactttttacttatttttctttcatttcaatggatttttttgtttctttgagtaattcttctgccacatacttccagttctacattaaaatagaagtattgacaatggacacaatatagttttgtattggtgtctgaatttgatggagcaaacacctcttcaagttttcatgaactgattttagaaggtaaggatctttctttgggcccttggggttatgagatgccctctgaatttgtagtgaagaggggttgtagcttggtcacaaggccgctgggtctgcactagggtccacctttagttggcttgttacaggggcttgggtagtcataattctcattttgttttggacacgctgcaaatttttcaggactttgctccatggggcagacactagggcatgtttttgcagttgggtctgcatatggtgggccttatatcaggacatggatgagtatggctttcactgagtaccagagagcatttcctcatgtaactgtttgggtttctatgtaggcaaaactggccatgaactgtggctcaggtactgaaactgagccattgaacgacttcagggaccacagcaaaggccaaggtctacaagtctgcctgcatggctgtaaatgggtatcttccttcaggtctctggaatggcaggacctctcccagactgtggctgggaggagtttgggatggttacagagttaagttcagaattctcagtgggatcaagttgggtgaaccctatcctggtctgtagccaaaaacaggggtcctgtagtttcccacctgaatgacatcctgccttcttaatagaacacttctcaatcttaagctttagtagtgtttcacaactccctcctgggatctcaaatctctcttcgagacacttattttggagatggcatcttgctgcttaacccaggctggtcttgaaatcctggcctgaagcagttctccaaccttaatgtaccatgtagctgtcattacaggtgtgagccataatgcctggtttctcataaaggcatttttgtcagggatggctgacttttttttttgctgtgaggggatatgaaaatagggcacttttaatctttttatcttactgatgtcactctccctacacatttttactttctattttctctttcagatttgcctgtaattttagattcagatatttaggacaatatgctagaatttgatggtattcctgaagtaaattagataattagtaagcactccatatttactcagttatttgtaaatttaagtttgccacaggcaaaaaggaattatagtattttcatctactttcttcagcttacatctacataataaaatagtttatttcctaatatttgtttcacatatcagagggtctcactttattctgcaaaatatatatgtgtatattttctatatttaacaatgtaaggctgttttttgcttctaaagttagattacagcagtttcattttgtgtaagaatagcatatatttaaaacataaaaaataacgttggtttattttaaatgcttatttattaaaagtttctcatcgtgttacccagactggtctcaggattttggccccaatggatcctcttatcttgatctcccaaagtgttaggattataggcaacagccactgcactcagtcagtatttttaaatttaataaaatttggtgtgtgtcctaacagcatacaccagatgcagataagaatattgtacattatcctggttttgactggaaagttttgtatgtgtctgtgaagcctagttggtctattacatggtttggatgttcatgttatccaaagctcatgctgcaatataaatcctcaatgttggatgaaggacgtggtgggacatgtttttgtatgggggcatatttctcatgaatggcttggtacatcctcttggtaaccaaaaagtttacactctattaattcaaatgagagctggttcattacatgaacctggctccttcacctcacacttgctcagtctcttatcatataatatgtccagttactgtttacattccaccatgacggtaagtttcctgagacccacaccaaaagcagatgctggcacacacttcttatacagtctgccaaactgtgagccaaataaactttttttctttgtaaattatgcactctcaagaatttctgtatatgcaaaataattagtacagtctataatgttgcccaggttttctgtttcttattttttatttgaattttctatttattattgcaaatggagtcttgatgtctacaattattatgttactatgtatgtcttgcttcacttttgtcaatatttgctttatttattttggagctctgatgttatatacacacattcatatagataaataaatattatagttaaagattcctggtaaatcagctcactttaccataatatattatcaatttttgtctcatggtagtacttgacttaaagcataatatgtctaatataattatgatcacttcactcacttgtggttactattttcatggaatatacatctttttcattcggttactttcagcctatttgactgaatgctaaaatgagtctcttgtaggcagcatactgtatgctttttagaaaaaccactcacactgggcatggtggttcacacctataatcccagcactttgggaggccaaggtgggtgggtcaactgaggtcagtagtttgagaccagcctgtccaacatggagaaaccccatgtctactacaaatacaaaaattagccaggtgtggtggcatgcacctgtgatcctagctactcaggaggcagaggtgggagaattgcttgaacccaggaggcagaggttgcagttagccaagatcgcaccattgcactccagcctgggcaacaagagcaaaattcagtctcaagaaaaaaaaaaaaaccactcaggcatcctatatcattttctttatattatttatttatttatttattttaagatggagtttctctcttgttgcccaggctggagtgcaatggtgcaatctcagctcactgcaatctccacctcccgggttcaagttattctcctgcctcagcctcccaagtagctgaaattacaggcacccacaaccacacccagctaatttttgtagtttttgttggggtgatcagatccaacaccaggttgtgggggctacgaagtctggcagagtcaaaggaatgggacaagacaagttaagagtacatagggtgggtccaggaggccaaagccagtttggaggctgtgaaggccctgagttctgggagtccacactatttattggtaatcaaacaatgaagcaggtgctgaggacgtgtggatatgagggtagacaggtgaggacgtgaggatagaaaggtagtggtgcatcaagtgtagctgtgacagtttagcatatgctgtgctacttaagataagggagaacaggttcttctaattcaagatccaatcatttatgatcttccgagagcaaggagcaaggggccagcgagtctggacacattccagaggttacaaggggttttatgccctgagccctgggttctctccaagccacaaggagttttatgctctgggcttagactgtagtgtggcagggcaggcttccaccatttggcacagagcttggttttccaaaggtcatgaggggttttagaccctggacccaggacatgttccaagactcttttacattatgtcagacaagcaagccctgcctcagctcttctgccaacagttttagtagagacggggttttaccatgatggctaggcttgtcttgaactcccgacttcaggtaatctgcccaccttggcctcccaaagtgctgggattacaggtgtgagccactgtgcccggcctcatttatttttgagatatgatctcagtctgtcaaccaggctgatttgcgtggttcactgctgcctgaacctcccaaactcagatgatcttctcattttagcctctcaagtagctgggttacaagtatgtgccatcacacacaggtagcttttttgtatttttagtagagactgagttttcccatgttgcccaggctggtcttgaactcctgggatcaagtgatcagcctaccttggtcttctaaagtcctaagattacattttattttattaagtagtttaattaatttatatttaaaatgattgcttaaagaaatgaagttgttattaccagttatatttatggttttatgtgtttccagtagttatatttttctcatttcctattttactttcttaatttttatttaattttgtactcacatgctttattttttattgtcttttgcatactttctataaatattttctttctaatcatctgaaaactggagattgcatgcatcttaaagttaaaacaatatgttttaatttcataaaaacttcaactgaatacaaaaactatgcctctatattttccagtttgttattgatatataaattattttatatggtgtatctattaacagatgcacgcagatttacacattgtttttatattctataaaagcactttaaaggttttatttaccatcatttttgttttttttggttgtttgttttgatttgtttttgagactgagtctcactctactgcccaggatggagtgcaatggtgcaatcttggctcactgcaacctctgcctcccaggttcaagggattctcctgcctcagcctcccaagtagctgaggttacaggtgcctgccatcaggccagcctggctaattttttgtatttgtagtatagatggggtttcaccatgttggccaggctggtcttgaactcctgacctcaggtgattagcccacctcagcctcttaaagtgctgaaattacagatgtgagccaccattcccagtgtggctgggatttaccatcattttgatagtaaagaattctatatgtgtccatatatttacatttattggagagctttatatttacatatgtttttatgatgctgtccagcaccattttatgtttctacataacggacacattttaacatttctctgtttttatatgtagggtctcattatgttgctcaggctggtcttgaacttctggtctcaagtgatgtgattgctttggcctcccaaagctgtagaattacaggcatgaagcactgtgcctgagccccgtgcagtattttttttttacttttttttttttgagaccgagtctccctctgtcacccaggcctggggtgcagtggcatgatcttggctcactgcaacctccgcctcccaggtgcaagcaaatctcctgcctcagattccatcccgagtagctggggttacaggtgcatgccaccatgctgggctaatttttattattattattatttttagtagacatggggtttcaacatgttggccaggcttatctcgaacttctgacctttgatgatccaactgccttggcctcccaaagtgctgggattacaggcttgagccatctcacctggcactttttttttttttttttgagatggagtcttgctctgtcgcccaggctggagtgcaatggcatgattttggctcactgcaacttccgcctcttgggttcaagtgattctcctgcctcagcctcctgagtagctgggactacaggtgtgcaccaccacgcccagctaatttttgcatgtttagtagggacgcagtttcaccgtattgttcaggctggtcttgaactcccgatctcaggcaattcacccacctcggcctctgaaactgctgggattacaggcgtgagccagtgtgcccagccccatgtagtatattttgtagaactgttagtggtgatgaacagtctcaccttttattttggaaagtctttatttttgtcttcttattgaagtagtgtaattttgaattgagttttactggttagaaatttttttttgttacattaaaatttgggaagttctcagcttttttttttttttaatcttcaagtaatgtctgtattactttttctctatattctaagattcctttcatgaatacattgatctgcttgatggtatccaataagttttacattccatgtgttaattttgttttgtgattttatattattgtgttatatatttttgggtatgccacatcacagcagttagttgtgttttgattttttagtttatattataattgtatatgacaatatttaactctgtacaatttaagacagtgtggagcaaaattaaatgtgaataagctgtatgtctattaccagtataattatttctatgtttgttggcctgtataaattttatcctggtatttttgtgtcacttgtatatttgttgtgtgtttcttgtagtaggttttttggagttttttgttgttgtttgtttgtttgagagagagttttgctcttgttgcccaggctggaatataatggtgggatcttagctcactgcaacctctgcctcctgggttctagcaattctcctgcctcagcttcccaagtagctgggattacaggcatgcaccaccatgccaggctaattttgtatttttagtagagatggggcttaaacattggtcaggctggtctcgaacacccgacctcaggtgatccacccacctcagcctccctaagtgctgggattacaggcatgagctactgcaccaagcctataacagttttttaatcctgtctagatgagtagtcataaaaaatctcctaatttcaacatctatttatttgtgaatctacattgttttgtgtgaaagaaacacttttggatttgaagataatttaaaaactataataactctgtatctctcttaggtattatttttacttatgtattttgtgtcaaaaacataacaaaatttacaataaaatatttctaggccgggtgcagtggctcactgagtgatattccagtatttttgtacctactgaatgatttggtgacagaaatttgcattgcttttacctattggctttcagtcacaatgctgcaatagttatgtgaaagttaatatatgtactgcattctgttttatttttctaatttttcacctttatactcataccaattgttttaattctgtagctttttgatgtgttttgaaatcagaaatggtaaagcctccaacgttgttcctttttttgaagattgttgggtactttcttgtctctttagattccatatacttttggatttgttgtttttatttcttcaaaaatgcaatgagacatttgaaaaacattgagttaaatctgtagattaaattgagcagtacagacatcttcacagtattaattctttcttttttggttgtttgtttttgagatggagttaaattcacccacctcggcctcccaaagtgctgggattacaggcatgagccaccgcacccagcccagtaatttcaacaagtgcatgctcaagagtgtgtcatatgatttctatatatttgtaaatttatcaaatatttatattattgttttatattctaatttcattttttgtcatagaaagtaatctataaaatctacattttagaaaatgtgttgaggctgggcgcggtggctcatacctgtactccctgcacttgggaggccaacgcaggcagatcacctgaggtaaggagttcaagaccagcctgaccaacatggagaaaccgtgcctctactaaaaatacaaaattagctgggcgtggtggtgcatgcctgtaatcccagctactcaggagcctcaggcaggagaatcacttgaacctgggaggcagaggttgcagtgagctgagactgcaccattgcactccatactgggtaacaagagtgaaacactccatctcaaatatatatatatatgtgttaagattttgtttttggactaacaggtggtctatataggagaatgttgtttgagctattgagaaggctgtgtattttgatgctgttgaggagtgttctctataccttcattagaaataagtgttttttactgccttctagtcctctgttccattattaatattatgtcttgttttattattattacagaaagtggggtattgaaatatcctactataattatattgctctctctgtgtttatccaattttgttagtgtttgctttatatatttgaaaccctagtttgagacacacacacacaaatacacacatggataaataaatttgtcataggttctcagtgaatgaatctatatattatttaatgtcctttgtctttctgaagtttgaacttaaagtacattctataaaatatgacagtttttgacttaacatgtatcttgtataatattattttgacctcttctactctcatttggttaatatttacgtgacatttctacttccattatttcactttcagtcttttttgtcattagatttcaactgagtcctgtagaaaggcaagttgaacattgattttaaacactttttaataaacctgtttattgaaagtatgtctcttgattggaaagataattatatatatatttaaatggttttctgaaagagaaaaacttactaatgttatattattaatcattttatttgattctatctttttctctcattttctctttctgtctttttttgtgtttttttatttctgtattgatatgctttcagtttttttcttactttcttttgtgtatctatataaatattttcttagataccttgggggattacataaaacctctgaaagatccaacaatatatttgaatatggtaaaaaactaacttcaattgcatacaaaaattcttcatcattacgtctgccttcaactttgttattgattttgctaattttatttttttatgttttatgttcattaacagatgtttataatcatgtctatacttttaccttttaaattttagagaataattaaaaatgttttctgtatcattatgataatgttaagtaataaatttcatttttgtgtatgtgcatattgcattatgttattttcagtgaaagaacctcctttcagcatctttgatatgtagagcatatgcaatgtcaatatactttctcaggatttggttattttggaaggacgtctttgtatttggtagtacaattttgctgatggtattattcccacttgacagctttttaaaaattattataactttaacaatatcacacagtttccttctgacttgcaaatttttttttgataaattcactggttatctcatgagactatgcttataaatgaaacatttttatattgtagtgcccaaaattcttttctcatatgccattttgaaattttgcttatatttgtgtctgttattatctttgtgtgtacctaaatttgttttttcagctttttcatgtttacgtcatattttcttttaagaaatttttcagttttttggtaattttatatccacaatttttggtattttaatttttttatctttatttttctgatcttcggtagttgtctgtgtttctatttttttctgatacggagtctttttctgtcgctgaggctggagtgcagtggcgtgatgtcggctaactgcaaactctgcctcccaggttcaagcgattctcctgcctcagcctcccgagtagctgggattacagctgcctgccatcacgcccaacgaattttttgtatttttagtagagacggggtttctccatgttggccaggctgatcttgaactcctgacctcaaatgatccacccactttggcctcctgaagtgctgggattacaggcacgagccacaaagcccagcctttttcattgtatttttgagacagtgttgctcaggctgcagtacagtggtacaatctccactcactgcaacattcccctcccaggttcaagcagttctcctgtgtcagcctcccaagtagctgtgattacaggcaaatgccaccatgcccagctaatctttgtatttttagtagatacagggtttcatcatgttggccagggtggtgtcaaactcctgacttcatgtgattttcccaccttgatctcccagtgtgttgggattccagaaatgagccactaaccctggcctgttcaatctattttgaatttttaaaattactttctatactttctatggttgctttagaaaattttatgtttttgatggggccatattgttctaatatttggtatacattataatctttgattgagatttggacattaacaaaaagctacctgttacaatctttataatatagctttgtgtttgcgtagtctgaagtcaattgtcttggctaaagattctgggaattcctcaaacatgtttttaggatgtatcttgtctaaaattttgtttttattgtttagataaatcagcttgttcacatttcttcttaataatctgtaatcacttgccacacccattccctgtttggggtactgcagtttctctgcttctctgtaatataccttcagactcagcagactcaaactgtcattccaacatgtatcaccatttctttcagcattttatgtcacgagaaacattaactaatgtctaagaaagcccctagaagccagaaataaagatatatgtgccaatatttttctagtttttttttgttttgtttttaaaaacgaggggttggcaatttacatgtgtgtgtatgtgtgagacagagtctcactctgttacctaggctggagtgcagtggcatgatcttggctcactacaatctctgccaccacagttcaagcaattctcctgcctcagcctcccaagtagctaggattacacatatctgttaccaagcctggctaattttttgtatttttagtagagatgggatttcaccatgttagtcaggctggtctcaacctcctgatctcagataatcctcccgccttgccctcccaaagttctgagattacaggcttgagccatcatgcctggtcagcaatttactttttttttggaggggcaggggatgaagtctctctcttttgcccaggctgaagtgcagtggcacgatctctgctcactgcaacctccgccttccaggttcaagcaattctcatgcctcagcttcccgagtagctgtgattgcaggcacccaccaccatgcctggctaattttttgtatttttagtagagatggggtttcaccatctcagccgggctggtcttgaactcctgacctcaagtcatccacccacatcagcctcccaaagtgctgggattacaggtataagccaccacatccatttggcaatttacttttgaagacacaatcttatatggagagcaggaagagctgtgttgggtataagtaacagacctctttttcttctatgtggctctttgcattgtgctcacttggggcccttcacacacttaactcatttatacattttttacaaacgttttttggtcagtatgtttttgttacatttatatgtccaggaagaaattacagcttatggtattttgctatgtcatcttgcttatgtagtttgtataattttataggttagatttgtaaagtatatttatctgagtctagcaactgaagtaatgtatttgtattgtttctttcagttatgtgttctcattttgcccaagacctttggccagagcagagcgtaaaagattctttccaaaaactgatactgagaagttagttatgaaaaatgtggacatgacaatttacagttaaaaaaagaatgtgaaagtgtggatgagtgtaaggtgcacaaagaaggttataatggacttaaccaatgcttcacaaataccaagaaaaaaatatttcaatgtgataaatataggaaagtttttcataaattttcaaattcaaactgacataagagaagacatacgggaaaaaagacctttcaaatgtatagaatgtggcaaagcttttaacaagttttcaacccttactacacataagaaaattcatactagagagaaaccctacaaatgtgaagaatgtggcaaagccttcaactggtcctcataccttactatacataagagaattcatactggagagaaactctacaaatgtgaagaatgtggcaaagccttcaactggtcctcataccttactgcatataagataactcatactagagagaaaccctacaaatgtgaagaatgtggcaaagcctttaagtactcctcgaacctcactacacataagataattcatactggagagcatctctacaagtgtgaagaatgtggcaaagcgtttaaccatgctgcatgcttctttgtcattttgaagatttgacttaaagtacattttataaaatatgacagtttttgacttaagatgtagcttgtgtaatattattctgagctcttctgctctcatttggttaatatttacatgaaatttctacttccatctttccactttcagtctttttttctcattagatctcaactaactcttgtagaaaggcaagttgaatcttgatttaaaaattttttaataaacctttatattgaaagtatgtctgttgattggaaagataattatatatatattaaaatggttttttgagagagaaaaacttactaatgttattttattaattgtgttatttgatttttgtatctttgtctctcattttctctttcttttttgtgtttttttatttttatttttatattgacatgctgtagggagaccccctgaaactatggctatggaatgaaagatgaaatgctcctgatagttgtaaatacaaaattacatgcaggattgtgtaaagacaatgccaggttgggctgccagaatgagccaacagtgcgtgatgtgcttcgccctgcagagagcctataaacggatgtgcagtcaggaaggtttcacatcaccaagattcctatcccagaaaagcagatattcatagctctgggaatggaatgcgacccttgtggagagcctacaaatggatgcatgaggggtgcctgttcatatggataacatcgggctataaacgcccttatcttgccatggctcttctaggtctctttagggttaagacatactcccttctgagaatttgtggtctaatcggttgtctagttttacatcctccttttattgattgtttgcaaccagcttttgctgtaattattactactgattaatatcttgctcatcattaatcatagattatggagagacggggtttccgttttaaggctctgttaaaaattgctgatgcacacactatattgtaaattcttatctctgtatactgtacttctgcatattgatgttatgttaaagaattacttcattcccatgtgaccatctcacctcataatcaaacgactctaaatccctcattaacctacccccaccctcactaaacttaataataaatgctggtatatccagtgcattggcagcatggcaggaccagaaggcggtgaccctcctggactcaactttcactatcttgtgtgtgtcttttatttcttgacctgccgatccacctgggaacaaagaaagagccccattgcattgcgggctgctggccagatcccgcaataacatgctttctgtttttgtcttatttcttttttatgtatctatacagatattttctaagtggtactttcaaggattacataaaacctctaaaagatccaacaatatatttgtttgtgataaagaatcagcttcagttgcatacaaaaattcttcatcattacatcagccttcaactttgttatgattttgctaattatattttttatgttgtatattcattaacagatgtttatagtaattcctatacttttatcttttaaattttagaaaataactaacaatgttttctgcaccattatgataatgttaagtaagaacttttatttttgtgtatgtacatattttttccagaaatttatgtattttcatatgattaagtgttgttttcttgcattatattattttcagtggaagaaactcctttcagcatctttgatatgtaggacatatgcagtgccaatatactttctcaggatttggttactttggaaggacttctttttatttgagagtacaattttcctgatattctcattcccacttgacagtttttttttaattataactttaacaatatcacatagcttccttctgacctgcaaattttttaataaattcactgattatctcatgaaaccatgcttataaataacacatcatttttatcttgcacctcccaaaattctcttcttcttatctgtgatttttgaaattttatttatatgtgtatttgttatgaatatctttggtgtatcctagtttgtttagcttcttcatctttatatcatgttttaagaaattttcagttatttttttgtattatttatattcacgattttttttgctttttttttttttttttgatgcagagttttgctcctgttgcccaggctggaatgcaatggcatgatctcggctcactgcaacctccgcctcctgggttcaagcaattcccctgcctcagcttcccgagtagctgggattacaggtgcccaccaccacatccagctggtttttgtatttttagtagagacagggtttcaccacattggccaggctgatcttgaactccagacctcaggtaatccacctgccttgggctcccaaagtgctgggattacaggcgtgagccaccgtgcctggccttttttttcctttttaatatttcttgttgttatcctcatttttctaatcttcagaagttgtctgtgttcctatttcacttactgaatattattcaatatatttgatttgatttgatttgatttgatttgatttatttattattctttttgttttctgagacggagtctctttctgttgcccaggctggagtgcagtggcacaattttggctcactgcaacctccgcctcctgggttcaagcaactctctccctcagtctctcgagtagctgggactacaagcacccaataccatgaccggctaattttttgtatttttagcagagatggggtttcactatcttggctggtcttgaactcctgacctcatgatccaccgatgtcagcctatcaaagagctgggattactggcatgagccaccaagtccagccagctttttacttttaaaagcacaatgttatactggagagcaggaggacctgtgttgggtataagtaacagactttactttttcttctatgtggctgtttgcattgtgctcacctggggccgttcatacacgtaacttatttataaatttgttacaaatgtattttggtcagtatgtttttgttaaatttatatgtccaggaagaaattacagcttgtggtattttcctatgtcatcttgcttatgtagtttgtataattttataggttagatttgtaaagtatatttatctgagtctagcaattgaagtaatgtgtttttattgtttcttttggttatgtggtctcattttgcccaagacctttggccagagcagagaataaaagaatctttccaaaaagtgatactgagaagatatgaaaaaaatggacatgacaatttacagtaaaaaaaaaggctgtgaaaatatggatgagtgtgaggtgcacaaaagaggttgtaacggacttaaccaatgtttcacaaatacccagagcaaaatatttcaatgtgataaatatatgaaagtctttcataaattttcaaattcaaacagacataaaagaagacatactggaaaaaacctttcaaatgtatagaatgtggcaaagcttttaaccagtcctcaacccttactacatataagaaaatttatactagagagaaacctacaaatgtgaagaatgtggcaaagcgttcaactggtcctcacaccttactacacataagataattcatactggagagaaactctgcaaatgtgaagaatgtgccaaaacctttaagcagtcctctaaccttactacacataagataattcatactaaggggaaaccctacaaatgtgaagaatgttgcaaagcctacaattggtcctcaccccttactacacctaagataatttatactaaggagcaaccctacaaatatgaagaatgtgacaaagtctttaagaactcctctcaacttaccacacataagataattcataaaggagagaaaccctacaaatgtgaagaatgtggcaaagcctttatgtactcctctacccttactacagataagatacttcatactggagagaaaccctacagatgtagagaatgtggcaaagcttttaaccatcccacaacacttttttcacataggaaaattcacactggagagaaatcacacaagtgtgataaatgtggcaaagcctttatttaatcaccaacccttagtaaacatgagataattcatacaggagagaaaccctacaaatgtgaagaatgtggcaaagccttcagctggtcctcacaccttactacacataagagaatttctactgcagagaaaccgtacaaatgtgaagaatgtggcaaagctttcagctggtcctcacaccttactacacataagagaatttctactgcagagaaaccgtacaaatgtgaagaatgtggcaaagcttttaactgatcctcagacattaataaacatatgataattcatattggacagaaaccaagaatgtgacaaagctttttaaggaagttctcaaccctcattacacataatttatactggacagaaacctacaagtgtgaaaaatgtggcaaagcctataacaagttctcatttttatttttttttgagacagagtttcagtcttgtcacccaggctggagtgcaatggcacaatctcggctcactgcaacctccgcctcctgggttcaagccattctcctgcctcagcctcccaagtaagtgggattacaggtgcccaccaccacacccagctaatttttgtatttttagtagagatggagtttcaccatatttcccaagctggtctcaaactcctgacctcaggtgatccacccgcctaagcctcctaaagtgctgggactgcaggcatgagccaccatgcccagccacaagttctcaattcttaagagacatggtgataattcatgctgaagaggagctctacaaacctgaaagatgtgaaagtgcttttagcaacccctccaacttttctatacataaaaaaaattatactggtatgaaactctagaaatacataaaatgtgaaaaagcctttatatggttgccacgcttgattgtacataagataattcatactgccaaaactcctacaagtgtgaagaatgtggcaaaacttttcatcagtgcttacaccttatttcatagtaaagctagtatctttgagaaaaatcgtacaaatataaagaatatggaaaaaccattaatgcctactcacatcttactcaacataagaagattcataattaataaaagcattaaaagtacaattactgtcaaaaaatctttcagaaaatataaacctttaaagtgaaaaaaaatttattctgaagacaaccattacaaatataaaggaggttgtggtacctttacttgtatcacagatcttattgcaatcattttgtactagaggataatccctaagcagttgctcaagctttgttcaacatcagggattttatattggagaaaagtcctgcaaatgtaatgaatttggagagacatttttttttttacaaaaactacagcttgtaaaacaccagagagtttatactaaagtatatttttgccgttgcagtaaataagaaaaaatgcttaattcaaaattgattctatgtaaatatcagagaatttacactagaataactaaggcactgacacttcagacattacacttagagtgttgagtataaaaactaatccacgactaaagttgttagataaattatttgtatgtaactataaaaggagtagattttttgaagcattgtaattacattgaaagtatacttgtttccttgaaaaaaattttttgaaaagtgaataatgatgtaatacagctttcaaattactttgtgctgttattttattcctatcgtattcacgtgtgaaagcatgtgatcaattgttgctgcatcgagatattagagattcttttttattaattgggcatatttatgaccttttctataaaagagtaaggacattaaaatgaaagatgcctgatgaaaatataagtggagaggttctttgtagttaacctatattaagtaatgcatatggtagatgttcagagtaatacttttctatattatagtgagagaaattattaattatagttaaaagtatattaaaataaattagtaattttactggttgtacttttatgtaataaaatgcagtacatttaaaaattgttagattatgtgtgaacttattttttttaccatgttaagactactgtgcattgaatgaagcattattatgcaactaaatttagcctatcccacattacttaagggtgtaggtaaaagatggtagcaatatactatttggtgcatagtggaataacatctctagtaatcactttgccagtggctttaaactgcaaatgagttgaagaatactgttcttataggttaaatttttactcttttttcttactgaaatttattattagtatttgtgtgtatacagtatgtgtatatatttatgccttatatggcatatttgtattcaagcatacaatacgtagtaattacactagggtaaatagagcatccatcatctctagcatttattctttctattacaaacagtgtaattatacactttattatttattgtaaaatgtacaattaaattcttatggactacagggttatttttatggttataataaaaattatacagaaatataaatagaatacagccaggagcaggggttcatgcctgtaatcccagaacattaagaggccaagacaggtggattgcctaaggtcaggatttcaagaccaggctggccatcatggtgaaaacccatctctattaaaaatataaaaatataaaaattagcagcgcatgcctggaggttgaggcaggagaatcgcttgaacccaggagatggaggttgcaatgagctgagattgcaccactgcactccagcctcagtgacagaagagactccatctcaaaaaataaataaataaaataaacagaaatagaaataaaattcatacatttctgagtcctgaaaaattattaataaatatttgttatatagttttctttgaacatgtggtctctctgcatgcaatcatatagacttttaatttacatagagttaagtatacacatattactctgaagataaaccttagatgtaagaaaattataaagtgagtgtgtttgtgtatgagtttgtacatatttttagaagaaaagtgcaattattggaacaaaacaaattaattaggtgactaatagaaaactaaacaccatgaaaatgctgaaagcaaatctatactttctgctttgtcttgaatttattaatgtaaaattttatgacttatggttcggattctccccagaatctgcctattaaagcacaggcaactttctctccagagataacactcttgagtacaacaataaaagccctcttcaaacagaaaacaattatttctaacatttattttaatgtaaatttcactaaaattgactaagtggatagatttttattgttctatgtgtgtgtgaatgtataaaatagtacataaaggaaaaataagccagaaagaagatgttagttaatatttgtgatgaataaaactggaaaggagttaattattatttgcagatgacagctttgtttatgtagataacaaaaacagcagaaagaatattttaaaagcttattcagttgggtaggcaacattctaagataataccctggattcccagtctgttgcacacctgctgtgtaatactttcctcttgagtgtaaaaagatgtgtgactgtggtgggaaattactcatgaaattaggttactcatgtgttgactttgtgttatcaaaatggagattatcctgattgtgctaatcttaatcataggtgcttttaagggaaagagacacatcacagaaaatcacccctgctggctttaaagtcagtgacttctaggtgggccatgttgtaagctgcttatggtggtcacatggcaggaaacatgtttgtatattgtcatcattcctgcctcctggatgttgcttccagtagggagaataagaggatcctatggcagagggggaagaaaagggaaattcattcatgcaagaaataatcacctctcatctgggatagcttaagagaaagaggagaccacaacaggaccaaattaatgggaggaaaaaggtaacctgggtaaaagtgctctctggcattatggaactacatttagtaagctgtagtgaatgatcagcctctgggataccaatagtctaccaacaaggctgaactcattctaattcaatcagcatgtctgcaccattctggtgacccaggtttacagtattcattacagaaataccatgaagaccagtgggtaatgtcctagaattgaacttatttcaaaaagcattcctaattatttgttttcacttttgaaaaaccttaaaaacaatacatttataaataattaacttctaattatagaggattctactatactgtaatataatattaaactgtaaacaccttaacatgaatattgaatgcatgattagttatgtagatggtttgttttagattaacatgacaaaagtaacaattagagaaaacatttgacatgggataaaattaatcaaaaccacatcttttcaatggcttggcataatttccatgcttttggaaatggccagataattagcaagaaacaaagacaagattttggctttgctcaatgatggtttttgaccttttgaaatctaaaatccttgctaaagtattcaaagggagtattttattggtggctgcccagggtttccaaggcaatgaaggaagaattttgataggcaggaaaatgcacactatatacacacattgctcttctctgatttgctttaacactgaaaaattgaagttgtaaatgtagtctcaatttagagtaaattaacaaatgacttgtttttcaaaaaagccaatgtataaaattaatgggtaacagaagccattagctgctaaaaactagtatgactaaattcagtaagtatctagccatgcaaataacagtccaattaaatgaagaccctcataggtgcatatggaaagcattgctgtgcagtgtggtgcctccactcagcattttcttctgcctcttcacagagaaaccagtttcccctgagtgactcagggtgcatactgggaactgagaatgctgtgttcagagtgattactgaaaacatggttaacacacttcttccatatgataataaaatgttataaatcttactctgcctcagaaaagcttttagtaaatgattatagtactcaatttgggtttatggagaatttcaatgttccagataattcagacacttaaatgtcaatgaaatcccataaaacatatttgaataagataaagtcttcttagctaacaaatttgtattactagtacatttataaaaaaatagaaaaccagtactttaagccaaataacagtatttgacacgttagtagcacccaaacaagtgctcttcacgatcattgttaaagcagcaatagcaccacgtgctttcctgggacctgctggcctgttttccactgatataaagtggagaaggcattgaaatagcaaaggagggtgatataaattgaatacttatatgaaatacaattttaaataaaacatagcacttgatgttgtacaactataggcgagactattagtgtgaggtcatatttttacttatattgacaaaataatcattcacaatattcttatttagaataatattcctgttctgctgtatatttgctagcttttgatcaaatatttgggagctcaatagaaatcaacaaaatgaatctttattttaccacaagcattattgatgcatatgcttgtttttattaaaatccattaatgttttatgaaagattatacttttgctgggtgcggtggctcacacttgtaatcccagcactttgtgatgtaaaatcacacccttgtcttttttgtctttgtggctgaagtcgggtatttatggtaatgcaaaagaagtctaggtctctttttagaagaaagatggtgatgatggaagcaaatataatggtgcatggtacttggccacatttcaaatgggtgataatgaacattcacctaagtgccacaggtggcttttatttaccacatcaaatcttctttgtgaggaaggctcagcccactaatgtcaagcatttttggtggttcctagatagatgaacaaaacctcactgggctgttttaatgagaccagaattaaaaacacccaggtgccaggttattaagaacatttttacacttgtggaaaaaaatgtgatgtggcgtgtggcttggtttgaataaatcttcactgaggtaagtagctgattgaatttacctaactgtaggttaagaaatgaaaataacctctgaccaagtttattttacaggcttatttctgtacatataaaatagatggctagataaacatatacacataaaatgagtcacatggatatgtctacgtaatgtttatttgtgcatagatctcacaaacaaaaaggctcagaaataaagcagatcagatgacatctccgtattctacccctgaagccgaggtaaattaaataagcaaattagcagaacccaggtggttgtaatcagccaatttgcacagcccaggtgattccaaccagcaaattagctcagatgaggtggatccaatcatccaattatctaaatagagactgtggctttatcaaggcaggccccaaatggtggatgtgaacagaacatgcacacactgaggagacatgcagggcactgaaatactaacctggacagataagttacatggttttattttcagcttatttctgtagacttgcccttgaagttaaagctttgttgatatttacataaacaacattgtatggctacgttccattctgacatgttacttagcaaaagaaaaaagaagtaattctacatcagcatgtttagtgcatgccagaagattaaaaatgtcttttggggaatgtattttgtatacataagtatttacatataaatatttatataattatgtgtttgtcttcctatgtatatttatatctagatatgtcaatcttcgtattgatatgcattgctacaaatagtaagataaagagtaacttccagccgggtgcggtggctcgtgcctgtaattccagcacactgggaggccaaggtgggtggatcacctcagctcacgagttcgagaccaacctggccaacatggtgaaaccctgtctctattaaaaatacaaaaattagccgggcggggtggtgagtgcctgtaatctcagctacttgggaggctgaggtcagagaatcatttgaatcttggaggcagaggttgcattgatccacgattgtgccactgcactccagcctggcagacagagcaagactctgaaaaacaaaaacaaaacaaaaacaaaagtaacttccatatatgtataagtttatctgccctataaacaatatcacaaatattacacaaataaaaatatgctctaacatacatcgtgcctcatttaacatatatgaaagcagcagctttttttttgtttgtttcttgcttctgggagataaaaatgcactaaggtgatggaagtcattcattgccatatcaatgtttacccttctctttctgttgcacacagggcaaaagctgaaccagcctcagtctaaagtttctcaccaaaatttgagaatgtttattctttttcattaagactttcatcaagacaggggctcttgtttatttccatgagtgtgcaatgtgaaagtacactgttgtccttttgcctttgtggctaaaatagggactttatggtaatggacagaaagcctaggtttcttttttttttctttgtttttttttttttttgagatggagttttgcttatgttgcccaggctgcagtgcaatggcgcgatttcagctcactgcaacctccgcctcccaggttcaagtgattctcctgcctcagcctcccaagtagctgggattgcaggcgtgcaccatcacacccggatacttttgtatttttagtagagacggggtttcaccatggtggtcaggctgatctctaactctcgaactcaggtgatctgcctgcttcagcctctcaaagtgctgggattacaggcatgagccaccatgccccaccaaaagcctaggtttcttattagtagactgtcatactgaaagcaaatataatggtacgttacttggctgcatttcaaacaagtgatagtgacactacactgaagcaccaaaggtggttcttattggtcaggccagagctccttgtgaaaaaggttagggccactggcatgtctgaaggttcctagctggatggacagaaccccatgggctattttgaatagacactgaatttaaaacaccttggtggccagtaatgaggatattttcacatttagcaaaacgtgatttgatgtgtggcttggagttgataaatcttcactgaggtaatggctgattggatttacccggcctgaatggaaaataaaataaaaatcacctctgacctattcttctttgtggtcttttttatgcacacagatatatatatatatagatagatataagataggtggctagataaacatatacacagaaaatgggtaacacaggtatgtcagtgtaatttccattattgcatatgtcctgcagagaagcctgagaataagtaggtcagacgccatttttcttcccaacttcttcacaccacgtgaatttaatgagccacttagatcagcgtagatggatataagtcaattagctaaattgggaaagtgaaggcatccaggcaggacccaaatggcaaatatgaatcacattggcatacggtgagaaaggaagcagggccctgaaatgctaagctggaactagagtcttatatggctttaccaaaaacatacttcccgggtcatgcacctaaaagtgaaggtttgttcatgtttaaacataacattgtatggctgtggtccaatctgagatggtatggatccgtataggtgagagtaagtttatatctgcatcctcaatgtaggctggggaacttaaaatgtttgttaaggccgggcgcggtggctcacacctgtaatcccagcactttgggaggccgacgtgggcggatcacgaggtcaggagatcgagaccatcctggctaacacagtgaaaccccgtctgtactaaaaatacaaaaaaattagccgggcgtagtggcgggagcctgtagtgccagctactcgggaggctgaggcaggagaatggcgtgaacctgggaggcggagcttgcagtgagccgagatcacaccactgccctccagggtgggcgacacagggagactccatctaaaaaaaaaaaaagtttgtttattaatatcttttgtacaaataaatatctacgtaggcaaacccacataattctatatgtgtgtgtttatctgtctacccatgtatgtctatatacagatctagctatcattttttccatatgaatacagagtaaagatataggaggtaaaaggataaataggtatttgtacttatagcaatgtaaagaaaaacttcaatgactgcaaaatcttatttgccccttaaattttatccataagagtacacaaatggaggtatactctgacctgcatcttgctgcatttgatgttttcaaagaaagaattggtttttgttgctcacaatctgttagcaaaagtgcactaaggccatcgagtcatttattgccaagtcaaacatggcctttttaattctggtgaatgggaaaatatggataaactagccttagcttgaaagccttaatccaaatttgcaaatgagaaataattctctttaaagcttccctcaattttagagcttttattttcaaatatgtgacatagaaatagaatcttcttctctttctttctttcttttcttttttttttgagacagagtctcactctgtcacccaggctggagtgcagtggcacgatctcagctcactgtaacctccgccttccaggctcaagcagttcttctgcctcagcctcctgggtagctgagtttaaaaccacatacgccaccgcgcctggctaattcttgtatttttagcagagatggggtttcaccatgttggtcaggctggtctccaatttctgaccttgtgatctgcccacttcagcctcccaaagtgctaggattacaggcatgagatactgtttccggcttttttttttttttttttttttttttttttgcagagtttcactcttgttgcggaggctggagtgcaatggcaacatcttgactcactaaaacctctacctcccaggttcaagtgattctcgtgcctcagcctcccgagtagctgggattacaggcacccaacaacacacctggctaaatttgtatttttagtagagacggggtttctccatgtgggtcagcctggtcttcaactcctgacctcaggtgatctgcctgcctcagcctcccaaactgctgggattacagatgtgagccacagtgcctggcagaaatagaatcttatcatattgttgtgtttgctcaagtagtaacattttgggtaagaaaattaaacaagaggtctctgactttaagatggactgctatactgaaagcaaatttcagggtgttttcagatgcttttttctttggatttagatacagatataacatatgtagctagagaaatatatacagccaggtgcagtggctcatgcctgtaattccagcactttgggaggccaaggcaggtccttcacttgaagccaggagttcaagaccagccaagccaacatagcgacaccccatctctactaaaaatacaaaaattagctgggcatggtgagaccagctgagccaacatggcaaaatcccgtctccactaaaaatacaaaacttagttgagcatggtagtacacacctgcaatcccagatactaggtaggctgaggcatgagaattgcttcaacatgggaggtggaagtttcagtgaaccatgatcacaccacttcactccggcttgggtgacaaaatgagactctgtctcaaaaagaaaaaaaaaaaaaatacaaagacccagggtcatagaaacatatagagacatacatatgtaacctgaatttgtgactatgttttataacatctcacaaatgtaaagtaagtcagaggttatgtccgtactcatgctcctcaagatagatgaatgcgattccatgaggcaaatttaataagccaatgagctcaagtcagctgttttcaatcagccaattagctgagcccaggcgattcctattagccaattagctcagcgcaagtgattccattaggccaattatgtcagcttaggcaattacaatcagtaaatttgctcagcccaggtgattacatttcgccaattgactcaatccaggtgattccaatcagtaattcgctcagcctaggtgactttaaacagccaattagctcagccttaacaatttcaatcagtcaatgagatcagcccaggtgactctaattggccaattaactcagcctcagtgatcctaatcagaaagctcagctcatgtaattttattttacttttttgacggagtctctcactctgtcgtccaggctggaatgcaatggcatgatctcggctcactgcaacctccacctcccgggttcaagggattcccctgcctcagcctcccaagtagctgggattacaggcatgtgccaccacacccagctaattttgtatttttagtagagacaaggtttctccatgttgtgcaggctggtcttgcactcccgagctcaggtgatccacctgcctcggcctcccaaggtgctgggattacaggcatgagccaccgcacctggctagctcatgtgattttaatcgggaaattagctagagaaattctagagaatccaatcagccagttagttagaactgtgattccaatgagtcaattagttcagttcagaagtatctaattaaccaattagctcaggttagttgatttcaataagacaaatagttctgcacaggtggatcaaatcagccaataatctaaatagtgactgtagattcattagatcagaatggcagatttaaacagcatttttctacactgagaagaaaagcagggcccaaagactctaatctggtcataaagcattacattgctgtattgtcagcttgtttccaagaccttgcctttgacagtgaagctttgtttatgtaaacatcattgtatgtctgtgttccattatggatttctattgtgccataaagtagactagtaagtccacatctgcattcttagtatatactaaggtattaaaaatgtcatttgctgaaatcttgtatattaataaacatttatgtaattataattatataattctgtacgtgtgtgtttatctacctacatccagatgtatccaggtttgtacctatattcacaaaaaataaagatgtagaaggtgaaagtgttgatcgtaattgatatcaatagtaatatacaaagataattccatagaggtataaaattttctgccgtatgaaatatacctagaatgctactcaaatggatgtatgctattacctaaatctatcatcatttaacttatacaaagtaagcatagttttttttttttaatggagtcttgctctgtcaccaggctggagtgcagtggtgctatgatcttggttcactgcaatctccgcctcctgggttccagtgattcaactgcctcagcctcctgagtagctgcgactacaggtgcctgccaacaggtctggctaatttttgtatttttacttagaggcaaggtttcaccatgttggtcaatctggtctcaaactcctgacctctggtgatcagcccacttcagccttccaaagtactgggattacaggcgtgagccaccgcgcctggccagacactttcttctgtagatttggaaacagatataagacacatatggctgggcatggtggctcacacctgtaatcccagcactttgggaggccgaggcaggcagatcatttgagatagggaattcaagaccagcctggccaacatggagaaaccttgtctctactaaaagtacaaaaaaattaggtgggcattgtggcacatgcctgtaatcctggttactcaggaggctgaggcaggagaatcacttgaacccaggaggcagaggttgcagtgagctgagatcatgccattgcactccagcctgggcagcaagaatgaaactctattttaaaaaaaaaaaagacatgtatataggaaaacataaacaaacacaaaggcttatatacatatgtctaattaatgcctatttgtgagtatgtcttgacaaaaagccccaaaagaaaagtatgtaaaaggttattaccttactcattctcctcaagacacaatcaatgaactcagcccatgtgaccctagtcagccagttagctcagcccaggtgattacaatcagccaattaaacgagcccatgtgataccaattagtcaattatatcataaaggttaatacaattagccaattagattagcccaaggtgattccaatcagccaattaaatgagcccaggtgataccaattagccaattatatcagtattggtgtgttggtgtgatcagacccaacaccgggttgtgggggtgacaaagtccagtggagtcaaaggattgagaaaaagtttgagagagaaaagtgggaccagggggccattgctagtgtatggaggctgcgaaggccccgagctctgggatgccatgctatttattggtaatccaacaaagaaacagatggtgagaatgtggggtcgaaagggcaagtgcatgatctacagctgtgatggtttagcatatgctctgctacttgagataatggagagcaggttcttttaactcaagatacagtcaatcctggaagagcaaggagcaaggagccagcaagtctagacacattccagggccacgagccctggattctattcaagccatgagggattttatgccctgggcttagattatggtgcttcagtgtagccttccaccctttagcacagagcttggtgttccaaaggccacagaagtttttataccctggaccccagacatgttccaagactcttttacattatgtcagacatgcaagccctgcctcagcttctctcccaacactcagcttttctcccaacatgccccccttttctttttcataaaaccgccacagctatcattgcttgttcttgaagtcagctttctctcagaggtggcttcatcttcagaggcagctttcgcatctgcagactaaaagaagacagcacaagcacacaaccaccagaacaaaatccacaaatgtagagcctccaatggccttcaactataaatcttttagaatgggataatagttttttaagggtctcagttacaatataaatagatggtgatgtctccatggtctatttagaggtacagggatccaaactccttctctggctttaattatcaagatagtttgatttttatcaaaggttgaattaatgtaggtaaacaagtgacattcggggcaagtaataaggcatatatttatatcaagagtaacatttcctattgctagcacaactttgaatccaaaaggtcctgttggagagaaaagaaagagcatttttatccttaccttcctcccctctattccttgtatatttgccctctcagattttgcttggactttgagccatagctaatttccataattcagaatgttcctgtctgtccctgcaaatctctgctagtctttgctagcctcaacttttgtacctctttagggcactgaccttatattgctagtctttgcttttgtacctctttagggcactgatcttatattgctagtcttcatctatctctatttatctctatctctctatttatctctgtttatctctatctctctatttatctctatctctctatctctatctctacttatctctagctctacttacttagctctacttacttagctcttattcaaaatggagttgctctggtttgaattcttcccacatatctcccttttcccttttacaagaggacccttaatcctaggggttgcagaaggatgaaggtccatcttctgtaacttcttcatgctgaataggagtgacgataatcctgcctaactattagggactcttgtattcagggtagagaggagctcagtcagaaagcattggtccgttaagcatccataggtaaaaccctggcattccagtagtttctcagcttcctgtgctgttttcttgctctgtcccatgttataggggttgcatccacatggtttcattcatctcctgcaaaaacacaagcgtaccctcgatcccacattagtaaacctagcgaaacagaagcaaaaagttttgtggttgtaactgggaggcatgccattgctgaagcatttgttaactcagcttctgcctctttggttaattacagtgaggtaaaactttccactgataatgagaaacaggccccttctaacagaaggcacagagaaagcaaatcaaggcttctcaaaccttcaatttgcactgtaccggtgggcccactagatgctgtggctcatgatagatcttcagatatttggtgggtaccccattgttgcaataagtctctaccccataaattgactggaagaggtgtaataatatgctgaattgtcccttcctgaccaggtgtcccttgacatggtaaaatcaaggaactctgaaaaacttcctaggctgttcctatgccaatgatacccatggaagcctttagtttgggccagtgctggggccattgatataaagcaataatagagacaccagctccagtatccactagtccttcaaaatcctttccctgaatagttactgtgcaaataggtcttttgtcaaacacttgaataacccaatatacagcctttcttgctgaattagtactaccaaagcctcctgttcttttcactgtgctgcttcctggttttatgtaaggtaagagccacaactgagcaattctttctcctggggaagcagaccacggagttgaggaactaataactaattgaatttctccactataatcacaatcaattattcctgtatgcacagcgacacctttcaaatttagactagaccttccaagtaatagatgaactgttcctgagggtaagggtcccctaactcccatagggaccttctttggttgctcccctggaagtaaggagactggaattgtgctgcagaggtctacggcagcactgcctgctgtgcaaggaaacaattgttgtacatttgtaagggcactggctgtgtcatatatgcctcagtttgttgaggtgctctctgaataaacaagcctcagattccactgggtcttaccgcatgcctcaccctcttcataataaattccttaagaaattcaagtaagcagaatgtttgctttcactttgtgccattgttatcctggttcttccgagcattccgctttcctaccgagcttcttttagttgtccttgggtgtcctttgaggatgcgtcatccactttcacacactgtagggtttcttcaccggggtctctgttgccccacattgggcagccaggaatgttggggtaatcagacccaacaccaggtcgtgggggtgacaaggtccagtggagtcaaaggattgagaaaaagacagtttgagagagaaagatgggaccaggggccatcgctagtgtatggaagctgtgaaggcccagagctctgggagcccacactatttattggtgatcaaacaaagaaacaggtggtgagaatgtggggttcgaaagggcaagtgcatgatctacagctgtgatggtttagcatatgctctgctacttgagataatggaaaggagattcttttaactcaagatacaatcaatcttgggagagcaaggagccaggagccagcatgtctagacacattccagagccattagccctctggattctatccaagccacgagggattttatgccctgggcttagattatggtgtgtcagggtagccttccatcctttagcacagagcttggtgttccaaagaccacaaggggttttagaccctggaccatggacatgttccaagactttttacattatgtcagacatgcaagccctgcctcagcttctctcccaacacccagcttttctcccaagaatggtgaatctaattagccaattagattaacacaaggtaattccattcagccaattttcttagtctagttagatccaatgagccaattatctaaatagtgactacaggtttatcaaaacaggcccaaactagtggatgtgaaaagcacatacaaacattgagaaggaatgcagggtcctgaagtgcaaacctgaactgcatgagtaacctgacttagtgtcagcttatttctgaggcctatgctactgaagattaaggattttttatgtttataatattgtatgtctatgttcaattctgaaatgctactgagcaaaagagattgaaagtaattatatatctgtaattatatatcaattctgaaatgctactgagcaaaagagattgaaagtaattatatatatgtatataagttctagatccatgaggatctagaactagaaatatgatttgacccagccatcccattactgggtatataccaaaaggattataaatcatgctactataaagacacatgcacatgtatgtttattgtggcactattcaaaatagcaaatacttagaaccgtcccaaatgtccatcaataataggctggataaagaagatgtggtacatatacgccatggaatactgtgcagccataaaaaagcatgagttcatgtcctttgcagggatatggatgaagctggaaaccatcattctcagcaaactatcacaaggattgaaaaccaaacaccatatgttctcactcataaggggagttaatcaatgagaacacatggaacagggagggaaacatcactcactggtgcctgttgggaggtggggggttgggggagggatagcattaggagaaatacataatgtaaatgatgaattgatgagtgcagcaaaccaacctggcacatgtatgcctatgtaacaaacctgcacattgggcacatgtaccctagaacttaaagtataataataaaaaaagattttaaaaatcatattcttaaagagtgtaagctaaaaggcagctagttgattctacaaaggtcagaaaattgacttgtgtgtaagaagcctcactgatacaagctatgagatttgggatcactgcttgaattcatggagtctatcaaaatatcattattcctttccactttgtagaatcatgagtcctaagggtaaataatatacagaaataaagtaaaatcagaagcttcaaacacttaacatcttcaaactaatagtacctatagtgtcaaccagagaatataagggcaaccagcaggtggtggaaatatcagcaaacaaaagaaggttggtgtaaaccagctggccagagttctgtggaaagagaatagttgccaagagcaagagaaattaagtctatcatttttcctacctggaaaccaccaaatagaaatgcctgttatactggaagtaacttgtaaaacagaaggttgttgaagaggtggggatgtcattaaaacattttaaaagcccataaaaatcttaggaaaatttcttactcttcaagaaagctttaagagtacatccagcatgggccacatgtatctaagattactcagatccagctggtttctctttgacactttatggcaaactaaaatctatcttccaaaaaaacagtgaagcattgaccttagatatttaattgtctattgagatgacaactcaatgaccttgtctagtttggaaaatacaaagaaatagccatttaggtaaccgtatatgagccagaatttggtggaatctaatcttatatatggccctaactctgaccattaatgagatgttgggttccattagttcattttatttaaaaattggaaaacatattaattcttgcaatagtctcatccctatgcaagcaggtgtctctttgcttatgaagataattagaccataggtttgatggcactttgactttaaaaaaaagacttactaggttgttttttttttttttccaaaaaaaggagagacagtcctgattaggtctctgttgccaaatcctaaagattctaggccctataaagtgagacattaaaaggattatgcatcataataaggccattctgggtaaagtcatttctattcatctccattactttgagagtaatctgtcaaagacaaattaactgccagaggaaacttatgaaaaaatatttgttctcaaaagctgtaacgtatttattttaccttcagtctccacttgccaaaaccataaattgcagaatatctccattaaagctcatgccaaattccaagtctctcctctggctgtcatttgcgagatggctcctcttcaggttcctgttagctatgtgcaaagacagcctaggcaatgacaaatcaagagataaataatttctgagatttcctgagttgattctttcgatcccagcactgcttttcattagaatttctaagtccctcttcctataacagaactaccagccccaatgtgcttgggagcaacttatttgctctggaaattagcacaatatgaagactcaaggctgagacctacaaaacttgggttcaagttaagttgttttttgtttgttttgtttgtttttatcaaatgggagtatgactttgagtttatcacctcacatcctacttggaggatccaaagcatttttctttgagcgtactcttgagatatcataaatacaatcccattgttaggagaggtcccagagcccaattccaacccacttgtccttgaaccttctctaaaacaacctgaaaaagaatggtcttggagcttatgcctgaaagcttccatgccagagaactcacccccacccactgccaccaccagaaaaccagtccagctgccctgtttgtttggtttgattcagttgtgaagcagctttgtagagagtgaagagcaagatactagaaggtacacaaacttcagtgttatggaaaattgattgtatttctatcctatgactaattatttgtcctcacttttgtttacaaaatagaaggctattataaccttgtgtcttacaagtttggtgataattacaaacaggctaagcattcagtaaaacatcatttttctcctatttgctctaactgaagacaggattactttgaatgaccagaacagtcgtatgcttgcaatagctaatttacaataactctagagttcttgaagtttgccctagggcattaaagatgccaactatggcctatgagaaatatcaaagcatgagacaaggccattcaataagaagaggtcagaaatttctcaactgctgcaaaattttttagcaataaactcatttctggtaagtcttttacatcacccactcctacctttacatacaaatgtgaattattacctaatttttgtatcagtgaaagaatttgaggatagcctgaaatgatattgtgggttttggagcttacaaatcttggagaaaacttatctcagagtcaaacatggcctggtgattacctaattcccaggtaggcctgtaaagtctctctgcgatcctgctggcaaatgctccctgtcttcattacacaagaccagccacggaaacaaatgggtatcagttattttaactccaactcttagaaagtgcttgtatttaagtttttgatcaaatgtatctattcatatgttttggaaaattaaatcgaatagagagattaaaatgaaaaataaacttcctgccccatgcctaacagtctctaacctcttttcgtacaggctaactgtgtttggccttttctgcattgctacagagaaatatctgaggctggataatttataaagaaaagaggtttaattgactcctggttctgcagcctgcacaagaaatgtggtgccagcatctgctcagcttctggtgaggcctcagggagctttactcggcagaaggtgaaacacctcccaccaggcctcaccgccaacactggggattacatttcaacatgagatttggaagggacaaatatccaaactatatcagtaacactatttaactcttaaaactatttctaggctgggcatggtggctcgttcctgtaatcccggcactttggaaggcaggtcacttgaggtcaggagtttgagaccagcctggtcaacatggtgaaaccccacctctacaaaaaatttgaaaattagctgggtgtgatggtgcatgcctgtaattgcagctactcaggaggctgaggtgagagaaaggcttgagcctggggggcagaagttgtagtaagccaagattatgccaaggcactccagcctgggggatagagcaagattctgtccccactcccacacacaaaaaaaagatttctaaacttatatttctgattatcatccacctttaatctgttattgcactatattccttgattaatttgaaatagcatttactgacgcgctattctgacaaaagatttaacttccttatatcatcccaagccttcccttaatactcctgccagtatgattctttgcctactttttttgtttttctattaattacttttgtaactttaaataaatgttcaccattatatttctttttacagcaactataggaaatacctcttctctagttgagataaagtttattctctaatttactaatgtttcaaagatcacctgaccttatttgcagagataatattttttaaatctcaaccttgcaaactgtcagggttgataatatttgcattcctttccaagatgatacctgtcttctgtcctttatctatggtttattatgaaagcaggaagtgaatcatgttttgtttgttattcctcttccaagtactatttgctgcagaaccaagcccttgtttaggattaattttgtgggttttgtatagctatttggatttttctggagtttctaattctcttcttacttcttcatattgtctttaatatgtttttaagtagttctatcttcctagggatcatatgaaatctatgaaacaccattttttacaaaatgtctccttgttggagcctctgttttcttccttctgtctggagtgctgcttccaggcctgctccaaagctgcatcctggcactcctccttctctcggtcaccctggatccacctttctttggatcccatgtcttccacattcttagcctcctcattttgcttaagaaaatcatccagtaacatcctaagaaagtttgaggagaaacttcttagtttctgtaaatatttttttattctctattcatccagattgagtgtttggcttggtatttttctctttttttggttttgcaatgcatttttctcttttttataatactttaagttctagggtacttaagttctaggtttgttacataggtatacatgggccatgttggtttgctgcacccatcaactcgtcatttacattaggtatttctcctaatgctatccctcccccagcccccaaccccctgacaggctccagtgtttgatgttccccaccctgtgtccatgtgttctcatagttcaactcccacctatgagtgagaacatgcggtgtgtggttttctgtccttgtgattgtttgcttagagtgatggtttacagctttatccatgtcactgcaaaggacatgaactcattcttttttatggctgcgtagtattccatggtgtgtatgtgccacattttctttatccagtctattattgatggacatttgggttggttccaagtctttggtatattgcatagtgccaaaataaacatgcgtgtgctgtgtctttatagtagcatgatttataatcctttgggtatatacccagtaatgggattgctgagttaaatggtgtggctagtcttaaatccttgaggaatcactacactgtcttccagagtggttgaactaatttacactcccacctacagtgtaaaagcattcttatttctccccatcctctccaatatctgttgtttcttgactttttaattatcaccattctaactggcatgagatggtatctcattgtggttttgatttgcatttctgtaatgaccagtgatgatgagcattttttcatatatctgttggctgcgtaaatgtcttcttttgagaagcatctgttcatatcctttgcccactttttgatgaggttgtttgtttttttcttgtaaatttgtttaagttctttgtagattcgggatattagccgtttgtcagatgggtagattgcaaaatttttctcccattctgtaggttgcctgttcactctgatgatagtttctttcactgtgcagaagctctttagtttacttagatcccatttgtctattattgcttttgttgccattgcttttggtgttttatttacgaagcctttgcccatgcctatgtcctgaatggtattgcctaggttttcttctagagtttttacagtgttagctcttacatttaagtctttattccatcttcagttaatttttgtgtaaggtgtaaggaagggatccagtttcagctttctacatatggctagccagttttcccagcaccatttattaaatagggaatcctttccccattgcttgtttttgtcaggttcataaagatcaggtggttgtagatgtgtggtgctatttctgaggtctctgttctgttccattggtctatatttctgttttagtaccagtaccatgtcatcttgattactgtagctttatagtatagtttgaagtcaggtagtgtgatgtctccagctttgttctttttgcttaggattgtcttggctatgcgagctcttttttggttccatatgaaatttaatgtagtttttccaattctgtgaagaaagtcattggtagcttgatggggatagcattgaatctataaattaccttaggcagtatggccattttcacgatattgattcttcctatccatgagcatggaatgatcttccatttgtttgtgtcctctgttatttcattgagcagcagtttgtagttctccttgaagaggttcttcacatcctttgaaagctggagtcctaggtattttattctctttgtagtaattgtgaatgggagttcactcatgatttggctctctgtttgtctgtttttggtgtataggaatgcttgtgatttttgcacattgattttgtatcctgagactgctgaagttgcatatcagcttcagcaggttttagcctgagatgatggggttttctaaatatacagtgtcatctgcaaacagagacaatttgacctcctcttttcctaattgaataccttttatttctttctcttgccaattgccctggccaggacttccaatactatgttgaataggagtggagagcgaaataatcattgtcttttgcctgttttcaaagggaatgcttccagtttttgcccattcagtatgatatgacaaactgtaggtttgtcataaatagttcttattattttgagatatgttccatcaatacctagtttattgagagtttttagcttgaagcattgttgaatatttttgaaggacttttctgcatctactgagataatcatgtggttttttttcattggttctgttaatgtgatggattacctttattgatttacatatgttgaaccagccttgcatcccagagatgaagccaacttgattgtggtggataagctttttgatgtgctgctggattaggtttgccagtattttactgaggattttcacatcgatgttcatcagggatattgacctaaaattctctttttttgttgtgtctctgtcaggcttttgtatcaggatgatgctcacatcataaaatgagttagggaagattccctcttcttctattgatggaaatagtttcagaagaaatggtaccagctcctctttgtgcttctggaagaattcagctgtgaatctgtctggtcctggacttttttggtgggtaggctattaattattgcctcaatttcagaacctgttattggtctattcagagatccaactctttcctagtttagacttgggagaatgtaaatgtccaggaatttatccatttcttctaaattttgtagtttatttgtgtagaggtgtttatagcattctctgatgacagtttgaatttctatgggatcagtggtgatatcccttttatcattttttatttcatctatttggttcttctctcttttcttctttattagtctagctagtggtcttattttgctgatcatttcaaaaaaccacctccaggattcatcgattttttaaaggttttttttttgtctctatctccttcatttctgctctgatcttagttatttcttgtcttctgctagcttttgaatttgtttgctcttgcttctctattcttttaattgtgatgttagggtatcgattttagatctttcctgctttgttttgtgggcatttaatgccataaatttctctctacacactgctttaaatgtgtcccagagattctgatacattgtgtctttgttctcactgatttcaaagaacactttatttctgccttcatttagttatttacccagtagtcattcaggagcaagttgttcagtttccatgtagttgtgtggttttgagtgaatttcttaatcctgagttctaatttgattgcactgtggtctgagagacagtttgttgtgatttctgttcttttacatttgctgaggagtgttttacttccaattacgtggtcaattttagaataaatgcaatgcggtgctgagaagaatgtatattctcttgatttggggtggagagttctgtagatgtctatgaggtctgcttggcccagagctgagttcaagtcctggatatccttgttaattttctgtctcattgacctgtctaatattgacagtgggatgataaagtctcccattattattgtgtgggagtctaagtctctttgtaggtctctaaggacttgttttatgaatctgggtgctcctgtattgggtgcatatatatttaggatagttagctcttcttgttgaattgatctctttaccattatgtaatggccttctttgtctcttttgatctttgttggttcaaagtctgttttatcagagaccaggattgcaacccctgctttttttttttgctttccatttgcttggtagatcttcctccatccctttattttgagcctatgtgtgtctttgcacatgagatgcatctcctgaatacagcacaccaatgggtctttactctttatccaatttgccagtctgtgtcttttaattggggcatttgaccccaatatatttaactttcttcatgaaaagcaaatttttgctttttttacacactctttatgcagaattgtttttcttagatctagtagtttttattatatatattaattacattaactcttaaaaacctaatttttagtgaaatccctaggaagtaattttggagtgtttggcatcagtatttgtagacaaaaaccattttatatttttaatagaagtttttttccaaattctctgttaattagcagatctaaatatgattagcttttctatatcatataaaaataagattctggtcaggcatggtggctcatgcttgtaatcccagcattttgaaaggccaagacacaaagattgcttaagcccaggaattcgaggcaagcctgggcaacatggaaaaaccccatgtctacaaaaaatacaaaaattagctcagcatggttacctacaccggtagtaccagctacccaggaggctgaggtaggagaattgcctgagcccaggagattgagagtgcagtgagccatgataaaggcacttcactccatcctcaatgacagagactcttttttaaaaaattaaatgccaaagcagataaagtagaacttattggactttgggggctggggcttgtttttattattatctcaacagctttgtggctacaggtggtgtttgattacataaaagtttttcagtggtgatttctgagattttagtgcacccatatcccaagcagtgtacactgtaccaaatgtgtagtcttttatccctttctcccatctctttcttttccccaagcctctggagttcattgtataattcttattctttccttttttttttgagacagtgtttcgctcttgttgcccaggctggagtgcaatggtacaatctcagctcactgcaacctctgcctcctgggttcaagtgattctcttgcctcagcctcccatgtagctgggattacaggcatgcgccaccacacccagctaattttgtatttttagtagagacaaggtttctccattttggtcaggctggtcttgaactcctgacctcaggtgttccacccacctcggcctcccaaagtgctgggattacagttgtgagccccagcacttggctagctcatgtgcttttaatcaggaaattagctatgttctagagaatccaagcagccagttagttgaaactgtgactccaatcattcaattagctcagttcagaagtatctaattaaccaattagctcaggttagttgattccaataaggcaaatagttctgtacaggtggatcaaatcagacaacaatctaaatagtgactatagattcattaagtcaaaatggtggaagtaaatagcacttttctacactgagaaaaaaagcagagcccagacatgctaatctggtcataaaggattacattgctgtattatcagcttatttccaagaccttgcctttgaatgtgtatctttgtttatgtatctgtaaacatcattgtatggttatgttccattttggatttctattgtgccataaagtatactagtaagtccacatctgaattcttagtatatactaaggtattaaaaatgtcatttgctgagcatcttctatattaatagacatttacataagtgtacttatataactctgtatgtgtgtatttatctgtctaactatatgcagatgtatccaggtttgtatctatattcacaaaaaataatgatgtagaaggtgaaactgttgattgttgatatcattagtaatatacaaagataattccatagaggtataaaattttctgctctatgaaatatacctagaatactcctcaaatggatgtatgctcttacctaaatccattggcatttaacttatacaaagtaaccattggttttttgttttgttttgtctttgtttttttgagtcagactctcactctgtcaccaggctggagtgcagtggtgcaattatctcggctcactgcaacctccacctcccaggttcaagcaattctcctgcctcagcctcccaggtagctgggactacaggtgcctgccactgtgcctggctaatttttgtatttttagtagagatggggtttcaccatgtgggtcagggtggtctcaaactcctgacctgaagtgatcaacccacatcggccttccaaagtgctgggattacaggcatgagccaccgcatccagccggacactttcttctgtagatttagaaacagatataagacatgtatataggaaaacagatacaaacacaaaagcttatatcatatgtctaattaatgtctatttgtgagtatgtcttgaaaaaaagccccccaaaagaaaaatatgtaagaggtcattaccttactcattctcctcaagacgcagtcaatgaactcagcccatgtgattctactcagccagttagctcagcccaggtgattccaatcagccaattaaaggagcccaagtgataccaattagtcaattatatcagtacaggtgaatccaattagccaattaggttagcccaatgaaattccaatcagccaattaaatgagcccaagtgataccagttagccaattatatctgtaaaggtgaatctaattagccaattagattagcccaaggtgattccattcatccaattttcttagcctagttagatgcaatcagccaattatctgaatagtgactgcaggtttatcaaagcaggcccaagctactggatgtgaaaagcacatacctacattgagaaggaatgcagggccctgaagtgccaaacttaacagcctgtataacgtgactttgctgtcagcttatttctgaggcctatgctactgaaggtgaattttttttatgtttatacaaacaatattatatggctatgtttggttctaaaatgctactgagcaaaagagattgaaagtaagtatatgtctgtataattagtatatgccaagtgattgaaaatggtctattggggaacatttcttgtatacataaatatttacataaatatactcatataatcctttatgtaagttttaaaaatctatttacctgcccaggaatggtgactcatgcctgtaatcccagcactttgcgaggctgaggtgcatgcatcatgaggtcaggagttcgagaccagcctggccaatatggtgaaactctgtctctactaaaaatacaaaaattagcctggtgtggtggcacttgcctgtagtcccagctactccagaagctgaggtaggagagtcacttgaacccgggaggcagaggttgcagtgagccaagattctgccactgcactctagcctgggtgacacagcaagactctgtccccatctccaacaaagtaacttctatacatgtataaatctatttgccctgtaaactagatctagaagagtacacgaatagaagaatgttgtggcatacatcctgctgcatttaacatatacgaaggaagcactggtcttttttgctcactcctggaaaatgaacatgcactaaccaatgggagtcattcactgccatgtcaaggttgacccttcccttcatgttgcacatatggccagaggtgaaccagccccagtcctaaggttctcacctaaattgtgaaatgcttattttttctcatctgggctttctttaagacatgggatcaacttcatttttatgagtatgtaacgtaaaagtacaatttggtctcttcatctctgtggctgaagtagtgtcattatggtaacggatagagtctagcactctttctggaagatagaccatcatactgaaagcaaatgtaattaattgttcatggtaccagaacacatttcaaccagaccatagtgaacattcacagaagtgccaattgtggcccttattggccaggccaaaacttctttctgagtaaggatagtcttactgatgtcaagcattcctgctttttttttttttttttttttaactggacagaaacccactaggctgatttattgagattcacaaataaaaagacctgggtgccaggtaacaaggacattttcacatttatgaaaaaaaaagtgtggcttttggcttggattttataaatcttcactgagctaaccatctgattggatttatgtagcctggaagtaaagaaaatagaaattaccttttaccaagtttacttcagtgccttttttctgtaaatgtaaatatggatataagataggttgatagacaaacatacacacaaagaatgagtcacatatgtatgtataggtcaagtttatttgtgcatatgtcccatataggacagaggtcatcttcatttctacccctgcatcccagataagttaaataagcaaattacctcagcctgtgtgattgcaaaaagccaattaggtcagatcaggtaaatataaccaactgattagctaaactggaaaagtgtagacatcaaggcaggctcaaaatgatggttgtgaataacacaggcataccctgagaagaaaagtaaggatctaaaatgctaagccagacataaagccttacgtcacactacgaatgtattacttcacaggccatgctcataaacatgaagtttcttcatgtttatacataacactttatggctgtgttccaatctgagatggtataaaggcatataggtgaaaagtaagtcttcatctgtgtcctcaggttaggctggaaaattagaaatgtctattgatgaacatcttttgtatgcataaatatttacatatacaaactaatataatcctgtatgtgtgtgtttatgtacttacatatatctatagccaggtctatctataattctgttaacattcatacagaataaagatatagcaaggcaaagtataagtgagcagtggttcatgcctgtaatcccagcactttgggaggccaaggcgggcagataatgaagtcaaaagatcaagaccaacctggtcaacatggcgaaattccgtctctactaaaaacacaaaaatcagctgggtatggtggcgcatgcgtgtagtcttagctactcgggaggctgaggcaggagaatcacttgaacctggaaggtggaggttgcagtgagcccagattgcaccactacactccagcctggtgacagagtgagactccttctcaaaaaagaaaaagaaataaagggcatccaaattggcaaagaggaagtcaaactgtcactgcttgtcaatgatataattgtatacctagaaaaccctaaagactcattcaaaaagctcctagatttgagaaataaatttactaaagtttcaggatacaaaatgaatgtacacaaatcaatattgcaggtatacaccaacagtgaccaagctgagaataaaggcaagaactcaaccactttacatcagctgcagaaaaaatatacttaggaatatacttaaccaaagaggtgaaagacctctacaaggactactacaaaacactcctgaaagaaatcaaagatgatacaaacgagtggaaatacatcccatattcatggatgagtagagtcaatattgtgaaaatgatcatagtgccagaagcaatctacaaattcatgccattcttgtcaaaataccaccatcattcctcacagaactagaaaacacaatcctaaaattcatatagaaaaataaaaaagcctgcatagccaaaacaagactaagcaaaaagaacaaatcttgagacatcacattatctgacgtcaaagtatactaggagactattgttaccaaagcagcatggtactggtataaacataggcaaatagaccaatggaacagaatagtgaataaagaaataaagccaaatactttcagccaactgatcttctacaaactaaacaaaaacatgaagtagggaaaagacatcctattcaacaaatgctgctgagataattagcaagccacatctagaagaataaaactggatcttcattgctcactttatgcaaaaatcaacccaagatggatcaaagacttaaatggaaaacttgaaactacaaaagttctacaagaaaacattgggaaaaactcttctacacattggcttaggcagagatttcatgaccaaaaacccaaaaacaaatacaacaaaaacaaagatcaataaatgtgacttaattaaactaaaaagcttctgctcagcaaaataataataatgataatcagaagagtaaacaaacaacacacaaagtgggagaaaatattcacaaactatgcatctgacaaaaaactgacaaagtttctacaagaaactcaaacaaatgagcaaaaaaccccacaaactatcctataaaaaagtgggcttagcacatgagtaaacaattctcaaaagaagatatacaaatggttaaaaaacattttaaaaagtgctcaacatcactaatgatctgagaactaaaaatcaaaccacaatgtgatatcaccttactcctgcaagaatggccataatcaaaaaaatcaaaaaatgacagatgttggtattgatgtagttcaaagggtacacttttacactgctgatgggaatataaactagtacaagtactatcaaaaacagtctggagatttctaaatgaattaaaagtagaacttccatttgatccagcaatcccactactgggtatctacacagagaaaaataagtcattgtttgaaaaagacacttgcacatgcatgtttatagcagcagaatttgcaattgaaaaattgcaaatgttgggaagcaggctaaatgcccatcaaccaatgagtggacaaagaaaatgtggtgtatatataccatagaatactactcagccacaaaaaggaacaaaataatggcattcacagcaaccttggtggagttggagattattattgtaagtgaagtaactcaggaatagaaaattgaacaccatatattctcatttatatgtgggagctaagctataaggatgtaaaggcttaagaattatataatggggagggtgcggtggctcacgcctgtaatcccagcactttgggaggccaaggcgggtggatcacctgaggttgagagttcgagactggcctgaccaacatggagaaaccccgtctctactgaaaatacaaaattagccaggcgtggtggcacatgcctgtaatcccagctgcttgggaggctgagacaagatagcgcttgaacctggaaggcagaggttgcagtgaggcaagatcgtgccattgcactccagcctgggcaacaagagtgaaactcaaaaaaaaaaaaaagaagaagaagaagaagaagaattatataatggactctagaggcttgggggaaagaacaggaagggggaaagggataaaagactacacattgggtactgtgtacactgcttgggctataggtgcactaaaatctcagaaatcaccactaaaaaactttttcatgtaatcaaacaccacccatagccacaaagctgttgagataataataaaaacaaccccccgcccccaaagtcccataaaattaattttatatgctttggcatttaattttttaaaaaagagtctctgtcatcaaggaaggagtgaagtggcttgatcatggctcactgcagtctcggcctcctgggctcaggcaattctacctcagcctcctggttaactggtactacaggtgcaggtaatgatgccgagctaattttgtattttttgtagacatggggttttgccatgttgcccaggcttgcttccaattcctgggcttaagcagtctttgtgccttggcctttcaaaatgctgggatcacaaacgtgagccatcgtgcctgaccagaatcttatttttatatgatatagaaaagctaaacatatttagatctgctagttaacagagaatttgaaaaaacgtctcctattaaaaatgtaaaatggtttttgtctacaaatactgataccaaacagttctaaattacttcctaaagatttcacaaaaaaaattaggtttttaagagttaatgtaattaatatatataattaaaactaccggatctaagaaaaatacttccacatagtgagcaaacataagaaaaatatactttcaatgaagaaagccaaaaatattttgtctagtttgaaattacttaaattgtctcaaattgaaaaaataaaaagaatgtagataaaaataaaatacagaaacttttaaaagtaatttaaaaaaggtcgggtgtggtggctcatgcctgtaaacccagcatttcgggaggccgaggcaggtggatcacctgacgttgggagttggagaccagcctgaccaacatggagaaaccgaatctctactaaaaatacaaaattagccggacatggtggcgcttgcctgtaatcccagctacttggaaggctgaggcaggagaatatcttgaacccgggaggcagaggttgcagtgagccgagattgcaccattgcattccagcctgggcaataaaagtgaaactccaaataaaaaaaaaagtaattaaaaaaagtataagctatgtatggaaatctagagtggtcaaaatgatatatttgatggatttatttataaagttttatgaaaattagcttttaatttttttaaaattttaaaattttaatttttattttttgagatggagtcttgctgtgtcacccaggttggagtgcagtggtgcaatcttggcccattgcaacttccacttcctgggttcaagtgattcccctgcttgagcctcccaagtagctgggactacaggcacctgccaccatgccaggctaatttttgtaatttagtagggacggggtttcacatgttagccaggctggtctcaaactccttacctcaggtgatctgcctgcctcgacctcccaaagtgttgggattacaggcgtgagccactgcgcctggtcaaaattagctttagtattgatagcacactaatacaaaagtataagttgattttctcttgaacaaaaattttgtgtattattactataacacaataacctatttttattcaccttttgaattaatttaaaaagagggagagtagagatgggtttttctcatgctgtctttcttgggtcatttgactggaaaactgaatttcctgcatcgaacagtaaaaggttttgtttttataagtcttctaataggccaggcactgtgactcatgcctgtaatctcagtactttgggaggctgaggcaggcggatcacctgaggtcaggagttcgagaccagcctggccaatatgccaaaagcccgtctctactaaaatacaaaaattagccaggcaaggtggtgaccgcctgtagtctcagctacttgggaggctgaggcaggagagttgcttgaacccaggaggcagaggttgcagtgagccaagatcacaccactgcactccagcctgggtggcagagtgagactctatctcaataaataaataaatacataaataaaaataataaataaatcttttaattattgctttggctaaatgaatgattattatttaatagtggactgtgatcccattttgttcaagtattttaaccctttgacatatttggcaggcttcccaaaattaaaattcagcttaaaagttgtgtgtatttgacccctaatatttgaatgctacataagtccaatgcagcatttgaaagagtgataaacagaattctttgatatgttaaattacatggaaagcattgtcaaattaaaaatttgacctttatcaacatattttaataaatgttatgatattcatttcaaaattatatgaaatctctaaaaatccaatgtatctgagtatatgctactagtaataattatggtttttatgataaattattatagactacaggtataatcattttttcatttatttcttcataaccattttaagtcattttcacagttaatggtttaattctgatgtagtttctaaaaacttcaaaagcacataacatcctagaggactgtgtctttaaagagttgtacgaaaagatggaaagggtccacacaagttaagtacaggcttctgataattttaggatcatattatatttggactggctaaggattgtgagaatttgaatgaagagacagactcctaaaaaactttgagcccaggctggggtgtggtggctcatgcctataaccccagcactttgggaggccagggcagacagatcccctgaggtcgggagttcaagaccagcctgaccaacatggagaaacctcgtatgtattaaaaattcaaaattaacaaggtgtggtggcgcatgcctgtaatctcagctacttgagactgaggcaggagaatcacttgaacctgggaggcagaggttgcagtgagcaaaactcgtgccatttccagcccaggcaataagagagaaactccatctcaaaacaaaacaaaacaaaacaaaacaaaatgaaaacaaaaacaaacaaacaaaaacacctgtaagcctacacaagacaaaaattaattgactattacaaaaatactgtgccacatttttaaagttatatcaggcagtatggaaatgttttagatatactttgtaaatcaactctgtggtccaagtcaaatgacctatgataacctctcaggtatcagtgctgcgcacctaaatttgggaaagtaacctagtgtttaaaaagacataaacttaatgttcagtgtggactcatggagaacctaggcagccacttgatatttcctgagttctttttttaaaaattaattaattaattattattattattatttgagatggagttttgctgttgtcacccaggctgaagtacaatggcatgatcttggctcactgcaacctccacttcccaggttcaagcgattcccctgcctcagcctcccaagtagctgggatgacaggtggtcacccccacgcctgactattttttgtaattttagtagaaattgggtttcaccatgttggccaggctggtctcaaactcctgacctcgtgatcaacccccttcagcctcccaaactgctggaattacaggcgtgagccaccacattcggaccctattcctgagttcttgaagtttccattatttaaagctacgcatttcactactaatcacagaaaagataaagtaatgtacattaaatataaattgaatgtgtgtttgtgtgtgtatgtctgtgtgtgtgtgtgtgtgtgtgatgactgttctaaattactacactaggttaagaccaattcctttttcaaacttataattcttagaagaatattaaaagtttatgtatgtttctgctacctcatgtgtgatttaaacatttatacagaaactgtcttttatttttttgagacagagtctcactctgtcacccaggctggagtgccgtggcacgatctcagcttactacaaccttggcctcctgggttcaagcgaatcttctgcctcagtctccctagtagctgggactacaggcacacaccaccatgcccagctaatttttgtatttttagtagagacagggtttcaccatattggctaaggtggtcttgaactcctgacctcgtgatctgcccgccttggcctcccaaagtgctgggattacaggcatgagccacttcgtccggcttttttttttttttttttttgactgagtgtcactcttgttgcccaggctggagtgcaatggcaccatcttggctcgctgcaacctctgccttctgaattcaagcaattctcctgccgcagcctcccgagtagctaggattacaggcacccaccactactcccaggtaatttttgtgtttttagtagagatggggttttaccatgttagtcagtctggtcttgaactcctgccctcagatgatcctcacgcctcagcctcccaaagtactgggattacagatgtgagcaccagacagaaaattgcatgcctggcaattgtcatttttaatgcatgttttctggtagtataaaagctttctgatgcaagaaggttgttattatagcggtagctaaaaggatactaagactttcttttcctcatgaagacttgctgaaaaggtctccaattacaaagatacttatttcactagaaaagttgtaaaactgttaaataagatattacagatacaatagtactgagcaaagctaactaaattcactagattgtttttgtaattgcaattgatgacactcagatccacttagagtggaaaaaacgtgttgacttttataaagagtcattggaagacctatgcacctaataatagaacgtcatgtataatctgctactgaagtctaatattactaaatgtggcaaggctctaatgcattatggcaaagcatattttcacaaggtaaagaaagctttttttttttttttgatggtctcactgtcacccagggttcagttttgtgatctcagctaactgcaacctctgcctcctgggttcaagtgattctcatgcctcagcctcctgagtagctgggattacaggtgtgcatcaccacgctctactaatttttctgtttttaggctaggctggtctcatactcctggcctcaagtgatccacctgccttggcctcccaaaatgctgctattacaggcatgagccactgcatctgtccagaaaagcttttaatagtctactgactgggaacaggaaaaccttttataatttagaacaaagagactgaatctgcttgccatctacaatgtagcaagacttcgggactttaaaccttgggttcataacgttacaactcaaaggggaccctctaaactcttgtaatcttattggagattttaattggagatcttgaggtaaagctaaccggagaagtttctcctcaaaagaagatgacaaccttgaggtagaaagctgtttccacaagataaaaaatgaagacctctctgatatcatgacgctcttagttcacagtttctttttttatgcctctacacacaacagaaataaaaaagggatctcttgtgtgctctcatggggtatacttatatatgtaaataattttacagccaacatttaaaaaaacttatgtcttaataggtaaaagatgaagggccactgcgggtgagaaattgtaatgggaaatttgttgcctcataatatcagaaacagaatattgatcaactgctcttggagcaatattaagttaaagataaacttattcagaatagcataaagagcattgccaggaggccattagtcttctgagtgatcatttgttaggtctttttttcaaaggcttagagtaaataaggcaatgattagaaatttatcttccataacaggctctatagcagattccaccataaaggctatggttacacaatagaatttaatatttttttaataaagttgtgctaaataaaataatttatctagtttacttactggataaacagagaagtatctgtgcagttggtagtatttgtagttgcacatggagaaatacatcgagtattacagagattcagttgtaggaaattaatgaacagactgcttggttgaaatgagtagaccatttaactagctaactgtttgatctatttaatcttagttggttggttcatgggaaccttggttaaaaagcatacttctggtcgggtgcggtggctcacgcctgtaatcccaacactttgggaagccgaggcaggtggatcacctgaggtcagaaattcgagaccagcctggccagcatggtgaaaccctgtctcaactaacaatacaaaaattagccaggtgtagtgacacatgcctgtaaccccagctacctgggaggctgaggcaggagaatcacttgaactcaggaggcagaggttgcagtgagctgaggtcgcaccattgcactccagcctgggtgacaagagtgagacttcgtctcaaaaaaaaaaaatcgtacttctaactcttgatattattttcctgataatcaaaatatagtctccctactgcattctattctctcaaaagttataaatctttgcatgcagtcatctctagaatgtcaagtggtctctctttaactggaatgatgaaaacttgaaaatgtatttgaccatgagaacaccataacctatgaatgacctgataagaacggaaatcaaaaataatggaaactgagagtgacactaagatgctgagttttggtcacactctgacctatgtgaaaacctaatcaaaagggggacattttttaaacaaaattattggaggccatcattctggactgagcttgttcactaggctcaaacagaccaaaccaaacaaaaatagagtcattcatgttgaatgcgacatagtcaaactgaaagtttaaagaaataggtggattctaaaactggccaggtcttgtttttctttggtgaaaagcagatttcgatacaaggaggtctcctctactgtaatcattttaaaaaataataacctgaagtacttgttttcactttataaaacccacagttctgctattttacagtggaatttgagactaaataagtacatttttgatggtgacaaagtaatatcaacgcctgaagttttgtttaatttcttgaaattgaggagataaccaaaagggagatattgttaaattaattatagcctaaagctgatcgcttttatgtttaattttgttaataggattttctgtacacagtaaactaaaagctagctgaatatgtaaatagattgtaacttattcttgtaccaaccactatgtttttgccaataaaagaacatcagctggtcaaaccatattccaataaggcaaatcccaagctgtaataaatctggctgtttctgtacctcatttctattttctgtatgtcactttgcttcttctgtatataaatctttttttccacgtggctgtgctggagtctctctgaggctactcgggacccataggctgcttaaaatttgcaaattattctttgctcaattaaactatgtgaaacttaatttctctgaagtttttttcatttaaaagttttcaaatgttttgtatgataaaaagataagttatgtgttgttggactttgattatcaaaaataagttatgttttccaaattattccatatcagctatgtcagctattttttccaagttattctatgttctttcaaaatgcttttgcaatttcttttttgtttttgttttgttttgtttgagaaagagtctcactctgtcacccaggctggagtgcagtggtgtaatcaatcatggcttaatgcagcctccaccttccaggcttaaacaatcctcctaccctagacacctgagtatcatcatgcctggttaattttttaaatttgttttgtattgagacaggatcttactatgttgcccaggctgcacttgaactcctgagcttcagtgattctcccatctcagcctcgcaaagtgttaggattacagatgtgagccaccatgtgcttcagtaatttcttgagattattcccaacaataaacagtactatgtgggcacaaatctaaaagcaatctggtttctatttttgaagtgtcactctccaggattttaagagtctaggacagctacttgaatagtgtgatccatggaggtacataggctttggagtcagagttgatcctgagtcccatcccagccacgtagtagctgtgggtattcagacaatttcttgatatggaagagttctatagaccacatatgcagaaaaagcagaatgggctgggtgtggtggctcatgcttgtaatcccagcactttgggaagccgaggcgggtggatcatgaggtcaggagatggggaccatcctggccaacatggtgaaaccctgtctctattaataatacaaaaattagctgggtgtggtggtgtgggcctgtaatcccagctactcaagaggctgaggcacaagaatagcttgaacccaggaggcggaggttgcagtgagccaaaatggcatcactgcactgcagcctggcaacagtgagactccctttcaaaacaaacaaacaaacaaacaaacaaagagacaaacaacagcagaaggatactgattacaaatatggtagcaatttttcatccctcctgtattcatgtccattgccaggtgcttttacagccattcccatcaagattcagaatctattttccaaacacttgatctggctggccttttttgcttagggcagtagaaacctgggaacatgacaatgtcttattttggggcctaggttcaaatagtgttggctacttctgtttttcttttctctctttttttttttttctttttttgagaaggagtctttctctgtcaccaaggctggagtgcagtggcgtgatcttggctgactgcaacccccatctcccaggttcaagcaattctcctgactcagccccctgagtagctgggactacaggcatgtgccaccacacccagctaatttttgtatttttagtaaagacaaggtttcaccatgttggccaggctggtctcaaattcctgacctaaggtgatccaaccaccttggcctactaaagttctgggattacaagcgtgagccaccatgctgggcctgcttctgtttttctttcagaatgctgccatcttcatgaaacaagcccatattagccagctggaggataagataccatggggaggagaagcaagttgcccctgttgacagccccagaagcagaagctcacccctagaagcacagctgccttcctagtcaatgagcagctcatgatacatgtctaaagaagctcagctgagaacagaagaatggccccactgagtccagcctaaatggctgagcagttcaattatgagctaatcagttttggatggtttgttatgctgcatagctaactaatacgtgcacccagtgcagatagaatgccaagatttaatgacaggttggttactagttaccttctaatgctgagcagcataaaagtactgatatttttccctatttaaagttagatgtcttgtaagataatgttgagaaatgcagaaatgtttttttttgaaatgcagaaatattgctgggtgtggtggctcatgcttgtaatcccagtactttgggaggccaaggcgggcagatcacctgaggttgggagtttgaaaccagcctgactaacatggagagaccccctctctactaaaaatacaaaagattagctgggcgtcgtttcacatacctgtaatcctagctactcatcaggaggctgaggtaggagaatcacttgaacccaggaggtggaggttgctgtgatctgaggtcatgccattgcactccagcctgggcaacaactgcaaaactccgtctcaaaaaataaagaaaagaaaagaaatgcagaaatacatgtggacatgtatgcatgtgattggcgcttatattcactcagtttcccacaccacaggagaaaacggataaccccagcctgaccattagtgtcaaggccaaatagcaaaataagtttgcctttaatctattttcttcctagtaaatattaaaggtccagacagtgtagagatctcaagacatagagttttcttctcttgttgccccatcatcctttgttcactgtctgttctctgaaagaaaggtgggcaacagtagtaagcagtggtttacctgtggttatttcattcctgctgccctcaggtgtggtgttgattgaggtctttggctcactctttatttttattttttagtcaggtcgtttgttttattgttgtctgaaaattatttctatattttggataacaatctttatcagatatatcttttgcaaatattatcttccatactgtgtctttcttttcattctctatacagtgtctttcacagagcaaaaatgcttaattttggtaaatttgacatcaatattttactttcagaaaatgaactagtggtatattatctaaattctaattgctaaatccagggtcatctagattttctcctaattacattctaggaattttatagtgttgcattttaaatttaggtctgtgatccatttgtgttagtttttgtgaggttgtaatgtttgtgattcatgcttttgtatgtggatgtccaattgttttagcatcatttgttgaaaggattctcttggctgcattgtattgcctttagtcttttgtcaaagattcattcagtgtattaatatgggcttacctctgggctctgcattctttccatcaactgatttgtctgttcttttaccagtatcacactgtcttgattactgtagctttatatttaatcttgaagctgagtagtgtctcaatcatccaattttattattcttctacaatatcgtgttggctactctaggtcttttgcctctgcatgtaggtttttgcctctatatgtaaacttcagaatcagtttttcagtagccccaaaagaagttcatggaattttgtttaaggctgtagtgcatcacagatctagctaggaggaactgacatcttaacaatatggagtatttgcattcatgatcatggtatatctttctactctttgctccttctgatttctttcattagataaaagtattttttttttaaggacaagtgcctcactccatcccccaggctggagttcagtgatgccatcttggttcactgcaacctacacttcccaggttcaagtgatccttctccctcagcctcccaagtagctgggactacaggcatgtgccaccatgccaggctaatttttgtatttttagtagagatggtatttcaccatgtttattggtactttcaccatgttatttctccttcttcagcctcctgagtggctgggattacagctgaacctgggaggcggaggttgcaatgaggcgagatcacaccactgcactccagcctgggcaacagagtgagactctatctcaaaaacaaacaaacaaacaaacaaacaaaagtttcaatataggcataaaacatctgttaatttacattatagcacatctacttaagattagttttatttcttataacaaagaatctttgtttcaattttttttataaacaagatcttactttgtcactcaggctggaatgcagtggtgtgattatagctcactgtagcctggaattcctaaactcaggtgatcttcctgccttgggctcctgagtaggtgggagtacagttgtgtcaacatgctctattaatttcctttttttgtagagactaggtctccctatgttgcccagcctaatctcaaactcctggcctcaagtgatactcctatcatggcctcccaaagttctggaattattggcatgagccaccatgccttgcctattttctctaaaagctttttttcacacacacacaaaaaatgtactgtcttttgttggttgcatattagaatataggttatatggagtatcctactttgaagcagcccattccagagtctacgcaaagttgtccttcctgaactactttaagacaattacctcatgtgggacaagggcatgggggcgtcccccagaaaattcaactgaaaataactactgaaacaatacatacctattcccaaacagagcaagagtgtctgttgtagatggtcaacctttgcagacagtagtagcatctatgtttaccaagagacatactgtgaactctgagaacaggttacaatgtttattgagtcaggagaaactcatccatcagaccatagccaaagacaatcaaatattaaacctcttccctgcacatgtgaaaacatcagatgtgcaaaaataaaacattgggagacaaggtcctcactgcatatatgtgggctttagtctccagtgagacacattgagtgcacatcaatttcactactgctgcatctgtcatacactacatttcatatatatttcatactatttttgaattttatattccatttgtctctaaatcagttcataaattaaaactacattatttaacttttcaattccttataacacatgacagaagatgtcacttcatatttctttctttctttttttatttttatttttttgaggcagagtttttgctctttttgtccaggctggagtgcaatggcgtgatcacagctcactgcaacctccacctcccgggttcaagtgattctcctacctctgcctcgcaagtagctgggattacaggcatgcaccaccatgcccagctaatgttttgtatttttagtagaggtgggatttcaccatgttggtcagctggtatccacctccagaccttaggtgatccacccacctcggcttctcaaagtgctggaattacaggtgtgagcctttatactttttacatatatctttattcatttattcttctttgcagtaaaatttctattttcagaacacaataagacggtgtctctgttggattcaactcaatttttaaactgattaaaagatcattgacccaattctgttgaatcttccttttcaaacatgtattgccactaacttttacttgtacagatctgttattcatgtttttcagaaatactttctgctaaatccttactaattttttaaaaatataatgttctaggccaggcacagtggctcacacctataatcccagcactttaggaggccgaggtaggcgaattacgaggtcaggagtttgagacaagcctggccaatatggtgaaaccccatatcaaccaaaaatacaaaaattagctgggtgtggtggcacaaacctgtagtcccagctactcgggaggctgaggcagaattgttgcttgaacctgggaggcagaggtttcaatgagccaagatcgcaccactgcactccagcctgggcaacagagcgagactctatctaaaaaaaaaaaaaaaaaaaaaaaaaaatatatatatatatatatatatgtacaaatatatatataaatttttctgtagaattctggtaatgtctttatttatagctatgaacatgaaacatgacattctattggtttaaattatttaactaatttgttagtggatttccaaatgctaaatctgacttgcatttctagcataaaataccctggatcataatataattatatgttttagtatgctgacacaatggcttccaatatttaaaatttttacattatatttatatgttctatatgactgtaatattctatatgtgtttgtttaagcaaagttctcatatccctcttatgaacacttacacataagtagtgggaagattgcctacattaaaactcttgaacagtctagatagcaacagtttatcaactatttaataagtagaatttctctctcaagtatataatgttggtgtttttctatatgagaataaccctttgagatatgtctctgtttcttctgtaaatattgaacattttacaatctctaactctgtgaggataaatgctgataacatttattcctaaaataaatcaacatttgcatgttagtttacattaaattgcacatatttgccccatttatgtttatatcaatatttaatttcaaggtttttttttgcactgtaacctttcacatattctactcaaggtttttttttttttttttcctttgaggtggagtttcgctcttgttacccaggctggagtgcaatggcgtgatctccgctcactgcaacctccgcctcccgtgttcaagtgattatcctgcctcagcctcccaagtaactgggattacaggcatgcaccgccacacccggctaattttttgtgtttttagtagagacagggtttctccatgttggtcaagatgttctcgaactcccaacctcaggtgatttcgcccgcatatgcctcccaaagtgctgggattacaagcgtgagccaccgcccccggcctcaagcttttcatatgctcacatttcctgattaaatatgaaagaatagtttgggccgggcgcggtggctcaagcctgtaatcccagcactttgggaggccgaggtgggcggatcacgaggtcaggagatcgagaccatcctggctaacacggtgaaaccctgtctctactaaaaatatacaaaattagcctggcgtggtggtgggcgcctgtagtcccagctacttgggagactgaggcaggagaatggcgtgaacccaggaggcggagcttgcagtgagccgagatcacgccactgcactccagcctgggcgacagagtgagactccgtctcaaaaaaaaaaaaaagaatagttttgctcaggaatttgaagattcacagaaaatttgctttttagcagaggaacacctaaaggaagcgcagaacccagaaagacacgctgacttcactgtctgttcttcgtatatcacactcagcattttcctctccctccatgtgagcctctttctttcttcagaaatcatagatgagaaaagcctgttccaaattccttcatttctctggggacaatagacagctgtaatcatttttcttgtttgtttttttctgttttgagaaggagtcccactctgtcacctaggctggagttcagtggcatgattttggatcattgcaacctccacctcccaggtcgaagctattttcctgcctccgcctcccaagtagctgggattacaggcgcgcaccaccacacctgactaatttttgtgttttcagtagagacggtgttttgccatcttggccaggctggtctcaaactcctgacctcaggtgatccgcctgcttcaacttcccaaagtgctgaaattacaggaaggagccaccacacctggcaaagagctgtaattgctgttggtaagttgtaactggagcgaatttttcaaaatattgctattttttttccaagtgcaacagctcatttcactttatttagctatgaataattgcgatctatccatactgacttaaaacacacaagttattatttttttttcacataaaaagtcaggagttaggcatacctggggtggtatggcagcttcaggaagcctttagggatgtctctgctccatcacccctgacatttgttttccattcttcatggtccaagatgagggctgaagatccagaacatctattaacatccatattttagaaaagcaagaaagctgtttttaaaatcatcgttgtttcatctacttaatttctgaatcttattttatttgtgcttttttcttccaacttctattttaggttcaagggtgcatgtgcaggtttgtgaaatgggtaaattgcatgtctctggggtttggtgtacacattatttcaccagccagatagtgaacatggtacttgataagttgtttgtttgtttgtttgtttgtttgtttgttttagagggagttttgctcttgctgcccaggcttgggtgcagttgcgtgatcttggctcattacaacctccgcctccaggttcaagtgattctcctgccatagcctcctgagtagctgggattacaggtgcatgccaccatgcctggctaatttttgtatttttaatagaaaccaggtttcaccatattgaccaggatagtcttgccctcctgaccttatgatccgtccaccccagcctcccaaagtgctgggattacaggagtgagccaccgtgcctggcccaatttttgtatttttagtagagacaagggtttagcatggtggcaaggctggtcttgaactcctgacctcaggtgatccacccgcctcagcttcccaaagtgctgggattacaggtgtgagctgccgtgcctggcagataggtagattttttatcctcaccctcctcacaccctctactctcaagtagaccctggtgtttattgttttcctctttgaattcatgtgtactcaatgtttagcttcaatttataagtgagaacatgcagtattttgttttctgttcctgcattaatttgcttataataatggcctccagctgtatccatgttgctgcaaagcacgtaattttattctgttttatggctgactcgtattccatggtgtacatgtgcctcatttttctcattcagtccactgttgatgggcacctagattgattacgtatctttgctattgtcaaaagtgctacaatgaacatatgtgtgcatgtgtctttatagtagaatgatttatatccctttggtatatatctggtaatagtgtagcaggatgagtcgcagacaaaactcctcagacgccagattaaagaaggaagaggttttttattcggccgggatcattggcagactcgtgtcttaagagccgagctccccgaaaaagaaattcttagcccttttaagggcttacaactctaaggggtctacatgaaaaagtcataatagatcaagtaagcgtgagaaacatgactgggggctacatacatcagctaacagaacaaaaagttttacagtattttctcatacagtgtctggaatttacagataacaccaatagttttggtcaggggttaataatattattattattttagccaccagggccaggtggtggtgccaaggtcgtctagctatttatcttacttctgtttcttttcaactttttgctttctcccttttctcctgtcttataaactagggaaaaggggaggttggggagaaactgagaaggacaacaggagaagtggcgacctcataccatatttccccccctttgagaattttcacttttagtgggagttcttactctcgtcctcacttttttagtctctttgtgagatagagcgatagtgatttgtataatacacatgtgctgaagttttctgatgaactaaagtaacaacaaaatattttatcatttgaaaaagcaagggtaatacacaggggagcagcaagcaagttcctatcactagcaatacacctacaatgagggttttaaatcctcctatagctggaaaccattttccaaataaagactcaggattaaacttgtgccaaacctgtacaggcacatgtgccacctttgtcatgtccctgactatgttttcaaccacctgtccttgatcatctatttgtaggcagtaattggttaagttaaattttccacaaactcctccttcagctgctagcaagtagtccaaggccagtctattctgatagatagcattcctcgtttgggtttcctgccgagctaaaacagtcaaagctctgccagtttcattagtaattatttctaagatggcctgcaaccgtatgatccgattgagcatgtaaatgggggttcggtatccccatgagccgtcttgtgcccatgtggcaggcccataatactgtatgatcctttcagggcgccactcattatctttccagtttcctataactatgcctctcttttctcgggaggcatagacagggaaacctagggtctcacctgtttttatgggtaataagaaaaaggacgacttaatagtgccaataacacaactgcctgcctatttattaggtaaccgaatgtaggctctgtgcccacatatccagtatagtccagcgggagccatccagtcctgatgagattctggatgagcccaagcagtttttaattttgaaaatttactaaatggattcttttcagtgtggtttatgccccaccaagtaattgtctttgttgtactgttatacaacttctgtcctatacaattaagctttcctacagggatgataaagtctttcccttctctagctatacagtattgtccaataattgaggtttttaggacccagaagttgctagcttgggttttctgaactggaattatatcaggagctggatcagtaggcaccaactctcgggcttcccaaggccatcggtctccgatagtggttcccccgcatacataacaagaagtaacattaagggaatgagctacattttctgctaattggagaaacaaattttttgtcttttttggaaattctggtgctggcagattcagctccttataaaaggtttgaaatactggtttgggagagcacttgtggacctcccctctaattaaaatggcaacttgggggtttaaccctgtcccatcaatccccagggttacacgttctccctttttccaatggggatctaggggattggtaattattagttctagtgggttacagtgaccagcagcacaggaggggttggcttcccccttctgaagataaaccgggtcctttttgttctttttccaagtagcccaaataacacatggccaataggcacaattttcacaaacccctgactcatgacaaacatatttattttttattctgtagctcctttcccagttaagagaatcacatcctattcctagctttttactattaatggctgcacaagcatcaaatcttaaagttatttgtttggggatttctttttcttctgttctagttattattttacttgtatcacctaggaaaaggccagttcttattcttatttcaaaaatggtggttgcaggaggctcagatgggttataacacacatcaggtcggtcatttcctgggctacatacattgtactgagtagcattatacaaacaagtttcttttaatgttcctatacatttataataactatagaacagaaacattgttttaatttgctgtcctacctcggtgacctgatgaatacactgggaacagtccccagtttgagtaagatcagttgaagcccttactgtataagtccaaaatttaagaaaaatgaatcccatgatgagcttctgcatgcttcggccgtgcgtggaccagtcagcttccgggtgtgactggagcagggcttgttgtcttcttcggggtcactctgcaggggttttctgggcttggtcttgcctcccaggtttcaggcactgcaggttttacacggctgtggtggatccaggttgggattccctctaccttcacagcggtgggagtgctcaggatgacagtctggggtcctttccaccgtggacacaaacaggctacgtttcagtccttgatccacactagatcacctggggagaaagggtgaactggggagaataagttaacagggcatctctcatttacccaggccgagattgtttgtgtaatttttcctgaagcctgtagctatcgctgtaactcaatttcacctaactctcggggagtgcctggaagtccccgcaatataggagggggcctatgatataatatttcataaggggaatatcctgttcttttagaaggggtacatctaattttaaataataccataggaagagcctgtatccattttaatcctgtttcttgacatactttccctaaactatttttgatagtccgattcatccgctctacctttccggaactctgaggctggtaggcagcatgcagtttccatgtgatccccaatacctttgccgtcttctgtaccaagtcagccacaaacaccagcccattatctgagccaatccgtaagggcagtccaaatctaggaataagatctcgaagaagcacacgagttacttcatgagctttctcagttcgtgttggataagcctccacctgcccagagtaggtacacacaagaactagtaaatacttgttacctccacactttggcatctctgtgaagtccacctggagatcttcaaagggggctgctccataagcttgtatgccagggggaacagctggaccttgtctcgcattatgctgtcggcaggtaacacaccgctgcgtcactgttttggcaagggctgacaaatgcgagatgtagaaataccagcctaacaacttttcaagtgattcctgacctagatgggtggttttatgcacagccagtacaactgcagctcctagcagctgtggcacagctactctcccatctggtaaccaaatccatccttcctccatcacttgtcctccctctgcctggagaaagtccttttcttctttagaataagtaggtacaagatcaggtgcttgagggagcaggggggctgtcactgatgcccggaagggggcagatgctgctttttgagcctctaagtcagtgcaggaattccccaaacccaccaaggtggaagctcactggtgtcctccgcaatgtataacagccaccttgtggggtttccatactgcttctaataattgcaagatttcttgttgatattttatgtcttttcccccagagttcaataggcccttttctttacataatgctccatgcacttgaagggttaaaaagacatatcaagagtcagtgtaaatgtttacagtcttaccttcactgagttctaaggcccgaattaaagcaatgagttcagctttctgagttgaagtgccctggggaaacgatctggcttcagcaacagtgtccagagttaccaccgcataccctgcacatctctcttcttgtgggttgacaaagctgctcccatccacgtatagttcccagtctactgatgcccagagtaaactgagtccaacacttctacacagtcatgctcgacagggatctctaatactgggagcaaggtagcggggttcagggtgttacaaacttcaatggttatatggggattttcacaaagcaaactttggtacttagtaagtctagcattcgttagccaatgatgtcctctagtattcattaaagtcaccacagcatgggggtcctttatgttcaggttttgcccaagaatcagcttatctgcttcttgtactagcagggcagttgctgccaaggccctcaaacacgggggccatcctttagaaaccccgtctagttgtttagagaggtaggccaccggcctcagccagggccccacagtttgggttaaaactccaactgccatcttttcactctctgacacatacaatgtaaaaggctttgtcagatcaggtagccccagggctgggactgacataagtctttcctttaactcatgaaaggcttgctgttgctgggatccccattcaaaaggttcctggtcccccgcctttgtgacctcatacaaaggcttagctaatactgcaaagtttgggatccacagtctgcaaaaacccacagcccctaagaattctctcacctgccttctggtcttaggctccggtagattacaaatgacctgctttctttctgatcccaggctgtgctccccctgttggatagtaaatcccaagtaacatacctgctgtcggcagatctgagctttttttcttggacaccttatacccacagtcctccaggtgccggagtagagcatctgttcccttggcgcacccgactgccgtggggtgtcccagcaaaaggtcatcaacgtactggagcaacacgcagcctaggtctctggtgggaaacttctggaggtctcgagccaacgcctccccaaagatggtgggggagttcttgaacctttggggaagctgggtccaagtgtattgagtagtgacacctgactctggatcttcccactgaaaggcaaacagcttctgtctctcaggggctaatctgatgctaaagaaagcatctttcaggtccaagcaggtgaaccagctgtcctcagctggcagcaaccccagcaatgtgtacaggttaggtactgttggatgtaaagtcactgtagcctgattaaccaagcgcaaatcctgtaccggcctgtagtccttggtcccaggcttgggaacaggcaggaggggagtgttccatggagactgacaaggaactataattctaaaggttcttaggcacttgagatggacctggataccttcaagagcttctctgaggaccgggtactgtttttgcctaaccggctggaccccaggcttaacttctataagcacgggggcttggttgactgccaaccctggagggttgtcttccgcccacactcttggccaccgcttagccagagctggtcttatctcttggcccggctcagttaagaaaagtctccattcctcctctcgggggagcataagggtcataatgactcctgttccgggtaactttagcagcaaagagccgtgctctgtaaaagagatagtggctctcagtttgctaagcaagtctcttcccaacaagggcaagggacaatcaggcatgtacaaaaactgatgaatcactttatgtcctcctatagtacaagtctggggcaagcagaaagcttgttttgctgaaactcccatggctccgatgatgtcaatagtctttttggataagggggcgactgaggcagttactaccgaatgttcagcactggtatctacaagaaaatcaatgtctttacccccaactgtcatcctgaccataggctctttggaggtccttgagcccagtccccctcagtccaataacccttctgccaggttgagcagggccccttcctccttgtctggagcctcctgctccgagtcaccttgttttccttttagctgagggcatttgttcttccaatatcctatttctttacgataagcacactgattacactgcaagctctgacagccaggctgagtttctttcccagggccccccttttcccttgcctctttggggggacccctctaattgctgcagctaacaggtcggcgtttcgccgggcctgacgttcattctctatgtggttttccttacggcttgctgcatccctgtttacaaacacctggttggctatttctaataactgtgatgtgttcatccctgcaaacccagcctttttctgcagttttcttctaatgtcttctgtgctttgactaactaaagccatgttaatcatgcgttgattttcagggctatcgggatcaaagggagtatacatacaataagcctcacacagtctctcgtagaattttgctggactttcttcttttccctgaatgacctcagagaccttgttaatgtttgtggccttctgggctctcctctttaatccttctaagagagctttcctgtatcggtttagcctttgcatatcctctctttaatttgggtcccactgggggtcggttcctggtaactgtgtccttacatactcttgggggttttggtaatcagccagtgcatgttcctctagccacttagttgctgcttgaagcacccttcacctttcatctgttttaaagaggaacatgagcaactggtggcaatcagcccaagtggggttatgggtctggataatagtttggagcaaatcaattagagcttgcggcttttcagtataggacggggtattgtttttccagttgagaaggtcggcagaggtgaagggctggtacacaaaaacacgactctccaccatgtgcccatcctcatctattccagtatactgctgctctctcaggggcatttgtatccctgttttgggtcttaaatgagctgccaagggaggggtttctcccgaggcttcacctcctctcttgtctactctgagtggcctagggatacatttgtctggcagaggcgcaagcactgtggactcaaaagtggggagcctctctccctgataaggggagggcaacactgggatcactggtgccatctcctgcaatggatcttctgatgtttggtcgaacagaacttcaggagttgatttccctcagcgggtggagcagaatccttccttgactatctgtccctttgctactagcactgctgctgcctgccctcttagccactgtggggggtctagcaccagctgtaaccaagtgtctatgtatggaaactggtctgagtgtcctgacttactagttaccttgtgccataccttagaaacaagggacctgtccaggcttccttctgatggccaacccacttctaatgttggccaatctatttcacacaaagttctaagtttccctggtgtcatagtaaccccatagtctccattaaatcccttcttaaaatttttcaacatagttcctagaggagtaggcttattttgtgtctgatccatgtttcctcaagacaaaacaccaagctcacaccacatgcacaccacaaaacaaagaatgggtaaaaagtgcacacacacactttttcagttttcaccaaaccagaatcaaaaccaaaatcagagtatccagaaatccaagccaggtcaaaccaaaaccaaagtatcaagcaattcaagtcaagtcaaaaacaaaaaccaaagtgccagtacaggcatgccgtggttgatcaggccacgcttccactcaaatggagtgggcaagttccgaagaccagtcttaccaagtttcaaatgtctggactccaagtgcctgttccttcccagtgttcagccactgcattgatcctccacaggggcctgccacgcactgctctgacgaggctttccaccggggtaattgcctacctgggagcgctctcaggatccgcgtcactcaagctggccagagtcccctgcagggatgctccacagggcaggcctaagccacctaaggggctgcctcgactgtccttcaattaccttgcttcctggccagggaaccaagaaatgtagcaggacgagtcacagacaaaactcctcagacaccagattaaagaaggaagaggttttttatttggccgggagcattggcagactcgtatcttaagagccgagctccccaaaaaagaaattcctagcccttttaagggcttacaactctaaggggtctacatgaaaaagtcataataggtcaagtaagcgtgagaaacatgactgggggctacctacatcagctaacagaataaaaagttttacagtactttctcatacaatatctggaatttacagataacaccaacagttttggtcaggggttaataatattatattttagccaccagggccaggtggtggtgccaaggtcatctagctatttatcttacttctgtttcttttcaactttttgctttctcccttttctcctgtcttataaactggggaaaaggggaggttggggaggaactgagaaggacaacaggagaagtggtgacctcataccatatttcgatggctgtgtcaaacagtttaaagttatttgagaaatcttcacactgctctttccacagtggctgaactaacttacactccctttgctctgcatcctcaccaatacaatactgtggtttttatttgcatttctctaataattagcaacgtttacatttttttaatgtgctcttttgctgtgtgtatgtcttcttttgagaagtgtctggtttttgtttttgttttgagatggagtcttgttctgtcacccaaactagcgtgcagtggcaggatctcagcttactgcaacctctacctcctgggcttaagcaattctcctgcctcagtctcccaagtagctggattacaggcgcccaccactgtgcctggctaatttttgtatttttagtagagatggagtttcaccatgttggccaggctggtctcaaactcctgacctcatgatccacctacctcggcctcccaaagtgctaggattacaggcatgagccactgtgcctggctgagaagtgtctatgtctttgctcattctttgattggattgtttatattttgcttgttgatttatttatgattctttatagattctggatattagatctttttcagatgcatagtttgcaaatattttctctcattctgcaggttgtctgtttactttattgatagtttctttcactgtgtagaagctcttaagtttaattaggtcctgcttgtcagtttctgtatttgttgcaattgctttgggagtcatcatcatgaaatctttgtcaagacctatgtgcggaatggtatttcctaggttttcttcaagggattttacagttttagattttatatttaagtctccaatcaatgttaggttgattttgtacatggcgagagagagaggtccagtttcaaacttctgcatatggctagtccattatctcagcaccatttattgaataagaagttctttccccattgattgttattgtcaactttgtcaaagatcagatagttataaatgggtggttttatatctgggttctctaacctggtccattggtctctgtgtctgatttcttacccgtaccacgttatttagattattgcagcctgtaatgtagtttgaagttgggaagtgtgatgcctccaggtttgttctttctgcttaagattatttcagctatttagactctgttgattttatgtaaattttagaatgaattctggggataatattatttgtagtttgataggaatagccttgaatctgtacattattttggacagtatagcctttttaacaatattgattctttttattcatgagcatggaatgttttccattactttgtgctttctctgatttctttcagcattgttttgtgattctaattgcagagatctttcatccccctgacataattttatttgatattttgcattcacaaatactaattttctctatataattatgataattcagtttctctatgcaatattttacaaattttacattctactcatgtttcccttttcttttctctttttttctttgagatggagtctagccctggtgccaggctagagtgccattctcctgcctcagcctcctgagtagctgggactacaggcatgcaccaccatgcccagctaatttttgtatttttagtagagacggggtttcaccatgttggccaaaattgtctcaatctcttgaccccgtgatctgcctacctcagcctcccaaagtgctgggattacaggccatggtgcctggcctcaagcctcttttcttaataggcattccattatgtgctccttcttggttaagttgaaaaaggcttctgttttaattccaagaggaaaccatttttgcatttgataaattccacttattttaagatgatgctaaatcagaacgtttatattctccttgaatctttgaatcattatagataatatttgccaataaattatgcaatcctatttaaattttaaattttcatattgcaatattaaataaatacgtacaaacattctttaaacaactaacaagagatacaaaaatgtttttaaaatatgtggattttttaaaaaatatatctgatgttgagacagcatgatagttaaaagcatcttcaactcctgaaactgcctcctacaaggaggtgattttagaaatgtcatttatcctattttcatctaagccctcttcataggtaaaatcagaataataaaccacttcatagagttgttgtaaaaattgtatgtaacacattaatataacacattaatatagtagttttataatgctatatctataaggttatcacactatatatagttataataataaagaaaagccaatggcattttcatattaaaggtttttccaagaaaagccagtgagatctttcatattaaagttttatatttgattcaagtgtatttcaatgaaataatataggtgaaaattaaattactaaaatagaaaatgcctgacaacatgtgagctagatatcaaccactggaatttattttgaaaagcacaagcctaatgcaaataatttataaatatatatatgtgtgtttatgtgtgtgtgtgtgtatatatacacatatatatatagagagagaatagaaaaaatcttagtgaaagaaaagtggaatttaaaaacaaagttttaagttggaaacaatggtatgtgaacaatagcccatttcagttgccacaataaaacagaccttatgtgtcaatgcaggatattctcactctgaatgaaaatattagtaattggaaaataatgaaaggcctccaggaatttggaaataggaatgatcttcttttctcagacaacagttggattattgaggaattttttttttgccactttgttataccgggtggatattaaagtccacagatttgattctcaagcacctggctatagccaacatcttggtcatattctccaaagcagcttcacagacaatgacttcttttaatttcaagcatttcctcagtgatattgcatgcaaacatgttttctatgttcacagagtgggcagaggtgtgtgctttgccaccacctccctcttgagtatcttccagccatcattgtcagccccatgaactccaggtgggcacagttgaaactacaaacccccaaatatattgggtcccccaacatcttgtcctggattggaaatacactgataaataccattttttctatgcatgtgattggcaaatcgaacagcaaaaacaattcaaagaaaaaagatttaagatactgttcttcattagataataacagaattaccagcttactgtgcacaacattatcatattgcatggtgtttgtgtgttagatacagttaggttcactcttcaaatagcttatccagtttccccattctctattctataattccaagtattccttacctcaactgtgcaccaacttacctaactatgcctagacatgaatgaaattgttgcaacccaagtcccagtctgcattattttcctttttagagaataggttgctttcctagttcccacataatggaccccattctctctctcttaactcccttatgtgactaacttatctaaaaaatttgaagtatttagccagttgggactagttgagactgtgcggtccaaccctaaccgatagaggaaagacacagaagtagaagctgcattagagataatagaaactcgcacttcctttgttttgtgtgcccttgccattgcttaatttacgaggtgcacccttttatagaagtaaatttgccttgctgagtgctatttcttgtggagcaccgaaaatctgtttgtaacatgtgtttgagactcataatctggaccagtggctccaagatttttattctgtacaagtggccaatgagcacatgaaaagatgcacaacatctttattcactagaaagatgtaagtcaaaaccacagtgatatatcacttcatacctatgggtacaggtatatttcagaagacagatcagtgtgggtgaagatgtggaaaaattgaaaccctcatagagtgcaaaattaggcagcagttttggaaaacactttggcagttcttcctgaggttaacatagagttactacatgtcttagcaattccacttctgagtatatactcaactgaaatcaaaataggtccacacaaaaacatgtatatgcgtgtccatagaaacattatttgttatggccaaaaggtgagagcagtgcaaatagtccatggaggactagatagacaaatgtgatgtagtatacaaggcaatagtattccgccagaaaaaggaatgatgtgccaatatgggacacaacatggatacatattaaagacattatgcttgatggaaaaagctatccaaaaagggtcatgtactttatgaatccatttgtataaaattcccaaaataggcaaatcctttgaaacagaaagtggattaatggttgccagaggctgctagggaaaatagaaagtggctgaatgatgggtgtggagatttttttttgttaattatacagttctaaaattacacagtggtaatgattgtaaagcattgcaaatacacaaaaagatactgaagtgtaaacctgaaaataattaatatattgaatttgatgttatgtgaattttatctcgataaacataattttataaacaaacttcaagccactgttgccaatgataaagactagataatatgctctaaatgcagcagaaaaacactgaaacactaagttagctgaaaggaaaattgaaactaaaatgaaaacagagtccacaaagttctactgaagctttagtcacctagatattcaaataaaaacacccaggttcaactgtgtaaccctctgtcatagaagtctgggtgcttttggtagataaatccattgggcatatcagtgtgacataaaaagtgcttaaaacgtagtttttttaaaaaattataaattcgtgacactcataaagataggaacacatattaaaatatttatttaacatctgaggaatcagccgatatgataaccagtgcaaaaaagagtcaaatggccaggctcacacctgtaatcacaaaactttcagaggcccaagtgggcagatcacgagatcaggagttcaagaccaccctgaccaatatggtgaaacctggtctctactaaaattacaaaaattagctgagcatggtggctgtaatcccagctactcaggagactgagcctgtaatcccagctactcacgcctgtaatcccagctactcaggagactgagccaggagaatctcttgaagtcaggatgcagaggttggactgagctgaactcatgccacgtcactccagcctgggcgacagagtgacactctgtctaaaaacaaaacaaacaaacaaagcaaaaaaatagccaggcacggtggctcatgcctgtaatgtcagcactttgtgaggccgaggccggtggattacctgaggttcagagttcaagaccagcctacccagctacttaggcggctgaggcaggagaatcatttggacctgggaggcggatgttgtggtgagccgagatcgtgcaattgcactccagcctgggcaacaagagcaaaactcggtctcaaaaaaaaaaaaaaaaaaaaaaaagaggccaggagcggtggctcatgcctctaatccaaacacttgggaggctgaggcgggcagatcaccaggtcaggatatcaagaccagcctggccaacatggtgaaaccccatctatactgaaaatacaaaaacattagctgggcgtggctgcgcacgcctgtagtcccagctgctcgagaggcttaggcgggagaattggtagaacctggcaggtggagcgtgcagtgagccaagatagcgccactgcactccagcctgggtgacagagagagacttcttctcaaaaaaaaaaaaaaagaaaaaaaatgcagattcaccttcttagcaagagcagagctgcagttctccatgatatgtttggacacctcttgtgggagatctgctgtgcccagtgcctggactcttccatgcttatgtttcttgctgccactcttgagtacctgatgccccatatcctggagctggtgaccaatgaagctcataatagccacagaaggtacagttatattatcatctatattacatatgattatctatgtgtgtattatatatatacatatattctatatattatataaaatgtatatatatgttttggacaaagacatattcaaacaatagttaatagtttttaaatattcagaatcaaaattatttataaatatattttattacaaacacaattattcatcttattcttagccaaaacacctgatctgtctaataagcacatatttcacagagctacatagagttatcaatggctaaatacattttatagggaaaagtatactctatagaaattctgccttaattgaagaactcaaagccccaaatgttataaacacttttatggctgcattaagttaaaaataagtgttccatcaagtgttgggtcaatctaactcctttctcctgagtatcaacatttgaagttttcacctattcaccaaagactcaaaggccaccctctggtatctctggccttttcatagacagatggtaagaagctgcccagctcatttcaagttcaaggtcagatggtttcttctagaagttccagtttactgtgtaccagccatgtgattctgtatattcatttattctctctaagcagccgtctccatctgtgtaaaatcaggatgatgaatttctctatctttgggttatcccaaataagaagtcaatttgagcttaagtttaagcttaatgcaatgcttggcaccacaaggcatgacacaggatgctaaactgggcacctgtattttacaaaactagaaaactttgagtttcttccctctcctgcattttcacatgtatttggtttaatctctaaatctgttgaagttgaatagatgtgtagacagggattgagattaataatctcatttacaaaaacataaaaaagaatgaaatacgtagaaataaatttattgaaagaggtaaaagatctatacactaaaaactctaaaacattaaataaattgaaggaactaaaaaattgaaagatacaccatgcttatgaattgaaagaattaatattgtaaaaatgtccatactacccaaagtgatctacagattaaatgcaatccttataaaaattccaattatatttttctcagaatttaaaaagtaattatcaaatctctatcaattcatgaaagacccagaatagcctaagcaatattgaggaaaaacaacaaagctggaggcatcatactacctggtttctgaatatattacaaagctacagtaaggccaggtgcagtggctcacacctgtgatcccagcactttgggaggccaaggtgggttgcttgagtccaggagttctagaccagccttggcaccatagcaaaacaccatctctacaaaaaatagaaaaattagcagagtttaatggcacaaacccatagtctcagctacttgagatgcggaggtgagaggattcctagatcctgtgaagttgaggctgcagtgagccacgatgaagcaactgcactccaccctgggcaacagactgaaacctgtctcaaaaaaaagctacagtaagcaaatagcatggtactggataaaaataaacacacacaaatgaagcataataccaagtcaagaaataaatgtatctacttcatttctggtaatgaaggaacaatgttttcaccagcaggcttcacctttcagtgttctatcaatgaatatttatcggtagattatttttaatctaacttcaagcattctgtagcaggccagatgagggcagatcagatgaatgttaacatgaaaattttgtggatttatagttaatgagtaatcatttatgaaagacttaccctatatttctgcagttgaattatttgcagttggtctagtggtgagcacagtcaataagaaacagataaataaataaataaatgtataataagaaactaaatcagtagcctgaagaaaaagtagagttctatttgaaacaataaagaaagagagagaatgcttactgatcttttttttaaaatctgtgatggtcaatcaatatttctctctcagaaggcaaaaaaaaaaaaaaaaggtagccaggagacaggattaatttgtatctcctgcttggatggacagaacagcatgtggagactctcatcatgaacttttactccaagaactaccataggaacataccaggaaaaccaaaagaatgcacagactctttgaaagaagtggcttgccactgcaacctctgcgagacaactgaaaaacagcaagtgccaaaagtgtaagagaaggaacattcacctctaaacacacatactcaaaacctgaaaatccagattaccagagaaggatttagccttacctagggccgaaatgaatttagagagccaagcaaaatataaaagcagaagcagtgggaagagccccataggcactcttgatcctcagggaagccatttctgactttatctcacaggggtccttgggaagggctgccagtggaattggggaagggctacagggagaagaaaacttccagctaaaccctgtaagaattttgacctagtgtcaatgttccttggcagaatcgatgaggggacagtgaatgagaagcacagatacgggcacaaaagccatggcaggtggtgaggggtggcgcctgaaagcccaggttgctttctcaatggggaggcttatagcctggggcaagatctcagtactgctcacggactggatataaacttggtgctgtttgtggggtagggtgtgaatgaaactggccttgctggcttcatgggagctgagtgaggcctgtcactgctggctttccttcacttccatcctgacctgtatgatacagcagaggcagccataatccccctgggaacataactccattggcctgagatccatactcccaaccccacagcagctgcagcaagccccacccaaggagggtctgagctcagacaggtctaaccttgtcctcgcctgatgcccttactctacccatgctggtagctgaagacaaaaaacatactctcttgggagctctatgttcccacccattgcctgagaaacctgaatacttatccaggtgacccaatggcaagcttgcctacaccctatactaccacaactgatgccgtattgaaaatcccacctctaggttggaggccaaccaactcaagccattacatcaactcatcaaagaaccccaaccaggtggtgtggctcacacctgtaatcccagcattttgggaggctgagatgggtggatcacctgaggtcaggagttccagacccccctgaccaacatagagaaaccacatccagtttctactaaaaatacaaaattagacaggcttggtggtgcatgcctgtaatcccagctacctgggaggctgaggcaggagaatcccttgaacctgggaggcagagattgcggggagccaagatcgcatgattgcactccagcctgggcaacaagagcataactccatctcaaaaaaaaaaaaaaaaaaaaagaacaacctcactccaataaaggagaaaacaacagctaattccatcacctgtaacatcctggctaaccagaagtcctcagtctttcatgtgacaacttcactgctagaacaaccagcatccaaaaaaagaaaaaaaaaaaccagtgcactaaacagaactacaaccaaccaccctcacagagtccactttactcccctgctacctctaccagagcaggtggtagaatccatggctgagaaacctgaagacagatcacatcacaggactctttgcagacactccccagtaccagcccagagcccagtagctccactgggtggttaaacccagaagatcaataacaattcctggctctcaggaagccccatcccaagggaaaaggggagactatcatgtcaagggatcaccccatgaaacaaaataatctgaacagcagcctagagcctcagctctttcctctgacatagaaaacccaaatgagaaggaaccaaaaaaacaattttggtaacataacaaaggaaaaattttttaacaccttggaaagaccacactagctccctagcaatggatgcaaaccaagaagaaatctctgaattgcagaaaaaagaattcataaggtccattattaagccacttaaagaggcactggagaaagataaatactaactgaaagaattttttttttaaaatacaggatatgggtgaaaaaaattaccagagaaatagatagcataaataaaaaaaaatcacaacttctggaaatgaaaggcacacttagagaaatgcaaaacatagtagaaaattacaaaaatagatccaaacaagtaaaagaaagaacttcagagctcaaagacaaggcttttgaattaacccaatctaatgaagacaaaaaagaatttaaaaaatgaaccaaacctccaagaagcttggaattatgtaaaaaaccaaacctaagaataattggtgtccccagggaagaagtgaaatctaaaagtttggaaaacttatttgaggaaataactgagaaaaactttcctggccttactagagatctagacatccaaatacaagaagttcaaagaactccaaggaaattcatcacaagaagatcatcacctaggcacacagtcatcaggttatctgaagtcaatatacaggaaagatttttaagagctgtgagaaaaaagcatcaggtaacctataaagaaaaacatatcagattaccagcagatttctcaacagaatccctacaagctagaagggattggggtcctatgtttagcctccttaaacaagacaagcatcagcccaaattttgtattcagtgaaaataagcttcataaatgaagaaagatacggtcttttccagacaaacaaatgcttagagaattcaccactaccaagccaccactgtaagaactgctaaaaagtgttctaaatcttgaaacaaaacctcaaaatacactgaaatagaacctccttaaggcataaatctcacaaggcctataaaacaataacacaatataagaggtattcaggaaactactggcacaatgaatagaacagtccttcacacctcaatactaatgttgaatgtaaatggcctaaatgctccacttaaaacatacacaatagcagaatagataagagtttaccaataaaatatctgctgtcttccagagactcacccaacacataaggactaacataaacttaaggtaaaggattggaaaaagatattccatgtaaacgtaccctgataccctgaaagcaagcagtagtagccattcttacatcagacaaacaagctttaaagcaaaaacaggtaaaaaataaaaaacacaaagagggacattatataatgataaaaaaggactagtccaataggaaaatatcataatcctaaatatatatgcacctaacattggagctcccaaattcatgaaacaattactactagatctaagaaaagggataaatggcaacacaataataatggggaacttcaatactctactgacagcactagacaagtcatcaagacaaagtcaacaataacaacaaaaaagggaatggacttaaactataacctagaacaaatggacttgacaaatatttacagaacattccacacaacaactgcagaatatacattttattcatcagcacatggaacattctccaagatagacacatgataggtcacaaaacaagtcgcaataaatttaagacaatcaaaattatatcaactactctctcagactgcagtggaataaaattcaaaatcaactctaaatgaaccatcaaaacaatgcaaatacatggaaattaaataaattgtagaaattaaataaatacatggaaattaaataaataattaaatttaagatcaacctggttctgaatgatctttggatgaaatcaagatttaaatttaaaaattctttgaactgaacaataataatggcacaacctatcaaaacgtctgggatacagcagaagtggtgctgaaaggaaagttcatagcatcaagttcttccatcaaaaagtctgaaagagcataggttgacaatgtaagataacacctcaaggaactagaggcacaagaacaagccaagcccaaacccagcagtagaaaagaaatatcaaagatcagagcagaactaaatgaaactgaaacaacaacaacaacgaaaatccaaatgataaatgaaatgaaaagctggctcttagaaaagataaacaaaattgatagaccattaacagcattaaccaagaagagagaagatccaaataagctcaattagaaatgaaacagaagatattgcaaccgctgccacagaaatacaaaagatcatttagggatactgtgaacacctttatgtgcacaaattagaaaatgtaaaggagatgaataaattcctgcaaatgtacaatcctcctagattaaaaaaaaaacaactctgaacagactaataacaagaagcaagattgaaataataatttaaaaaattgccaaccaaaaaaaaaatgttcagaaccaggtggattcacagctgaattctactagcctttcaaagaaaaattggtgggggtaagggaggagaccacccctcatattgtcttatgcccaatttctgcctccaaagaaagaaaaagtaaaaactaaaaggcagaaatgaaatccacaagcagacagcccagcgccacaccctgggcctggtagttaaagatcgacccctgacctaattggttatgttatccatacattacagacattgtatagaaaagcactgtgaaaatccctatcctgttatgttccattctaattaccagtgtatgcagcccccagtcatgtaccccctgcttgctcaatcgatcatgaccctctcacgcagacccccttagagttgtgagcccttaaaagggactagaattgctcactcggggagctcagctcttgagacaggagtcttaccgatgtccccagccgaataaaccccttccttctttaatttggtgtctgaggagttttgtctgtggctcatcctgctacaggggcagggccaagatggctgattagaagcggcatcccatagaaaagaaccataacagtgtgtgaatgctgtaccataacctgaggtatccatgttctttcatcagaactgactaggtggctggcgtgatccatggagaggaaggaagagcagtgtggtgtggcagcccacctgacacccacatgggcctggggagcccccaccccacagccaagggatgcagtgagtgagcatgctacccagcctgggaaactgctttttccatggaactatgcaacccacggattagaagattccactcatgaacccacaccactggaacctaaggtcccaactgttggaagcaagagctcagagtcgcaaagaacatgggcactgaaacaaggaatttctcagcaaggcaaggcacatttacttctgcagaagggtgccagtcatgtctctggctgttttgagagcacagcatacaagagagggaaggagtttttatccctaacacagtccctacttctgtgtgctgcccccattggctggagtcagaccacacaatctaagctaactcgatggctattttaaatcgagactggcaggaaggttgtttacagagcaggtaactaggagtgaggaggacttcttccaaataaggaagagatgtgggttacggattgcgactggggagaagagatgtttacagagcaggtagctaggagcgggaaggtataaggaagttgattttgagaacaaacaacaaggaagttaccctttgaagaggaacttattatgcctgacacaaccctggagctgagcagattatgaacagcctgtcaggtagaatctgcttaagcctgccgagttcccacggtgggggagaccagcaccaccgttgcagttggctgctgtctaagctgtttgagctccttgagggagggacagcagccagcactgggactcgaaactgcctaacaggctaagatccctggatggggaaagggaagcagccatctctatagctcctggcctcacttttcctctgctagatccaggaaaactggacagcttggtctcaagaggtgtcccccacagcccaacacatgggctgtggcagactgtggccagaatgtctcttcaggcctgacgctgacccatctctcctcactggtcagggcctccctgcaggaactccaacatctccagccaggggctcagggacataactctgatctccctgggcctgagcccctagggggaggggtggctgcagtctctgtggaccagcagacttagcctttcctcctgctagttctgaggaatttgagcagcccagatgagtgggtttccccccagcaaaacacccccctccaccaaggaacagtcaaagtgcttcattaaatgggttctgctccccatgccacccaactggtgacacttcaacaggggttgtcagacaccctatacaggagccatcttaatggcatcaggttggtgcctcttgagatcagagatcacagaggaaggagcagactctgcttttctccaacctccttgagtgacatctccaggcatgggagtgaaccagattaatagggcctgaagtgaacccccctcaaactgcagaagccctacagaagatgtacctgaccattgaaagaaaaacaaacaaacagaaaggaacaacagcatcaacaacaaaaaagtacccacaaaaacctcatccaaggccaggcatggtggctcacacctgtaaaaaggttaacgtgtttttgtgattggctattgtttttcagtaactaacgtataggaatagattgaaacagaaatttctctgaaacagcgccggatgaatgcctaaaggggctcacacaacctgctctgagacttggtgaccattatttttgtccacgttcaattgagttcaaatttaatatttaacttttccagtacattcggcctcaattggatattcaattgtattaaaatacccttacggatacatcgggaaggcatagttgatatatattacagatacagggtaagcacaggagaattaaaggcacaattaataaaaattaaaccccacatggcgttgcaagcagagtaatattgtgagacttgccaggaatatacacacaacatttagtatgcagtaaggcgcaaacccctccttgggctgtggtaagcatatctaatgccatttgattttgcaacacaacaatacgcagctgagcaaattcatctgataacaacataagcccagtgctactatcattaagagctttttctacatgtaagctaaatattataatttgttggtgaagcaagattgtaccagtggcaggggagaatactgtgatagggtaccaccaccagggagtccagcacatttgtaaccagcgatgtttgtaagcatctagattactggggaggggaatattatcctggatggtgaatagaattaatggtcacccccaagtgcatctccccatccaaagtgggggcagtatcaccaccgataggatctgcatacccagagggccccccaggggacagcaatggagctactgtaatcatagtgtactaatctcttattaaaataggaaagagattgttgttcattgggtgcaatgttgttgatttggagtatgtgttgacaattgagtggagaaaccccagagtaacattagaggagccatttaaggcctctagacaaagcaggggctatatggaatccagccaccagcacagaaggttcgtagtatataccattccaggaacattgggcagaataccaaggctttcaatgcaaggtgagggtggagttcatcttttgtctgacttggcaaagattgattttttagtgtggtcaaatgaagtccaggttggattgcaagtgctgttgttgcagccccattggtaacaacatagccattcagaaatgttgtcagggatgattctccaaggtagaccatttttggcggcctctagcaactccacgtatagccaacattgattgcagttggcttctgttgcagcagtggctaaaaagttgatgaatttattcttggcctcagacacaaagacacaggtgctgaccattagtagataggttattccctgtaataacaaaaacagaggggaacatcatattgtttttcatctttaggaaattgtactatgccttcattttctgctttcatagctacaaggtcaccagccttagggttgggatctgatggacgctgtacccatattttggctccaggatttaagcttcctgtaccaggggatctgaatccccaagttctgtatgtagcctctgttgggcaaagatttcctcaggggttaattgtggacaaggtaccactaacaattgagcaaccagcatctgtggttttatagcaaaagaatctggagaggtattgtataaaatgtcctttaactctccccggtaatcactatcaattattccaccatacattattatgcttctcattgcaaggcttgaacatgttgtaatccatttacccacattcaagatcacagttatggtggaaatttttgcctgttgatcttcctgctgattaaatagtctgtcaagaggaagcagagacacactagcatcaacatggaaaacagggccaggcacagtgactcacacctgtaatcccagcattttgggaggctgaggtgggcagatcacaaggtcaagagattgggaccatcctggccaacatggcaaaaccccgtctctaaaattacaaaaataaactgagcatggtggctcatacctctaatcccagcactttgggaggccaaggcctgctgatcaggaggtcaagagatggagaccatcctgtttaacatggtgaaacctcatctctactaaaaatacaaaaattagctgggtatggtggtgtgtgcctgtagtcccagctactcgggaggctgaggcaggagaattgcttgaacctgggacatgaaggttgtggtgaacccagattgtgccactgcactccagcctaatgaaagagtgagactgcatctaaaaaatgaataaataaaaaataatacaaaattagctgggcgtggcagcctgtgcctgtaatccaagctacttgggaggcagaggccagaagaatcacttgaaccgtggagatggaggtggcagtgagctgagattgcaccactgcacttcaatttggtgacagggctggattccatctcaaaaacaaaaaacaacaacaaaaaaacatggaacacagtgacgatgggagtatgcaccaggattcagataccttaccaatattgttttccccaaacctctttattccgcattaaccatttgtttcattgccacttgggcacccaggtagtaagaccatttgctactgacaaagagttgatataaaagtaacaaatccctctggcctcctcctgaatagctcggagaaacgactactagttcagctaactggctgctcccaccccttccttcatcagaaatgcttatgtttttaacaggattataagccacagccctccagcattgggtcccaccaaagtatttggtggatccatcagtaaaccaagcatgtttctgatcctctgggcttagttctttaaaggatttgccccatttgatgtgtgtgtgtggggggtgtttctttccctatctgcaggacttgcttggttgtttcctgagctcgcaggttttccacatcctcatgtaaaagtgatagcccctatgattttggcttagcctggttttgtatgtcccatttccattttatgatgctactttctgggcatgccctatctggtgggttttgggggaactcatgaccaaagtcataatagaaatttcaggcctcataaagacatcgtggttgaagcagaggtgttccatttccagcaaagctcaatagcaagctaacaattgcttctcaaaagaggaataagcttttccagcctctggcagtttctgggtccaaaacatgaaaagtaccctctttccatcttgtttctgcctaaggctccaattagcatgttgatctacgacagttactcgcagttcatcaggcccatcccatataggccatagatccagggccagttgcactgcttgtttagcttgttcaaaagccatgctgtctttctctccacagtgagagtcatacctttttctagtggctgcattcagatgttgtaaaatgttacccaagtaaggaatatgatgtgttcagaatccaaacaagtcaatacatttctgggcctccttcttagtggtaggggttgcaaattatagtattttagccttagcctttggtgaagtggactgtttctttgcattccataggatgccaaagaattttacactttgtgcggatccttaattttactaggcttaatttcccatttttgagataggaactgggtttttacatgctctaagccccggctgactagttcttcagttttaccctgattgggccacctggacagctgcttttttcagcaataggctgatagctttgagcctgatcagtcaagacattgactggcattgggccagggccagtccggaagtcagattagcattttccttttccagcttatatttctcttgtagcaaccagcccctatcttgacacattaacttataagcagcaatcaaacactatccactttgtgagattccctcagcatctcctttggtgactggaatcccctgcagcacttcacgcacagtcaaaggtttaaattgcactaatttagattcccaattcccacaaaggccagttcccctgaaccattcaatcacaaagaaggagaactgggagtgatcccatctcaggatatgggaaatccttgagcctccagccctatccttctggtcaaaaaggggcccacttttgttttcaaatcctgtttgtgatgccaaaaatgttctgtatgggaaacgtgggagaggagaagaaaagacatacatacaataactttaatggtaaacaagctttaacccacatcaatatcaatgcagacagaataaactaatgatataataagcaaatgatataataagcaaataaatataatacacagattgatataataagcaaattgcagtaagaagaggagatgggaaaagatatatatatatatttaccctcactagactatggaggattaccaactgagtaggaagaaacagcccaggctccagagtcggccacccattcatgcacagacaaggagtctcatgaagcttcagggtggtctgggaccctagctcttttgtaacgagttgtttggcataaggcccagtgaggagggccatttgggacttgcctcacggaacacaaaagggtcaagttgtttttgtgattgtctattgtttttcaacaactaatgtatagtaatagaatgaaatagacatttctttgatacagctctggatgaacacctcaggggctcacaaccaggacctgttctgggacttggtgaccattgtgtccacgttcaattgagttcaaatttaacatttaacttttcctccataaattctcctgtcttcatgaattggctctgtctaggcaaagggcaaaatgaaccccttgggctgttacataacctccacctcctgggttcaagtgattctcctgcctcagcctccggagtagctgggaccacagatgtgcaccaccatacccagctaattttttacattgtgagtagagatggggtttcaccatgttggccaggctagtcttgaactcctgacctcaagtgatccacccaccttggcctcccaaagtgttgggattactggcatgagctacctgtgcctgaccctaaattatttctatctcttatagcagtttgaaattacttaaaggttgtttcaagttgaaaaaataagaagaatgtggataaaaataaaatataaatagataaaaaaattacagggattacaaaatatatatgtaaatctggagtggtcaaaaatgacaaatttgatttatttataaggttttattaaaattagctttaatcgttaatacactattaccaaagtaaaagctgattttctcttgaacaaaaattttatgtattattaatatgacagcaaaatacttctgttcacctttgaatacattcaacaagacagagagtaaaaaagagataaaatgttcccatgctctggcatggaccaggctcagctctgggaggaagccctgcctgaaaaggctgcagcttaggctgtcactcttttcttcactccgcccagcagctgatcacatcttctgtcactcagtgtctgagggggcgggaccttaagcattagccaatcagaggcgctgggctggaaaccgtccaatcaggcacgcagctggaatgaacaggacggcttccggatttggcggggtctttgtctctccctgcagctggagctccaggtcgtctgttcactgctctctgtcttcttctcctagaggcccagcctctgtggccctgtgtcctgcaggtattgggagatccacagctaagacgccaggaccccctggaagcctagaaatggtgagagtgccggtccagcatcccgagagaggtgaagtgtctgtggcgggactcaggcctcccctcagtcagctccacaatctgcaccccgaattctccttacccagctctgcctcagtcccattcagccataagatggcggctacgctgacagcctggcccccgggcgtcctgtcgcttccccgcgcagtgactgtgcccctggcctggagcgctctgtgggcagctctgcacccgcagtgccgtgtctctcccagattgtgcagggaccaccggagggtcttcaggggagaatgctgactcgcggtgcgggttcatgaatgggaagagctttggtctgtggggttcacagtttctcttttctgctattaaaattgtatggggccgggcgcggtcgttcaagcctgtaatccccgcacgttgggaggccgaggcgggcggatcacttgaggtcaggagttgaagaccagactgaccaaaatggggaaaccccttgtctactaaaaatacaaaaattaggtggatatgttggcgaatgtctgtagtcccagcttctcgggaggcagaagtgagagaatcgcttgaacccgggaggcggaggttgcagtgagctgaaatcctgccactgcactccagcctgggcgacagagcaagactcttgtctaaaaaaaaaaaaaaaaaaaaaaaattatgggagtcactgcaaaaatatcaaacaatttaatcaaagagtgattcaagaattgtagagcacccagctatagtttgtagtttgtggtccatgggagaggcttgaagaaaagacatttataaaatgcatgatgaggaaaaccaaattcaataatttgttaggtttagtaatgtagtttcttaatttgtacaatcaaggtggaaatttcctggttatgtaattagagcttaattggcagtttatagttgctgaagcctgaattttgtttcccctaatgtagtaatttgccaaaaaatgcacttgagcttagatttttttttttttttttttttagaaatagaaatccggggactagagcctcttcagtctaattgcctgccacttaattattttcacatcccacaggggactgactttccctggcatttttcacatgtgtcccaagcagggcctcaagtgtcccccatgttcctcaattaattattattattattattattttttgagacggagtcttgctctgtcgccaggctagagtgcagtgtcagatcttggctcactgcaacctccacctcatgggttcaagcgattctcctgcttcagcctctccagtagttgggactacaggcaagcgccaccactcccagctagttttcatatttttagtagagatgaggtttcaccatgtttgccaggaatgctagttaccaaggaaaaatatagggaaaatctctcttccattttggctgtagacaatgaatatatttccacaggaaaatgtggtagataattgaggagttacatggattcatcaacacattagttcctctttttgcagggtaaattttttctatatccttttattttgatttctgagttaaatgctaaattttaagtgatgaaacatggtaccttctagaagtgttcccatatgactaattttttactacattattttatttatttacttatttttttgaaacagagtctcactccgtcaccaggttggagtgcagtggcgtgatctcggctcacgcaacctctgcctcccaggttcaagcagttctcctgcctcagcctcccaagtagctgggattacaggtgtgtgtcaccacgtccagccaatttttttgtgtttttagtagagacagggtttcaccatgttggccaaaatgttctcaatcttctgacctcgtgatctacccaccttggccttccaaagtgttgggattagaggcgtgagccacagtgcccggcctactgcattatttttaagataaataataaaataatacatacattgtctgaaagaagtagatatatatgcttttcttataggggtataaaatgcaagcatcttagccaggtgcagtggctcatgcctgtagtttcagcactttgggaggcctagacaggttgattacttgaggtcaggaatttgagaccagcctgcccaacatggtgaaactcatctctactaaaaatacaaaagttagccaggtgtggtggcatatgcctgtattcccagctacttgggaggctgaggaacaagaatgtcttgaacccgggaggtggaggttgcagtgagccgagatcatgccactgaactccagcctgggccacagagtgagacttcgtctcaaaaaaaaaaaaaaaaaagtaagaaccttaaaatttccttcccttatgtaaacactgcgtttgagtaatttccctggatttttcaaacacatagtttcaaaaactaagtgagtaattctgacatggaaattaaagcttgaacctagtgactccaagctaaggctaataattaagcctgcaactggatattgaagactcagttagttttttctggggagcctcccgtgcaggtgtccagcctgctcaccccagccatagaaggagcctttatcctgagagaagctacagagccctggaaagctggggtcccacaggcagatgcagttgaggttaagatgaaaggaaactgagagggtcttactgatgatgcagtcgttatgttttgtggcactttctgtactttgtaaaataaaaacattagatttatgtaaaaaaaaaatgaattccaaaaaattattgcaacaggagaaagtaccaactaaatataagatctttatggcttgcaaagatgtaggcagaaaagggctttcttttttagggagaggtaaacaagataagaaaggaggtgggaggtgaatggcaaatggagagtgaaaaagtcagattttagatcagaggatgtcttaccctgaaatcagcatgttcttaggaggaatgtaaaatggggttgtatgttgactcagactgagggtagctcaaagttcaggagcctgagggagggaaataaacttaagaaaagtatgattaagaaatattttattttagtccgggcccagtggctcatgcctgtgatctcaacactttgggagtctgaggcagtcggatcacctgaggacaggtgtttgagaccagcctggccaacatgatgaaatcctgtctctactaaaaatacaaaaattactggaaggctgaggtgggcggatcacctgaggttgggagtttaagaccagcctgaccaacatggagaaatcccatcactacaaaaaaaaaaaaaaaatcaacaggtgtggtggtgcatgcctgtaatcccatctactcgggaggctgaggcaggagaatcgcttgaactcgggaggtaaatgttgtactgagctgagattgcaccagtgcactccagcctgggcaacgagagtgaaactctgtctcaaaaaaaaaaaaaaaacaccaaaacaacaaaaattcgccaggtgtggtgatgggcacctgtaatcccagctacttgggaggctgaggcaggataattgcttgaacccaggaggtggaggttgctgttagccaagatcgcatcactgcactccagcctgggtgacaaagtgaagaaattattttgagcactgaagacaaattcagctgtttttttaatgagaaaaaggagaaaatgtgcagagcgtgtgtctgcctgtgtgataggtaagaaaagagagcactatcttagtcataatgggaagagtgtttgtttgcataaattgttcctggagcacacaaagaatggagaattttattaatcacaaacattttccagtattatctatgtgtttcatctttccccatttcttttctttgttctatgcatttctcccatttggcttttcctgggctgcgtctcacatattaaactggtaaacataactacagtgttttgctaagttctgtgagtagctctaccagattattaaaattcagagaggttatgggactaacaagtttttaaacagtagctcagaagcatagatgggcccatggggtttttgactggcatctgcagtgaggacagtgttgtaggaccaagccctgaatcagggtctgtgttgactctgggtggtgtcagaattcaaatgttagacaataagttggtgttggagaattgtttaatgttcagctaactctacagatttggtgccagaaaaaagatatcacagaggcctggcctggaataaaactaggtgtttgggaatgggagctctgctttcccatacacaggctgtcacactgcccattgtcctgtgattcaggtcttctcccagggtgacagaggactgaaaacttagaggacaggagctctgattacagacccccttttcccacagctgccaccacaagattcccacccactcacaaacacacacactagacattgacacgtccacactcctcccaggactaggcaccaccctcagaaacttcaccacagcatttttgaccctagtgtttcttgccaagaacccacaagtctctgcaagtctcctggcatatccccatccacagatgctaaatctgcagcagcaaccagttttctccaccaacctaccattttggatcagctgttcataatctcatctgcctgcacacagtaataaatcagagtatggctgcattgggaccactatctgcagcaaaaatcagtcctctcacctgcattgcactctctcctgcccagggatttaattttttattttagcttttatttttgattcggggtacacgtgggtttcttttacaggtaaaattatgtcatgggggttttgtgtgcagattattttgttaacttacgtactaagcatagcaccaaacaggtatgttttctgatcctctgagttctcccaccctccaccctcaactaggcctcagtgtctgttgttctcctctttgtgttcgtgtgttcttattatttagctcttacttataaatgatagtacattcatttggttttctgtttctgcattattttatcttttttttttttggagacggagttttactcttgttgcccaggctggagtgcaatggtgtgatgtaggctcacctcaacttccacctcccggttcaagtgattctcctgcctcagcctcatgagtagctgggattacaggtgcattccaccatgcccagctaattttgtatttttaatagagatggagtttctccatgttgggcaggctggtctccaactcctaacctcaagtgatcaacccacctcggcctcccaaagcgctgggattacaggtgtgagcactgcgccaggcctctgcatttgttttctaagaaaaatagtgtccagcttcattgatgttattgcaaaggacgtgatttttttttaatggccacagagtattccatgatgtttacgtaccatattttgttttgactaaatcttttattttattttatagttggagacagagtctcacttattgcccaggccagagtgccatggcgtgatattggcttactttaacctcaacctcccaggctaaagcaattctctcctacctcatcttcccaagaagctaggactacacctgggcgttaccacacctggccaaattttctttttgtattttccgtggagacaggattttgccatgttgcccaggctgttctcaaacttctaagttcaggcagttcacctgccttggcctcccaaagtgctggaattacaggcatgggccaccgcttctgaccataccatattttctttacccagtctaccattgataggcatttagggcctgtccttgtctttgctattgtgaatagtgctgcagtgaacatgcatgtggatgtgtctttataatataataatttatatttccttgggtatatacccaattttgagatttctgggtcaaatgataattctgttattagttctgtgaggaaccgccacactgctttttacaattgttaaactaatttacactcccaccagaagagtataagcattctgttttctctgcaaccttgccagcatctgttattttttgactttttaaaaatagccattctgactggtgtgaggtggtatctcattgtggtttttcttttaatttctctagtgattagtaatgagcatttttttcatatgcttgttagccacatgtatatcttcttttgaaaagaatctgtgtttttgcctacaatttaatgaagttgtttggttttttcttttaaacttgtataagtttttaataaattctggatattagacctttgtcagaggcaaagtttgcaaatattttctttcattctgtaggttgtctttttcctctgttgatagtttcctttgctgtgaagaagttccatttgtcaatttttgcttttgttgcaattgcttttggtagcttcatcatgaagtctttgccagtttctgtgtctagaatggtgtttcttaggttatcgtgcagattttcttataattttaagtttacatttaagtgtttaatttatcttgagttgatttttgtatatggtgtaatgaagggatctagtttcagtcttctacatagtgctaggtagttattttagcaccatttgttaaatagagaattcttgctgcattcctcttgtcagctttgtcaaaaatctgatggttataggagggtggcattatttctgggctctctattctgttgcattggtcttgtgcactcgtggattttttataacatctttctctcttctcctttttccccataaacattctttgaagtgcatacagtgtgaaaaattcagatgtccaagagttcaaaactatttaaaaagttccaaaacaaattttgctattctgtctgttcttaagggatttagattatatgtagatatttttctctgcttttttgaaatatatgtaaatcatattaacagctaaataaacctttttcattttttatgactccagattatctttatctggtacttcagatttattgctttgtttttgcttctgaaaagtttatttttttcatttttagtcctttaaggtagacacagatttgtttagttaaaactcatttaagagcacacagaagcatagcacaaagataaaattaaatttagcaatacagaatgataaagactaaaagatactaagtttctttgacagaaacctgattatccaaggtaattatccaatatttgcaggctgaagtactaatactgcaaatgcaagaacagttcaatgcatgaactcaacagtggaatctgtagttgtaccttgttttctatttattacttcagaacaattagcatagttatgtttagtgtttgtagacaaactgcattcatataaattaaacagtgtttcctcttttttgagacagactctcactctgtttcccaggctggagtgcagtggcgtgatctcagctgactgcaactgctgcctcccagattcaagtgattctcctgcctcagcctcctgagtagctgggattacaagtgcacaccaccatgcctggctaagtttttgtatttttagtaaagatagggtctcaccatgttgtccagcttgatcttgaactcctgacctcaagtgatctacccatctcagcctcaagttgctgggattacaggggtgagccataagcagtattttctacaatattatgaatataaagccacaatacttactttgaatcacttaaatggttattttaatattgtaatttatacttttgaaatataaagtgttttaactgaagtatagttacagtttttaaaaatggtacatatactatgacgttcattaaaattattcatacttagatatttatatctaatagccagagaaaatttactaccaaattattacagtagatatttgtctgacatatttattactttattcaataggaataacaatgagtaaacacaatttaggtatcttttatttcactaaattggtatgttcctattacaggacagataaagacaggtgatgtggccaccccaacaccataatacctcttcagttagctatgttgcaagttctaatatattccactatacgaacacaatcagattctatttcttcatcaaaaagtgttgtttgaagttgtcagatgtatttcaatatagaacccccattcaatggctagaagatgagacagcagcagagatggaaaagaaactttataaaattattctttctgaaaatctgcaccctcctaatgctcatgtttctcatggtgagagtagctatacactttgagtgtttcgagagaaatttattttaggagaatattttctggctgacttaacaatcttatatctaatctgacctttttcttaagatctttttaacttccttctctcaaaattatcttgctcagagggagatctgtttttctctccaatgctttgtctgtttcagaagccttactagtatcccgtggtgtctgaatgaggtgggttgtcacagtgaaaacttctgatgttatctctatctggactcatgttggaaattcaatattttttccatgtcaccattataagtagaaagtgaggctgaaacactgctcccagtttcattattgtgaagatatgattctacccaggaggcctgcaggctctcctcctgcagctcaggcctcactctctgttgtgacattagagtgttgctgtggcaaatgtagttcacataaaatgtgagctgtgctctgggctgtgcctcagtggcagatagtagaggtcaagagaggagaccagcaaccaggggaaagcaagcaggagtgctgtagcccagtgccagggagtacagagccactgctctaaaatgtaaatagccaaagagagaatcctattcaaccatttttgtagcagagtgaaagcctaccttcagcagccactgggcttcaagctgctaaactacctcctgttctgaagatgtggaaagtttatttgtcattggatataagcatttagcatacccagatgccctattccatctccaggtgattttaggatgaactatgtgtgacatggtgctataaattcttctacttgtggactaattatggtgaccatctttccatctttgtattctgttaaacatattgaccatgatgtatgtcactttcaagtttaattttataagaaagccattttctttctctggggctgaagaaaccattttctttttctggggctggagcttctctggggctggagaaaatttttcttctttttctgtttttgtttgtttgtttgtttgttttttgagatagaggtctcactctgtcaccaaggctgagtgtagtggcatgatctcagctcactgcaacctacagctcccgggttcaagtgactctcctgcctcagcctcctgagtagctgggattacaggcacctgccactgtgctgggctcattttcatgttgttagtaaagatggggtttcactgtgttggctaagctggtctcaaactcctgacctcagttgatctgcccacctcagcctcccagagtcctagtcctgggattacaggtgtgagtcactactcccagcccaatttttcttttaattattgtttccaaacactgtctagaattaccagatgtgatataaacacataaggtgccaaccagaatttactctagaggggactttccctctcaggcttccagtcaacttatacttgtgcagcaaagtgcacgctgtcccctaaatatgcaggcagaattgtgtctctgcctatttggtatctagagttctctacaatcacttctagagaggctagatcaaatttctacaaacttcacgggcagcaatcaatcattttacctctttcactgactcttgtatcttcagactgaaactgattcagagaatatggagcccagaaacccaatcagagtaacatgtgtgcattgagtagacatagagacatgagaatctccactttcttcttcctcctcttgccaaaatgcccacaaacgtacaggtaatacctgctgctactccagccattcaggccataaatctgcagcttcaaattttgaatccaggtcatgagatttgagaaataaaaaacttttatctgaaaaatgcaagtccttttggttatcaaactcagagagacattaaaataaaagtgcagttacatctttatcctattaactatgtattaatctcttgaaactgttccctattggcacaagtagctataaatgacactaataatgccacattggacactatatttttgtttgtttgtttttgagatggagtttcaatcttgttgcccaggctgagtgcaatggcacaatcttggctccctgcaacctctgcctcctgggttaaagcagttcttctgtctcagcctccccagtagctgggattacagacatatgccactatgaccagctaattttgtatttttagtagagatgggatttctccatgttggtcaggctggtcttgaacttctgacctcaagtgatctgcccacctcggcctcccaaagtgctgggattacaggcttgagccactgagcctggcctggacactatattttataccctaaaccattatgatatatatctaattaataatcaatgctatttctgtaaataaaaatttctgaaaaacaactttgtgtcagcccactctctgtccctctgttgttgtctttacaaatcctcttgtaattgctgctaattaaagtgtagattccaggcaacttgaatctttgctcccaggttatgatccttaaacttgacccaaataaactgtctacttatgttcatgttgtgtcagccttttttaatatatatatagacttatcatttagaatgtgctagagcagccttcatgaggggatctctacttagattgtattccacttgctgtaacatcaaaggatgcagagccaggttgatcctacctagaatctgcaattaaggtctggcctctgcctgggatttacaaaaaagcctggactttggatagaaaatgtacagaaaactaacaaaaggcattttctgcgttgtgagatgtcaacctaaacatcttacagccccattttgggagtgtggctctttgagatttttcacatcttgttcattgacctgctacagtgatgtgagaggctccaggaggaaatagaatctgatggcagaatttgtaagtgtaaataagcatcttaggcatgagagatcaaggccacaaagtatccagagccatgatcacaattataattacctgtaaagtggaatactggagaagagttatttttgttatttcctttacccatgagctagcaaatcagaatgggtgttccaggttctggagttccaccagggcagttccattttctatttagaatcagcctgagtctctccagcctggttgatcattgggccatcagcccagggtcactgggaattccctcaaaatcacctaggtgtctttgaggtatttgaggatgttcagagcagaattgtgttagactgacaagagtggttaattctgcttctgtctcagtgtaagagaaatgagtcatcctgtgttttttcatcccctcatacaagaggtatctttggttgctacccagatgagagtttctccagtttcctgttacttggatgataaagaaggaggagatctggagactcaaacagataaactagttgcttcaatttcatatagccattaaaaaaccatgaagcagtcatggttcctacagtccagaaatgtttagtctagactagcaactggataaataattatgcatcatatggttggtacaataaacacgtgtccaaaatcttgggctttatttagtctactttgtttatattgtgacttctgatgtctacatctcaaggcatatttatgaacagaaggattattataatttttattttgagacggagtctgtgtcacccaggctggagtacagtggtgtgatcttggctcactgcaacttctgccaccctggttcaagtgattctcctgcttcagcctcctgagtagctggcattacagttgctggccaccatgcccagccaatttttgcatttttagtagagacagggtttcaccatcttggtcagactggtctcaaactcctgatgttgtgatctacccgcgtcatcctcctgaagcgctgggattacaggtgtgagccaccacgcctggccatataatttctatttcttttaccttgctaagtgtacatatttattttctaataaaattaccctagaaaggctgggcatggttgttcatgcttgtaatctcagcactttgggggtctaaggcaggtggatcacaaggtcaggagtttgagaccagcctgaccaatgtggtgaaacgccgtctctactaataatacaaaaattagctgggcgtggtggcacacatctgtagtttcagctactcaggaggctgaggtagaagaatcacttgaacccaggaggcagagcttgtagtgagctgaaatggcaccactgcactccagcctgtgcaatagagtgagacttcatctatttaaaaaaaaaaaagttaccctagaaaaccttaaaggatttgtttaaattgcgtattagtatgtagcataaagttgacagggcagtggctagaaaatattaaaattacagaaattctgggatttaagtttttcttttaggtaacctttgaaaaaagaatactggtagtactgcagtggcatagagggaagaattctacatagagtccccaccctgcctcagacctgttcagattcaccctttttggaggccttattttggtctgactataccttggagtctttcctcagagaactgattagaagagatcagagttttggctggtgaatcctgttgcctttctagagctggtgttcacaatttcttgaaacccaaaaacagataaatgggataaataacgtatgtattttagggtcctagattttaaatgttctattaaaaccagtgtttgcagagacattatatttagacacttgttttctattcctgcagatccagtagttgctccataagtcacaaaaaagtaaatataaagagaataaaattttgtctaaactacattaacctctttctttctgtatctctttcatctgtctatatttagcttttattccttataatttaaaaaaaattgatgacagaggaacagaagaagaaatagagattctgggcccttttttgaaatcctggaaattattaaacccttagtaccagctcccaggatgttacgagaattaaatcacataatgtgttatgcccagcacagtgctctgtatcatgctcttgagcacacagtatctgtttaataaacattgcattagtacatgtgtacatgttgtttttaaaatacagacttattcagacattgctgccttctgtttcctctccttgtttgtaccagaagtatttggttgtgacaagagtgctaagtgtaagggatcctgtgctgtgcctgcttctctaactaatgtaaataatgcgccaagggggagcaacatcagctttgacaggggacttgtttaaaacacccatgcatagacccttttcaaatctgcagaattacattacataaagtggggccaaaattaccaagtgatttataagcttgttaaagcttgagaggcaatgcttagcttagtgattatcagcccagggttctcattaggatcacatggccaatttgcagaaatctcttgtgccctccccacaggttctgtttattgttctgggtggaagcatccacgttgttttaatgaagggcctcatgtgactctaaggtgaggccagaatcaagtatgaaggcttcaaaatacattcatgagagttaaattccacctttgcactaaagggtggtcacagggcctattctatttgggtttggtagggacaggtcagtgtggtgcatatttccattactgtggcagaaattgctggtgtctgtggcaggggagggcacctgaggacaggaaaggagaaacttatattttcatcttcatggagcagctcattgctcctgaatctcttctgttttaaaggatagaaatggatggatttttctgtctttttctgccaattgatgccatgctagctggtaaacatgtggcactgacacctttaaaggcatattctcaagatgcaggggtaatttgtccagagaatcttcatctgagaaggaattccagagaaggaggagatcagaaagagaaaaaaaaagggcttcaggtaaacatgcctcagctgaaaagctatgtccactctgcctcctggaatgccatgtatctagtacttgaaaacttttacttctctacttgtgtttttcctccctaaggagtttggtttaagtacttcttaaaattcttatgatagtcaaacgtgtctgaaaagtatttcttccctgtatcccagagccttctcttcattctctacatcataacttcttatacgccatgcagatttatcaacaggaatttatgatctgcaatattaaaaatgttccgtttgtggctgttgaacatggaaagatgtggatactcaagatttctattggggaaaactgtggtccttagtaaagatggagaaaatataatgttgaggctccattcatgtgttccattagctgtatgctgaacaggattaaggaattgcttatttaggtcgggcgtggtggctcatgcctgtaatcccagcactttgggaggtcaaggcaggcagatcgcctgaagtcaggaattcgagaccaacctggccaacatggtggaaccccgtccctactaaaaatataacaattagcctggcgtgatggcaggcacctgtaatcccagctacttgggaggctgagggaggagaaccacttgaacccaggaggcggaggttgcagtgagctgagatcgtgccattgcactccagcctgggggacaagagtgagacttaatctcaaaaaaaaaaaaaaaaaaaagaaaattgctcatttaaatgtgatggcatttattacccagaaattctgaaaaaaattattaggagatacctgctttctagggtgttaatgaagcctgcttaatattactactaaaaattacagaacataggaggtatctgtattttgaggtttgcataaaactgatgattctttttgattacattcagattttatttgctttttttaaaaaggaatatttcaatagtgatgctgtattcttctgtatgcattaacacatcataaaaatttgtcctagtgcagttaatggttaatgattcacttgcttaaataggtctctgacagacttttttttactatatagctaattatttttctcttcattattaagtttcattatgcagctgatgtgaacaaacaatcatttaatctggcagctgttcttttttctttttttctacatatttttctttggaaaattaaggctcttatctttgtttacaggccagaaaaactggaaaaaacacaggctcttccacttactggatgtttgacaaaatattcttcttgggccaaaaacattgacattattggttagcttgctagaaattcaaaaaatcagactttattccagatcttctggaaaaaaaccctgcataacaaggtcttcagcttattgtacatattaaaacatgcctttttcatctgaaaaatattcacaactcattccatatgatgtaaatatagcactcaaaaatgtacatgtttgtgttcatgcccttaattttatagtttattttctagaaaaatatatgaactgatgttgtggatcttatgttcctttattttctcagagttagagaatactttagagaatatttctgtgttgaaaattattttataggataactttagtcagtcctataagtcagaaccagttatctttactctctcatttcaccttaagtcaaattaaaaattccgcccataaccacttggtgaaaatgtgtgtgtgtatatttttcaggggccattgcaatttagagatgtggccatagaattctctctggaggagtggcattgcctggacatggcacagcggaatttatatagggatgtgatgttagagaactacagaaacctggtctttcttggtgagaaaaactttaatacataactcataatatacacaaattgttttatttctcttttttgtagaatgttagtaatttattctttttataaaagagtttcagatccagtttttcaagaaaatcttcagaatttgttcatttagaaaagaattactttggtgcctcatgcctgtaatcccagcactttgggaggctgaggcagggggattacctgaggccaggagtttgagaccagctggccaaaatgctgaaaccccaactctaataaaagtacaaaaaattagctgcgggctgtggcatgcacctataatcccaggactcaggagggtgaggcaggagaatcacttgaactcaggaggtgaaggttgcagtgagttgagatcatgacattgcactgcagcctgggcaacagagcaagattctgtctcaaggaagaaaaaaaaaaaagaaagaaaaaaatttcttcaagatatttcatcttaatacaaactttccacatttctgaggtgagttatattcttcactctaaattagtggtaattccagaaatttactgacttaaaatattgtagcttccacctgaaaatctacttgccaccaccaagttttgattcagtagtaccaggtagtaaaattaggaaacctacaaattgaaagtattttcttttcttttcttttcttttcttttcttttcttttttttttttttttgagacagagtctcactctgttccccaggctggagtgcagtggtgcaatctgggcttactgcaacatccacctcccaagtttctcctgcctcagcctcccgagtatgtgggactacaggcacacatcactatgctccgctaatttttgtattttcagtagagatggggtttcaccatgctggccaggctggtctcaaactcctgaccttaggatctgcctgcctcggcctcccaaggtgctgagattacaggcatgagccactgcaccaggcaaattggaagtattttctaaatatttagaaatctctgttacaaatttgtattttgttattaatttactagaatattttatcacatcatctttcctgagcacattactagcttgtaattggagaatgtgagcaagattcatgttatttatttttgataaaacaggtattgttgtctcaaagccagacctcatcacccatctggagcaaggaaaaaaaccttcgactatgcagagacatgagatggtagccaacccctcaggtaggtgtgagtgaaaatgaatacaacagacaacacagtaagaagtccaaggtcaaaaagaaagccagtccttaaggtgtgattctggaagctgtgttccaaaggaacttctgggcagctgttttttttgttttttgtttttgtttttgttgttttaaattttgctgtcacaaaggggcatattgtcttatgcttctaaattctctaaaaattctacttttctctcagtgagcttccttcacattcacagtgagagccaaagtcctcttcatgacatataagagacagcacaatccagctgctttttcattgttttggggacacacaaatatcttcctaattttgagaaactgaaactattttttagttttctttttgtatccggtctgaaatttgtgagagtagtagtttctgttgcatttttttttgttcatttttgtgcacagtccattctatttttattactatatagtcttgaaatatagtttgaaattgtaagtacgatattctgttttcttctttttcctcaagattgctttggctattcaaagtttattttagtttcatgtaaattttagaattgtattttccattattgtaaaaaaaaacactgcaattttaataggaagattattgagtctgtaaatcactttggataatatgattctttaataatatttattcttttaattcattgacataaaatattttaaaattaatttttatcttctaatttttttattttgttattgtaaacttttttttacctccttggttaatttttttctcaggaatttatttaatgctatattaaataagattttttcttcctcatcagatagtttgttttaagtgtaagaaaccatacatatacttgtgtgtttaattttatattttgctaatttactgagtgtatttattagtttagacaggttttaatgtactgtttatggttttttaaatataaaattgtgtgatttacaaccagcaacttttttttttttttttttgagaggggctttcactctttttgcccaggctaaagtgcaatggtgtgattttgactcactgcaacctttgcctcctgggctcaagtggctctcctgcctcagcctcctgagtagctgggattacaggtgttcaccacaacacccagctacttttttgtatttttttggtagagacggtgtttcaccatgttggcaaggctggtctcaaactcctgacctcagatgatctgcccgcctctgcctcccaaaatgttgggattacagccatgagccaccatgcctggctggatttttttatttctgtgaataattcttctgccacatacttccatcactacattcaaatagaagcattgacaatggacacaatatagttttgtattggtgtctgaatttgatggagtaaacacctcttcaagttttcataaactgattttagaagcatttccttagggaactgtgtgggtttctttttttctttttcttttttttttttgagatggagttttgctcctgttgcccaagatggagtgcaatggtgcgatctcatctcaccacaacctccgcctcttgggttccagtgattctcctgcctcagcctcccaagtagctgcaaatacaggcatgcgccaccatgcctgggtaattttgtatttttagtagagaaggtgtttctccatgttggtcaggctggtcttgaactcctgacctcaggcgatccgcccgcctcagcctcccaaattgctggaattacaggtgtgaggcactgtaccctgcccaattgtgtgggtttctatgtaggcagaactgaccataaacttggctcaggtaactgaaactgagtcatagaaccgcttcagggatcccagtaaagtccaaagtctgcaggcctgcctacattgttgtaaatgggtgccttcctccaggtctcttgaatgtcaggacctctgccagactctgactgggaggagtttggattggttacagagtaagttcagaattctcagtgggaccaagttgggtgaaccctatctggtctgtagccatgagtaggggtcctgcagtttcccacctgactaagggcaggttctcttctgaatagaacacttctcaatcttaagctttagcagcatttcacaactccctccctggatctcaaatctctcttagtggcgtgtattttggagatggggtcttgctacataacccaggctggtctcaaaatcctggcctgaagcagttctccaacgttaatgtaccatgtatctgtcattacaggtgtgagccataatgcctatttctctcataaaggcatttttgtcagagatggctgacttttttttttgctgtaagggagtatgaaaatagggacttttaatcttttcatcttactgatgtcactctccctatacatttttactttctattttctctttcagatttgtctgtaaatttagattcagatatttaggacaatgtgctagaatttgcatggtatgcctgaagtaaattagataactcatagggacccatattactaaaatagttacttatgaatttaagtttgctgcaggcaaaaaggaattaaaggattttcatcttttttttagcctatatctaaataataacatagtttatttctcaatatttgttttacatatcagagggtctaaccctattctgcaaattgtataattttaaatttaacaatgtaaggctactctttgcttctaaagtttgattatagctgttttattttgtgtaaaaataccatatatttaaaacattaaaagtaactagtttccttaaaatgctaatttttaagtttctcattagaatcttctatttataattatactgcatattctctgaaattttactgccacacagggcatgccaatgattcaaaatacctgcatttagtgagtacacactaacagttaaatatttcagttacctagaaacatttttattttttttgagatggagtcacactctgtcacccagcctgcggtgcagtggtgtgatcgtggctcactgcaacttccaccttccaggttcaagcaattctcatgcctcagtctctcaagtagctggggttacaggcatgtgtcaccacccctggcaaatttttgtatttttagtagagacagggcttcaccaagttcgccaggctggtcttgaacttatgacctcaggtgagctgcttgccttggccttccaaagtgttgagataacagttgtgagccaccacacccggcctgacaattttttaataatgcatcaatgttgcatgctagattttttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgattttatgagtaaacatttattattgttttgaagttttatattagtgtgtttttcagtgtaggttttttttttttgggatggagtcttgctctgtcacccaggctggagtgcattggcgtgatcttggctcactgtaacctcttcctcgagggctcaagtgattcttctgccttgacctcctgagtagctgggactactggcgtgtgccaccatgcctggctaatttttgtatttttagaagagatggggtttcaccatattggccagtctggtctggaactggtgacctcgtgatttgcacacctcagcctcccaaagtactgggattacagttatgatccactgcacctggcctcagtgtaggtttcttaccattagtttattgggtgttttggttttacttatgtattataattttagacaatttgcaattctgcttgtatactttaagtcaattttaggtttaagagataaattatgcatgtctgtcacaatcaggttacatatgtatgtctgtttataaatatgacaccaattttagttatggcttatcttatactctttcttagcttattttccatggtagttttatcttgtctaagtaagtactcatggggatagtcttattttaccatgtgtttagtaattaatatgtatttcctttcatgagagaaacatttttgtgatttgaaggtaattttcaaaaaaatatgtaatttttttttcagtttttctttaaaaaaattgttttaaaaacacataatgtaaaatttaccatcttaaatctattgaagtgtacatttcagggccaggcgtggtggtggctctgatctgtaatcccaggattttgggaggccaagacaggaggatacctggagcccaaaagtttgagaccagcctgggcagcatatggagactctcctctataaaaaaaattaataatagccaggcatggtggtgtgcagctgtggtcccagctacttgggagattgagggggagtcaaaattgtgccactacactttagcttaggtgacacagtgagaccccgtctcaaaaaaagagctgttcatttcaggcatgttaattatattcacactgtcatgcaaaaggcttctagaaactttacatcttgtaaaactaaaactcaatgcccattaagtaacaactgctcattttacactctttccagcccttgacagacaaaccttctactttctgattttatgattttgactacttaagatatctcatataagtggaatcatacagtatccataattttgttactggattaattcaggtggcataatattttcaatgttcatcttaaaatgtgacaagattattctttttaaagtggaataatattccattgtatgtgtatgttatattttttgatgtgtttataaattaagagatatatgctggtttagccttttggcttttgtgaatactggtacaaaatacatgtattttcaattatgtcttccaggtcctgtgttgcatattttgtttttttgttgttgttttctttctttctttctttttctttctttcttttttttttttttgagatggaatcttgctctgttgcccaggctaaagtgcagtggtgcgatctcagctcactgcaagctctgccttctgggttcaagtgattcccctacctcagcctcccaagtagctgggattacaggtgcacgtcacatcgccaaggtaatttttgtgtttttagtagaaatggtatttcaccatgttggccaggctcgtctcaaactcctgacctcaggttatctgcccacctcaacctcccaaagtgctaggattacaggcttgagctactgcacctggcctgtgttacatattttagatatagatttataaatgaggaatatttataacattttaaaataatggctgtgtctttgttttccaccagcaatcaacatggattttatttttacacctaatgagtgtgaggcgattttgttggtattgtgttttttgttttcatttctctacaaattagtaattttgtgtgttttttcaaatgctttttcccatttgtttatttttatgtctaagtattttatttaaaatatattattgtatcattcaaggaaataatccaacttcattttatcagtgttgacattcagttttcaacatcattttttgaagagattatttctctctattttgtatgcatggcaactctgtggaagatcatttgatcatatacagaacggtttatttctgagctctctattctgttcttttatctgtttgtctttgtgtatcacattgtttaaattccatagcttttaactgtaggttgtattgacatctttgaaaaataaaatttgttgccccctgagcaagaatatgttgaagagtgtgtttcatattcacatatttgtgaatctgccagtttgacttttgcttttaattcctagtttcataaagtttttgttagaaaacacacagtgtataattttagtgtttttaaagtgattggttgttgttttgagacaagatcttactgtcacccaggctccaatgcagtggcataattgtggctcactgtagcctcagcctcctgggctcaagtgatcctttcacctcagttttttgagtagctaggactacagacatgcactaccatgtctggctaattgtttgctagtttatagtgttaggatctcactattttgcccaggctggtctcaaacttttggccccagtggatctcccaaagtgttagaattataggcaggagccatggcacccagtaggtatttttaaatttaataaagcttgggtatgtgtcctaacagaatacaccagatgcaaataagaatattgtgtattatcttggttttgatgggagagtattttatgtatctatgaagcctatttggtctataatatggtttggatgtccttgttgtccaaacctcatgctgcaatataaatcctcaatgttgggtgtgggacctggtgggacatatttgggtcatgagggtgaatttctcatgaatggcttggtacatactcttggcaaccaaaaagattagactctatcaattcaaataagagctggttcattaaaagaacatggcttcttcacctcacacttactctgtctcttaccatataatatatccagttattccttaccttccaccatgattttaagcttcctgaaatcctcattagaagcacatgctgacacacacttcttgtacagtctgctgagctgtgagccaaataaaccttttttctttataaattatgcactctcaagtattgctctatatgcaaaataattaatatggtctataatattgtcacagttttctctttcttagtttttatctgaattttctatttattaattgcaaatgggttcttgctgtctacaattattatgttgctatgtatgccttgcttcacttttgtcaatatttgctttatatattttggagccctgatgttatatacacatatacatatagatagataaatattatagttatagattcctgctaaatcaattcactttaccataatataatatcagtcattgtcccatggtcgtacttgacttaaagcatattctgtctaatataattatgaccaccttactcaattgtggttactattttcatggtacataactttttttcattctgttactttcaccctatttgactcaatgctaaaatgagtctcttgtagggagcatagtgtatgctttttaaaaaaccactcaggcattctatatctttttttaatattttcattatgcatatattcatttattattcattttattttattttattttttgagatggagtttcactgttgttacccaggctggagtgcaatggtgcaatctcagctcactgcaatcttcacctcctgggttcaagtgattctcctgcctcagccttccaagtagctgggattacaggcacatgccaccacacctggctaattttttgcatttttagtagagatggggttttcccatgatggccaggctcatcttgaactcctgacctcaggtaacctgcccaccttggcctcccaaactattgggattacaggtgtgagccactgcatccggcctcatgtatttttgagatagggtctcactctgtcaaccaggctgatttgcatggctcacggctgcttgaacctcccaaactcagatgatcctctcatttcagcctctcaagtagctgggttacatgaatgtgccctcacacccagctagctttttttgtatttttcatagagacagagttttgccatgttgcccaggctgatcttgaacttttgggatcaagtaatcggcccaccttggccatccaaagtcctaagattacatttcaaagattacatttcatttcattaagtagtttaatgagagtcctgtatttttgtatctactgaatgatgtggtgacagaaatttgcattgcttttactattagtaaaattagtaacaatgcagtaattatgcaaaagctaatatatgtgctgccttctgttttattggtttactttttcacctttatactcataacaaattattttaattctgtagctttttgatgtgttttgaaatcagaaatggtaatgcctccaacattgttccattttggtagattgttgggtactttattgtctctttagattccatatacttttggatttgctgtttttatttcttcaaaaatgcaatgagacatttgaaaaacattgaattaaatctgtagattaaattgagcagtacagacatcttcacaatattaattatttctttttcagtttgtttttgaggtggagttaaaatcactcacctcgacctcccaaagtgctgggattacaggtgtgagtcactgcacacagcccagttttctgaacaagtgcatgctcaagagtgtgttttctcatttccatatatttgtaaatttatcaattatttatattattgttttatactctaattccatttttgtcatagaaagtaatctataaaatttcagttttaaaaaatgtgttaaggcttcatttttggcctaacttgtggtctatataggagaatgctgtatgagctattgagaaggctgtgtatcctgatgttgttgaggagtgttctctataccttcattagaaataattgttttttactgccttctagtcctctgttcccttattaatattctgtcttgttttattattacagaaaatgaagtattgaaatatcctactataattatattgctctctgtgtgtattcaattttgtatttgctttatatatttgaaactctaatctgagacacacacatgcaaatacatacatgtataaacaaatttgtcatagattcccagtgaaagaatacatatattgtttaaagcccttctttgccttcttgaagttttgacttaaagtacattttataaaatatgacattttcttacttaagatgcagcttgtgtaatattattttgagctcttttgctctaatttggttaatatttacatgaaatttctacttccatcttgccactttcagtctttttttatcattagatctcaactgactcttgtaaaaaggcaagttgaatcttgatttttaaaattttttaataaacctttttatttaaagtatgtctcttgatttggagagataattatatatatttaaatagttttctgcaaaagaaaaacttattttattgttttattttattcttgtgtctttgtctctcattttctctttctgtcttttttttttatctttgtattgacatgctttcagtttcttattttcttttgtgtatctgtacagacattttctaagtggtaccttctgggattacataaaacctctaaaagatccaacaatatatttaaatgtggtaaaaaatcaacttcagtttcatacaaaaatttttcatcattacatctgccttctattttgttattgagtttgccaattatattttttatgtttgtatattcattaacatgtttataataatttctatagtttttatcttttaaattttagagaacaattaaaaatgttttctgcaccattatgataatgttaagaaattccatttttgtgtatgtgcatatctttcccagaaagttacatattttcatatgattatgggttgttttctttcaccatgttattttcagtggaggaaactcaccatctttgatatgtcaggcatatgcagtggcaatatacattctcaggatttggttattttggaagtgcttctttctatttggtagtaaaattgtggtgatgctattattctcacttgaaagctttttttaaattattattttaactttaacaatatcacagtttccttctcacttgcaaaaatttttttgataaattcacttgttatatcatgagactatgcttataaatgacacatcatttttatcttacagctcccaaaattctcttatctgtgatttttgaaattttgcttattatgtgtgtttgttataaatatcttggtgtgtacatttttaaagaaattttccaattatgttttgtatttttatatccacgatttttgttttttgctatttaaatgtttctggttgttattctcatttttctgatcttcagtagttgcctgtgttcctatttaacttactgaatattattcaatttattttattttatttatttattttattattattttctgagacagagtctgtctctgtcacctcaactggagtgcagtggtgcaggctcactgcaacctccatctcccaggttcaagcaattctcttgcctcagcctcctcagtaactgggattataggtgctcacaaccacacttggctatttttttatatttttagtagagataaggtttcaccatgttggccaggctaatcttgaacctctgacctcaaatgatccatccaccttggcctctcaaagtgctgggattacaggtgtgagccatcctgcccaccctattttattatatttttgagacaggcttcctctgttgtccaggctgtagtgcagaggtacaatcttcactcactgatggggccatgttgctctaatattttgtattcattgtaatctttgattgagctttggacattaacaaaaagctacctgttag

SEQ ID NO: 594 - DNA, 182263 bp, Homo sapiens
aaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtgg

SEQ ID NO: 595 - DNA, 197699 bp, Homo sapiens
ggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaaggatcttgatgtttctctttgtatatatgtgatgagtttgaaatatttgtatttccttgcagattttattcaaagcaaaaaaactttttaaaatgaatctctagcactttctttatgataaaagtaagcatgaccaaaaaatcacatctgatttgtcagattatgtagcattataaataatcaagggctttgaaataccagttgttgctacccattatacaggtatcattagctatgaaaagataattttatctgaatctacaacaaaagtgtaataagcatttacttacgattgttaaagaactttcatttgtctgtatccaggttttactcatggaacacctatctccaaaaacactcagactatgtctatacaagtaaagcagcacagtaatatcagatacacagccaggcaaaatgaaactcaggctatccaggagaaaaaaagtaaattcaataatttccacctgagtcatgtacaattcagtttaacttactttaatgcattggtaaaagtataacataaaacatttcctgaaagaacaaattatacattagctgtcaggacttgctaactcaactgtttgcttcagaagtttttcataattagcaaaagtaatcacaaactttatctttcatagtggtgagccatttattactaaagacaatagagctaatcgtgcaaattaggaaaatcaattaggctattcagtaagtggagtccagtttttctattttttgttctattgcaaaggatgattattcattattacatgggggataaggaacctccttgggcacaaatttgaactctgcattattggagttcagacatacagagatatattcgcaggcagtgaagaaaggagttgagagcagcaattctgaactggagccagggcagacaagagtgcccttgagaaaaaactcagcataaaagaaaaagaaatctaggactctagaattgcaaaccagattcatcaagggaacaacatactatgggaccacttaactaatgacacatgtcattccgtaatcaaccagctctgagatgcagcagtcaagtaccatagtctcacctgcatggcaaagtgccagctcctccagtactgagaaggagaaatcaagtttcaaccttcctagtaccaagacattatagaggctgcagcttggaattgtttgcaggtgaagtggcacctcagtgaaactttcagggacaatagccgagttctggcttgattatgggagccctgtcttgttagccatggtaacaagcaacaataggcctattctgaaacacagaatatacctttttgaggattcctagttataagagaaagggaatcaacaagggccttaaaagcaaggcacaaaacatctagattccatttttactcatagattggtaagaactaaagcattcacactttgtagcttttctgaagtttttacaatggttgggtaatattgttatgagccaaataaaacaataaaagatgtctttaaaagaacaattataatgttctggtataagcttgaattttactcacctcgccaacatctatagagcatattccatatgccaggtcagtgctaaacagaggatatatcaagatagaaatgatctagtctctactcgcagtcatggggaagacaaattttagtgcaccaatggattctaaatgtactggtatcacttaggaagaaatgaccggttccctttacaagagcaaagccaggaaagtataaggttgagccagaaaaaaataaactgttgtttgagctgggtattgtgtatgtaaaagttcctcagaatgggagggcagggtgtaatgtgatgtgttggaagacctagcttagagtggctgcaacagaatatgtgaaagaaataccagattacatatagacaaaggatagataggtcaaggtcattgtatgacatgaaactaagtttgggttttgccctttagggagtagggaagccattaaaaactttaaataggagctaaacattattcgggagctcctacacattattattttaggcgctaaacatgatcagatttgcattctagaaagaactatctgtagactatccaggagattaatttgatggtgaggggcaaagggtgaagacaagttagaaaacaacaaaaatatttaaggagacaactgcaatatcccagggcagagacaataaattcccaaatgaaggtcattacagagaagaagataaaagaagagagctaatgaaatatgataggaagatagaagttctcatcattcatgaacaatagaagatgaggaacaagggggaggaaggcatttagggcagagcttctaggattcttttagcttggataacttaagaatgataccattaaacaggatagaaaaattccacagaaggagcagatattttaaccaaaacaaaaacagtgtgtgctctgtacattgtattgctgtttacaatcatctcagttgttaaggaatgcagtgtgtttttttagtttcagggtacacaaatataattatgaaagacatatagtttgggaagcggaaaggaaaaggtatttttcctgctcctttgaaagggtaatttttaaataaaacttttgatatggtcaacacacttatatctggataattatagatatgaacgtagatatgagggtcactatgctataacacgcacagggtcctcctggagtagaaggaacagcgcctagaaaacagctggctgtgagcccagtgccttccttctccaagcagagctctccttcctgaacaaaatgagtccacctggggtttattttctttaaagatttgctcaatagagattttattatctttggtttaaaataaaagttaaaatgatatatttactattttaatgagttacatttaatgttttatggcaacaaaaaagaaatatctgattctgatgtgatttttcagatcatagactacatgtctaaagaagcctataagaaattatggcctatgaagtgtggaatctgagactgctggcaagatggccgactaggaacagctctggtgcacagctcccagcaagatccacgcaggaggtaggtgatttctgcatttccaactgaggtacccggttcatcccattgggaccggttagacagtgggtgaagcccaaggagggcgagccaaagcagggtgggacatcacctcaccagggaagcactaaggtcagggaactccgtctcctagccaagggaagccattagggattgtactgtgcacaccagcccagatactacgcttttcccacgttcttcacaaccctcagaccaggagattccctccggtgcctatgccaccagggccctgagtttccagcacaaaactgggcagccgtttgggcagacaccaagcgagccacaggagatttgtttcataccccagtggcacctggaacacccatgacacagaaccgttcacccctgtggaaaggaggctgaagccagggagcccaagtggtctggcttggtgggtcccaccccacagatcccagcaagctaagatccactggcttgaaattctcgctgccagcagagcagtctgaactcgagggaggctcaagcttggtggcgggagtactttcagtactggcttatcttcatgtatttctataagaactctgttttctctcctattaaaactgctattacacatcttccttccactaaaatcaacaatagtgtctccacttatacccagttggtagattttccttaggaaatagatgcaattggaagagaatgagttcatcttctcaccaacaaaatctcttgattgatgtacatgcgtctggtacccatatcttctgcatattacaacagaaaaattatccctctcccagtctatgtctaactcaaagagttttggtcttaaattgcactcatttctcttgtgtcatcaatttacccctttctgctggattattcccattaatactcaagcattagattaaataaataaataaataaaaatttggaccaacgtccccctgtagtttctacccatttctctgctaacctttaaaacaaaattactatagatacttgccactttgatattaatttacctattcagctttcttttggttagtatttgcatgacatatgttttctcatcctattatttacaacctttctattttcctatgtttttagatgtcttttgagaaccgtatatagtttagttttttaaaaaaaaattcagtcaggcaatctttgcttttaattgcaacctataggcctacatatttaatgtcataattgatatatttggacttcattataccaccttactatttgcttcccatttcctcattagttctatgttttttttctttctctcttatatgacctcatttcagattgattgagattatttattatttcagttttcccttctcaagcaagcatactttatcttactatttttagaagttactctagagattataatatcatcattgacatagcagtctaatattaattggcacttttacctcttcttgttcaatgtcaggaacgtctaccctttaacttcagttaacccccttttgacatatatgctattgttgtcatgtgttttaattctatatatatttaaactcaatagaaattataattatggttttatatttattgagatttatacacagttaccctttcggttaaaaaaaaaatctttagtgttccttttagtgtgtaatgcatgcctgctggaaaaaaaaatttttttcacaagtttttgttcttaaaatatctttattttatcttcattattaaagaatacattttagatgcttagaaatctaggagggcagttattttctttcagaactttgtagaaagtttcattgtttctgatgaaagacaaaaaatctcattctaaccattgcttcaagagatccctatggctactttataattttttttttttttgcgttagttttcagtacttttgctatagtgaggttaactttggttttcctattagttatcttagttagggcttgtaggcattcttgaacctggagtttaatacgattatcagatttggaaaattctcagccattatcttttcaaatattgctgatgtcccatttttctctctcctttttcaggatttcaattacccatgctagatgttctcattatatctcctattttataactctgtctttttattttcttttttttctatacttcctcctgggtaatcctacctatttcttaattctctcttcaattgtgtctaattggttattaaatctatccactgaatttttagttttagttctgaggtaaactcagttttataattttaatttgttttcatagcttccaattttctgtcaaatttcctactcttgtccttaatctccttcagcagaataagaatcttaaaggtaaatctattatcatctgaagttcatatgagtctgtttctattgtcaggtttttttctccttatttttcattaattcattttatgtcctaacatgaactggttatttttactgagtgctggaccttatagttttttaaaatcatacaaataatttgaagctatgatgacattatgttactccagagagaatttgtgttttcttcagacagccagttaggggctctaacaatgtgggaatctcttaatccaattttaagaattgagtttacttaaaattgggtttaagcccctgccaaacttgaactacttctggttcacatttattcctaagagtaagttccctgagattccgacccagagcttgatggagagtggctccaagggctctcctccttggcatactctggattacagattttgttccattagtctcttgaggctactaaaagtactgttcaagacttgtaacctctctgttacctcttctagaatcccctaatggaaaagtaaacctcagtgctgggtttacctctcttgggttctttcttcctccaagacttattacccatcaccattttgttagctactcaacaccttcaggcacagagtttttataattggtcttgcttttctagttgatcccaggtttggtacatataacccaggaatgaccagcagcagaaatcactagagagagttgattacatttgttatctctatgtccccctcttccattttctctcttctattctgtacaattttatctctcactgttgcactacacctctcttgtcaagatgaccaagtgataaaatctcagtcctcactttacttgctcacccagtaatatttgacaagtttattcctctctttcttgaaacattttattttcttggcttctgggaaaacctactccctgagtgacttttctgtgtcatttgctggctcctcttccctttcctatcatctcaatgttagcaagattgactctttgatgtccttttcttctctttttataaccacaatagaagtaatcatctcctttaatctcatggccttaaatattaggttggtgtaaaagtaattgcttttttccccattactttcaatggcaaaaatctcaattacttttgcaccaacctaacaaaaaacatcaaaagtatgttgatgagtcccaaatttatatccctaggctttcacctgagctgcagcctattacatctgcctttttgacaacttctcttgaatatctaagaagcatctcaaacataagattctaaaggcaaaatcttaatttctttcccattctcgcccagttgctcaagacagacactcaggagttatctttggtacttccttttacttcatacccatatcccatttaccagcaaattctacgggcttgaccaccaaaatatgttttgcatccaactgcaacctcactaaactcatcgaggtccaagtcacagcaatctctctcctaggattcttgcaacaaacttccaaaatggtcttcctgttcccactcttgccctcatcccctgctaccactagcagaatattttccacccagcaaccagtgtaattcttcaaaaatgtaaatgctatccggtcactcctatgcacaaaactctccaatgttttcacataaattttaaaataaaacccaggctctttaccatggtctacaaatccccaaaacatctggaccctgctcgctttctgaactcatctcctgccactctttacctcactcaagccactcacattccactggtattcttgcgtgtcttcaaaaataagctcattcctaccttaggcccttcgtattctctatatcctctgtctagaatgttctacctatgcctcagtttttacatgattagttttttttcatcattcacatctatgttgagatgtcacctcttcagagtgcctttctctgactactctacgtaaaatagctcctttcctgtatccttttcctgggctttatagttttcattactctgcatattatgtcttttataggtgtacttgtgtttcctggttgtctggttctcctactcaaaagaacagagattttatcttatttgtgacagtattctcatgacttagagcctggcacatcgtagaagctcaataaataattgttagatgaatgaatgaatgaggaacatggttgtgttatcaataaatggttgagatagtagtatttagaaaacaaaaatgacttagataagtgattctcaaagtacgctccacagaccaggagtaccaccatcatctaggagcttactagaaatgcaaatcctgggaccccccagcccagacctactaagttagaaactggagataagcagagtgatctattttttatcaagaccttccaaagattctggatgcatggtaagtttgagaaccactggtttcagggataggccaaacctagcctactacctattttataataaaattttattggaacacagccacttgcattcatttacgtgttatctatggctgcttttgcactacaacagcagtactgagtacttgcaacacagacattatagcccacaaagcctataatatttactatccagcccgttataaaacaattttgattacctctagtttagatcaacgccttatgctatgtaattacggcaaagtaaacacatacgattcatcttctttttcaccgaaatcccactgaaattaaagaaaagctatggctaaagaaggcaccatagcatactgaaaaacagaaaagggtagcatcagtggaccagattatttgaggaatttccaggacataaaaaacatctcggagagaggagacaacagtgagatcagattaaaagaaacaagtatagagactgcaccacaagattcaaatagaggctattgcaaaaagcagcaatagtttctaagaaaaccgcagatgagtattattttccaagtaagcaagctaaatcaaccaccgagaaaacattgggtgaatcattaaaggactaccatcagaagatctggccagtgacccttctacccaaagacttgcacagctggctacagatctcatttataaacaaagctaaaaggctttgggaaaggctcatggcttcagtattggagtctgagaagcagagtacagcaagactgccacagtgacagcagaggcacaggaagaaaagggaagtctgactagagcatttgccaccaagaaaaagtgtcatgtacaggtctctaaagtaagagtactgaaataggagactcccagaatagcttcaggaaaaagtacaaggtaaggacaggaagcccatgtttacccagtaaacaaactacttccccatagttatggattaaattatgcccccccaaaaagatatgttaaagtcctaatccctggtacctcagaatgtgaccttatttggaaataggttattgcagatgtaattagtcaaaatgaggttacaatggagtatggtggtctctcaatccaatatgacttgtgcccttgtaagaagagagagatggccgggcacagtggctcacgcctgtaatcccagcactttgggattccgaggcgggcagatcacttgaggtcaggagtttgggaccagcctgaccaatatggtgaaaccccgtccctactaaaaacacaaaaattagctaggtgtggtggcaggcacctatagtcccagctactcaggaggctgagacaggagaattgcttgaacccgggaggtggaggttgcagtgagccgagatcgtgccactgcactccatcctgggtgacagagcaagactccatctcaaaaaaaaaagaagaagaagaagagagagacacagagaggagaatgccatatgaagacatgaagacacacagacacagagagaagacaatcatgtgaaaggagagacagagggccaggcatgatgattcacatcagtaatctcaacaatttgggaggcctaggtaagagaattgcttgaggccaggagctcaagaccagactgagcaacatagcaaatccctgtatctacaaaaaaaataaaaaattagccaggcataatggcatgtacttgtagtcctagctacttgggaagctgaggcaggaggatcacttgagcccaggagtttgaggctgcagtgagctatagtgcactgcagcctgggtgacagagcaacaccctgtctcttaataataataataaaaagacagaggcagagaagctcgaagaagaaaataatctcctagaggctttggaggttgcatggcctgacagtacttagattttggacttttagcctccagtactgtgaaaaaataaatttctattaagccacttagtttgtggtttgttagggcaaccctaggaaactaatacagtagacctccgggccacacattctactgctccctctttatcaccaaaagtggaacccgaattaacagacaatcaaattatcaccaaatacttggggaaaattaacatcattagaaaggatcatctgattcaaataactgaataactaaaacttgaagaaaattaatggcagcaacagaataagactttttaagtataatttatttggaggtattcgagaatatattactttaattagcaaaaatatgacagctatgaaaaaaacagaaacaattgggattcttggaattaagactattattactattttttttttcttagggatgagatctcactatgttgctcaggctagactctaactcctgggctctagtgatcctcctgcctctggctcccaagcagctgggactacagaccagcatcaccacacccagtttagttacaaaatattttttaaactataaaaaactattctgcatagtaaaacactgtttattaagttaaaaaaagaaaaacactcatggaaaacaacaaaataccttttggcatacaaaaagacatgcatatttaagaacatatatgaaatatcttaaatagaaacaatggtggggagaatgggaacacgcgtcaaggatgaaagttttaaaaataaacaaataagctgggcatggtggctcacgcctgtagtcccagcactttgagaggccaaggcaggcagatcacccaaagtaggaagttcgagaccagcctgaccaacatggagaaaccccatctctactaaaaatacaaaattagctgggcatggtggtgcatgcctgtaatcccagctactcaggaggctgaggcaggagaatcgcttgaactcgggaggcagaggttgcggtgagccaagatcgtgccattgcactccagcctgggcaaaaagagtgaaactccatctcaaaaataaataaataagtaaaataaacaaatgagcaatcctaagccaaaagaacaaagctagaggcatcacactgtcatgagatccttggggtgttgctttgccagccggaaaacctctgtggctggtggcacatttccccaggtttttactcaggcccactgggctcattccacccacctggcctggcaggctgtgcttggctcacaccactggcccaaatctcatgcctaccaaggacgagccaggcacagagtagcaaggggtatgtgagtgagagtggggttcagccactgggcacagccaggcacaccggctgtggtaaggttggcagctccaggtgccagcatgggtgccagctccctatgaggctgcatctggaccaggcatacctgaagcagcttccacagctggcaccagggaatgcggtagcacccagaagcttggagatgccaggaatctgcagagcctcagagagggtggcacagccctggtttggggagctcctaggtctgggatccccaaagggccacagctgtctctccttctctcttctttctttcttgttgcctgcaacgtggtgagcaaggggcatatttcatccctgtttttgttacagctcttttagccctcccatttggcaagtcctgagttcttgtcttgcatccaggaagaatgatgtacgcaaacaagtggaggtgagcaaggtgaagaggagctttattgagtgacagaggagaccctggagtgggtagctcttctccacaggcagtcatctgatcatctccttgatctggctgagcccaggggttttatgggcttcagaggggaggaaggggtggtggttggttcatgggtggccatggggagcccagagaaagcaccataagttcccatcctggctcttcagccaggcctctggattcaggccatccatggctcaaaggtggggcttcactagggacctgcctctttctgccctgcctcctgctgtcatccatagcactcaggctgtttgtgccaagaggcaactgcaggccagtgccgagctgccttcagcaacccccctcaccctctcccgtgcttgttgatacccaaagtctgaagggcgccaaggcagcaggggtctggtgtgtcagcactgctccaagcatgtgcacccacccagattgtgacagcacccaggctcagcctcaattttgcttcaagatcagagcaggcaccaggagtggggagaagccaggctgtgggagcagacacctccaagcctgagggggcagaggggcttcctgggcccccaagaacacaggtatgcccaggtccacagctgtggcttgggtggctgcagctgtacctgggaagcttgaggcttctgcactgccaattcggaagggcatgaggcttctgcctgttcccagctctcaccagctccatgaagctcaaagccaaggcagcgcctccccacctgcagctggtgtcttcgcagccaccactccaggcaggcggctgctgccatcaacattacccgacttaaaattatattacaaggctttctatcagggtaaactgtcagtcaaaaaaagaacaaaaaagaaatagaaaaaaattatgctacaaaaatatagtaatcaaaatatcatggtactggcataaaaatggacacatagataaacagaacaaaatagagaactcagaagtaaagccatgtacctccagccaactcatctttaaccaagttgacaaatgtagaagaatgaaactggtcccctatctctcaccatatacaaaaattaacccaagatagattaaagacttaaatttaagacccaaaactaaaaaaatcctagaagaacacctaggaaaaactcttctggacattggcctagacaaagaattcatgactaaggcctcaaaagattcagaggggtaggaggggagtaaaggatgagaaattactcagtaggtacaatgtacgttatttgggtagtggttacactaaaagcccaaactttacctttatgtaatataaccatttaagaaaacgaacttgtattccctaaatttatacaaattaaaaatgaatgaatgaatgaaacaagacacatgggcaaattataaaactgtgctatgaattaagatggtgtgattaactatttacacccaggatccaaaaaggagaaaactttacatattaatagggaaactaatttccaaaatagatatagctgaagattaatttacagaactaaacgtctaaactgagggattctcccagaacacagttcaaaagaaaaaattcataaaatggaaaactttaaagaagagttaaggggcatgaaaagagacccaaatgatctcaaatacccattgtgtaagtttcagaaggatgcaatagaagcaataaaataagaaaacaaataaataatggagggaaatttcttggagctagagaaagacactagacttcagagcaaaacctctgtaagatgaaggggctgaggagggaggggaggaatgcacgcctttgcaagcttgatggaacttcaggccaccaaggataaagagaaaaatcccaaaaacttccataaggaagaaacagacttttttctttggaaagaagaatctgattccaaataattgaggagacaaagtaggtgattatgcacattgctaagatttggctctagaaaaagctgggcagtagatggtattgctagaagggatgtcatcaatagtgagctaagtgtactaaaattatcatttttctcacaaagcttcatgttctgaagggaaagaggcaattataattctggtcccagctataaatgggctggtgccaatgtatcatcacccaactgcttctctaaaatccagctagcatccgtctctcataagaagcagcatttatacgaagacattctaatgtctacacatctataatccaatatctgtaatataatctataatctaatatctgtaatccaatataatatctgtaaatgctaactagcatcatttcaaattataaacccctatgaagtctccctgataactgacaatgaagccagcatacggagacttttccagagtcatgagcttgtgggtggcagaacaagggctgggaggcaggcctcctgactttgtagccagtactggtgccaccatgtcatgctgacagctcagcaccaatccttctatactctcgtgttttctcctgtttgtgataaagtatgtacatctgtgtcattggaaggcttggagaagagtccaaaggtgcaaaacaaagcaaatctccccacgcctggcagaatcttcagtcctggcctaatgagctcaccagctcagtaagttctgcgactgcttcgggttaccaaaagaatagagtatgtaacagtgctaggaaaagagacacttaaaaacccacatccaggcattgttcaatgactgctcataaatactttatggcaaaattctttctggtggcacagaaggccatgaacaatctgacacctccattagtcacctctgttagtcaccactacgacttcctgacccatctctgggtttcacttcagtttttagatacccagccctaacaattaagcaaaacttcattgatagttcctcttcaaaagtatttccagaataactattaaaatcccatggactagtcaagatagtgagatatgcttttgagtgaacagccaccatttcttccttttagagatttattttttaacttaacaaaaagcaaatctaatgtgaaacttaatgaaaattgtttcaaaaacttgaaatgcaactacaaaatagcccattattgcctaagctttctatacttaactagttttctaaatctatattacataggctagagaaataacatattgtttttatatgtacaatccaaatctagtctctccgaattttctttaaggccaactattttaatataggccagtattttactctattattcaatcgcaaaccacgtttctttcctcacagtagtgcattttgacaaaatcaatcttttcattcttttcagcaaataatacagaaattgggattcattcatgagaagtcagtgaaaataaaaatgatttcagattttctttacatttgtataatatcactagtagaggaggaatggctttccagaccacttgttaggaaaaaaatatgagtgggaaattacactaagcctatataaacaattccaaagtagaattctcttttctccttggtaaataaatgcttgattttcataattcaacatataattttaaactagggcaaccaaacttgtgacatgaaaagaggaattttattgttaagttacactggtatactgcaaagtcataccaaaaaaaaaggagcaaaatatattttttaataatcttacacaagaatgctcaagaatcttctacatgaggtaactacagaaaaaaagaacactaggtcagctgaaggctgaactaaatttgttccataaaagttggtgagtttcatttttcgcttctaaggggataaaggaaaaagaatgtgcattgtgtttaagaaaacccagaatactgccaaaagtttgccacccactttggcattctgcctttatcctgaaagataatttcttctccattataaacagcctatgtgagatgaactgtcaacaagagggaagctagagtgagaaacagagaaaaagaacagcatcatgcaaggaaagttatgaaacaaattgactcttgattctctcttggcttgcctttcttaatgcaaatagaattaaaaagtcaaatagccctaatgttagccaggtgaagtgtggttagaaatggttgactggaaattcccttgctttcatcaaacaattgttatgtgaatattgcatcagcttggtccttttgatgttcctacatgacttaagaaaactttgtatttccagtagtgtatttccaatgacaaaaactctgctgtgtgattttagaaaatcactaaaattaccagtgcttttgctagatctttcacagttgcaaaaacaaatgtttttgaacaaggctctatttttcatgaaaatattcaactgaatgcagggaaagtaaatgcaaaatatctagggaaggcaccaatcaaatcatgcaagaagagatttttctagacttcaaagaaaaagtattcagtgactccaaggtgtggggcaagggaggcaggggagtgatgaatttgttttctttgcattgttccacttccttgtttgctgtgttgcacaaactctattgaatatcaagatttggcctcttatgaataagatacttaatagagaagaatgtcagttttttcaagcccataaataccttttaaatgttcttagaattttacaattggatgaaaaagcatcaaaaaacatagtttgtataattttatcattaaaaatattttccattattattcaaggagttcattgatgctgaatacaaaatgcctaagatttattatttaagtttatgagctaaaggaaatcttagtgtttatctagcctaacttccttgttctacatttctgttttgttttttcaaatgatgtatcttgtttgcttcacgattatgttaaagaaaaagttttttttcagaaataagaaatagattataaatttttaaaaaggaaagaaaattgaggaaaaagggaattaaaggatattggataatatagagaaagatatttatagggcataaaatcatttctagtggaaggaggacacatgggtttgtcattgccagagcaccttttgtttttctgagcattttgtgagatggccaattttacccagcatagaatcgagtaagaatgaaactgaaataatttgcaaagttgaaagttgagtgtgaccataagcctccaatcctagttccagcctgcccaccatgctgggaatatagtttggatatttgtccctgcccaaatctcatgctgaaatataatctccaatgttggaagtaggaccttgtgggaggtgtttggaacatgggagcagatctctagaagctgagcaaatgccagcaccatgcttcctgtaaaacctgaagaaccatgagccacttaatcctctttttttataaattactcagtctcatgtgttactttacagcaaggcaaaaatggcttaataccttgggcatgctccagtagagattagaattcacatgaaacaacaaatgagaaacagggagaaaactattaagaggtctatggtagggaagattgtggctattgtctccatttacttttagaatttcttcgtgtgtgtgtgtgtgtgtgtgtgtgagagagagagagagagagagagagagagacaactagtagaaacagagtaaccaaatctcttaactggaaatgactttatatgttgtattactaaaagacgtccaatttccaacatcctgaatatatacagtgacagaggacagataactcactattttatggggtagtttattcatttttgtaaataccagccattgttcttaatattgttatcaagggtctcaacccgaaaataaattcatctcccctacccatctttcgcaacaacaaagcaaaaaattccccttccagactttgtcacatctgttaatgacatagccattttatcgaactcaaaaactttgtgttcccttgcatttaaaaatccagttatcaagtgttgctaattccaatttggactccgtagcatccattcctacccagtttcgtttacagcataccatcacttctgctgtacatttattcatcacacagacaaactctgatataatatggaggaagattatgcaagggcatgaatactaggaggaaccattgaggaatatcatggaggctggccaccacacaaggtaacagaatagatgaccactgataagatcactgggaagaggacatctttctccataggtctagaaggaaaagttctagagataactctgtcttagtttagatcatgtgcccatctctgaaccaataattatgaccagagaaatggactcccttagttaaccagacttgggtcatgtgctctacctatggctttttttttttttttttttgagatggagtctcgctctgtcccccagtcttgagtgcagtggcgtggtctcggctcactgcaagctctgcctcccatgttaacaccattctcctgcctcagactcccaagtagctgggactactggtgcctgccaccacaccggctaatttttttgtatttttagtagagacagggtttcaccatgttagccaggatggtctcgatctcctgacttgtgatctgcccgccttggcttcccaaagtgctgggattacagacgtgagccaccgcacccggcctacctatggcttttgagggcaaatggtgtcatctccacctgaatcactgaatcagaaaagaggggatgctgaacggaaatactacatatatcctctattctacctcacatttcaactgctttcttggtcttctaaacatcctcatattactgtctctatcttccttttcaaacagtacatagctgacaaattaacttcagtaaaactcaacttggatcatatgttttcttttctcaaaatcttccctaaatgggtcctcacacttaaaaggtaagtccttagtgcttacctggcattcacacttttctataatctcaacccagattcttctggtctaatctacaattttatacctccctaaaaaagtcaatttactcactttcttcctaaaatgactttgactccatggccttgttcacattgttcacattcttcattcaccaagaatacttttctctcttctttcctgttcaaagtctacccattcttcaagtgcaagtcagagtttacttccatatagatttttatagtcatcccagcctgaaggaactcctttctctccctttcgctctcatggtatttttgttgtatcattcttaaataatgataaatgttttattctattatgaattcatatttcaataagtaacacatattatctagctatccatattgcaaacttcttaaaggcaaggacaatggcttatatttcttttcattctgtgagagacgtagcttgcatttaataaacatttattatatatctggataattataaatatgaatatagatattagtgtcactatactatggcactcagttttaaaaagaaaccttcaacacactagcttcaaccaaagtccacaccagacaagagctgttcagtaattagaaagacactacaattctaaaacgatgtgcacttactactacatagctgcagaaaatgagttgctacttttcaaaatgaacgggattgctgaagcaataatctagattattttagccaacagtaatatatatatatatatatatatatatatatatatatatatatatatatatatactcctacttcaagctagctatctacaatggttagatatatcacgtactgctattttgctcttaaaagagtttgtttgaactgaagcatagtcagcacaaattacttctgggaaaccatttctgagagaatttggctctttacatctttggccagaattccttgagttttggcttccagtctgtattttgctttcctggtagaaatgtgtactcctagtatcttgctggcaaggatgcctctgccaaaaggaaatacacactactttattcatgaaaggacgggaacactctcaggtagactattggcatgtagtctaagtgaaatgagcccacccatcattacaaccttaccaaatatgtaagacacttccaagtattgtggataaacactcctaggtgttgtgcatatacaaaatcatccagaagttaccctagaaaggatggcaatacaaagtagtatgcatgttccaagagaataataataagtgtcataaataattacagaaggtagagtttttttgagtttggaaagctcaggaaaggtttcaaaaggaaacggatctaaccgatggatcatttagtaaagatggacgatttagtagagtcccacaagagtcaggactaaaaatgacatattctaggccaataggatagaaaaagagggctaacatagaggcataataagtaaaataaggtaggcaatttggaaatacactagagaaaagctttaagattctgtattttatactatagacaatggagatttttgagttttcaagcaccagcaaaatagtgttttaataccaaattgagatataattgtcagttttttaaaaaaaaagttttctaaaaataaaataaaatcactaaaataattttgaagaaaaagataaattgaaaaagatcttttggattgttttcaaaaagatagaaaacatgcttttggaatagaaataacgcatagcttggaatggaattaatgaagctcaaagtcagatcatgagtaggaagcatagaattcaagcactttagaggctggaccatgaaaggtaacattataactaaaataattcagcacttttattcacatttagtgcttttttcctgattataaaataacccagatatatggataggaagaatcaatgtcatgaaaatggccatactgcccaaggtaatttatagattcaatgccatccccatcaagctacaaatgactttcttcacagaattggaaaaaactactttaaacttcatatggaaccaaaaaagagcccgcattgccaagacaatcctaagccaaaagaacaaagctggaggcatcacgctacctgacttcaaactatactacaaggctacagtaaccaaaacagcatggtactgtaccaaaacagagatatagaccaaaggaacagaacagagccctcagaaataataccacacatctacaaccatctgatctttgacaaacctgataaaaacaagaaatggggaaaggattccctatttaataaatggtgctagggaaactggctagccatatgtagaaagctgaaactggatcccttctttacaccttgtagaaaaattaattcaagatggattaaagacttaaatgttaatcctaaaaccataaaaaccctagaagaaaacctaggcattaccattcaggacataggcatgggcaaggacttcatgtctaaaacaccaaagcaatggcaacaaaagccaaaattgacaaatgggatctaattaaactaaagagcttccgcacagcaaaagaaactaccatcagagtgaacaggcaacctacagaatgggagaaaatttttgccatctactcatttgacaaagggctaatatccagaatctacaaagaactcaaacaaatttacaagaaaaaaacaaccccatcaaaaagtggtcaaaggatatcaacagacacttctcaaaaaaagacatttatgcagccaacagacacatgaaaaaatgctcatcatcactggccatcagagaaatgcaaatcaaaaccacaatgaggtaccatctcacatcagttagaatgtggatcactaaaaagtcaggaaacaacaagtgctggagatgatgtggagaaataggaacacttttacactgttggtgggactgtaaactagttcaaccattgtggaagacagtgtggcaattcctcaaggatctagaactagaaataccatttgacccagctatcccattactgggtatatacccaaaggattataaatcatgctgctataaagacacatgcacatgtatgttcattgcgacactattcacaatagcaaagacttggaaccaacccaaatatccatcgatgatagactggattaagaaaatgtggcatatatacaccatggaatactatgcagccataaaaaaggatgagttcatatcctttgtagggacatggatgcttcatcctactcttcaccagttagagtagttcccttaagtacataagcaaacagctacttgcatcacaaattattgtaattgtaacaaagtaatctacattcctaatgacgctgcatcatgaagaaaacataaaattaaatagcacgcaatctatttaagagatcttaaagaaataataatcatgaataatttttaaaaactattggacaattatctaaataattccataattattctgaataaatgataagctgtgatcatcctaattagcttgggaaaggttttatattagaataacattcaaaagctgaaaaaatatgaaaaattaaggtaataataaagtaacataaaataaattaaaagttgcaattacattaaaaatcactgtggccataattatgacctgtagacacatctggaatacaagaacacaggcacagaagtcacttaacaaatttttctttttatgagtgatcagcaatgagtattttaacaggttttaacactacattcaaacattatcacacttaaaaagagggcttattattgtatcaaaatatctttttggcaaaaagttaaagcataagttgaaatgtgatgagtacaaaatgattagggggtataataaaatcattattcatcttaatgcttcattccagctagcaatccaagttagcaaaagtcacaggaaaaacaaggattttaaaagttgagtataagatgagaaatactaacaactatttttggcacctgtttaatgctttgtggctctatacatttcttaacttttcctgcttagactctctctttcagtgagtctttattctagtattcatcctttcccaatccagtctatgtgctctgaaggaaaattacctcttccctagccataggggtggactctggatcaaaccatatctgaagcttcctcatcactggatctttcaattatgaaactaatacacttcttttactggtcaagtcatttggaattaaattttatttcattagaaaattaaattatatcatatataatgtgtatgaaatatgtatacacaattaaaataataataataaaatgaacactcatgtaccagacacccagcttaagaaataaaacagtgttcagagctcccctaagtgccctgccttattataactggcttcccatcccaaccctgagaggtacacaccatcctgaacttttggtttatgatatataacaaatatcttttcacaatgtgactaacctttttcagttcctctatggtttccattcattatagagagtttttaattttaatgtcaaatggatacattttttcctctgctagttcatattactgtatgtgtcttatttaatagacctatcctggctaggtacagtggctcatgcctgtaatcccagcactatgagaggcccaagtgagaggatcacttgagcccaggagttccaggctgcaggaagccatgattgtgccatttgaaaatattatagatagatagatgatagatagatagatagatagatagatagatagatagagatagataaatagatatttttctatgttttcaagttttccttttcataataagtattttattttattagaattgatttttgtggggtaaagtacaatttcacatttttcataaaattatttttcacaaagtaacataatgtaaccaaactcaggtttggctggtagctgcctgaaaagccaagtgcacaagaggcaaggtgtggtggaaggaaagcagctttattcaaatgccagcagttgcagaaatggctgggctcaagctgcaaagaaaccatctcaaatttttaagctaagtgaaggagtttacgaggggaaacacatgggaatgggagtagtgcagggtgcaggcctgcatgtgttgttcccatggttatcttgagctattgcccatctgggtgtggctggccccatctaggttaccagatgagttgtaaattaaccacctaaagaggaagaagtctgcagctaggtctccatatctggtttgttttgagattagctggtggagtttctaaggaagcctgtagtcagagaaacatgcacggtgcaaggaagtttctactgggaaagagggagaagcaaagagcttcaaagtacatttcaaagctatattctgagattggagaaataaaatctaaaatgctttttaaacctaagatactcagttacaaaaaacaatagttcttccttcctgctgacatacaaggcctgctctgtcataaatcaagtttttttttcctctatgcctgcaccagtttttttttaattgaggaaaaaaatatatatataattcaccatatttaccattttaaagcttgcagttcagtggtaataaatacattcatatttgttattttccctcttcatcccctacaccctcttcttaacctctggtaacccacagtctactgtctatcttcatgaaattcacatgtttagtgcccacatacgagtgagaatgtgagatatttgtattttacttaatgtaatggcctctagttctatccatgttgatgcaaataacaggagttcattcctttttatggctgaataatattccataatgtatatataacacatttctttatccatttatacattaatggacatttaggctgattccatattttggctattgtaaatggggcagcaaaaaaacagggaagtgtagctatctcttttatacattgatgtcctttcttttggatatatacccagtagtgggattgctggatcatatggtaagtctatttttagttttctgaggaacctccacgctgttctccatagcggctatactaatttgcatccccaccaagagtgtatgagggttcccctttccccacattcttgccagcatgttattgtgcctgggtcaattttaatgctacctattctgttcccttagtctgtctaaccctataatatagaattttgtagctatataattatcctcggtatctaggagggcaaatcatactatattgctcttcttctctgggaattttgtgactattcttacctcttgctcatccatattgatttttgaattaatgcatctagtgccataaaaaatcttgatgggattttgacagaaactgaattgttagatatatttggaaagagcagcattttcacaatactgagtctttgtacccaagattatgaacgatctttggatattctttaatgtctttttccatacggtttatacttttctccatgaagtgcttacatatcttttgttagatctattaatggatacttggtattttcaattgccataataaatggtatctttcttaattgcattattaaactgctcatagctgatgtattgacatgcaataatttatttatgttaatgttttaaattgagcaatcttgttaaactctcttattaaatctcataatttttctgtggacccttgggttttctatgtaaggtcatttcatttatgaatgacaatttctccccctccttttcaatcattatacttcatttctttttctttcctcactgcagaagccaggactacaagtacaatgttgaacagtgaggtgatagagagtgtccttgccctgtttcttatttaagaacatgcattcaacattacctcagggagtgtcataaatccttacggggtgctgaagggggatggtctttcttctgtaccatcttcctgctggctttcagtggtgaccctgcctaacaggggacctcatatgggcaagatgattggtggtagccaattttaaaagaagacaacaagcttttgagccaggttgtccggctccagcttattcccttagcctgtcaatgcagttagaaccagaggaacaaagttacaggagctgaccaaaaagctgaaggaaagagttatttcttggtccttctcaaggggaggaaaaaaaatactgaaagcagtgacacacagcaaaagtttaatttttgagatatgattctgagaaatttttttaaaagaaacaggtcataaaattaaaagtaaaatattttgcaattttagtgagagaaaaacaatactttaagaaaactttattttaatatacgggaccaatcttagaagattattataaataatctctttttaataataaccaacttaatcacctacaaaattccttttataaagtccacttcatgaaccttatgatgacttgcacagaccatctatgatatgcttggagtttctgacttgtcctaaacttttctctttcttaaataatcagtcattttactttaggacaaaagtttaccatagaagatgcttttttatataaaattattctcttttttaatcttccttaccaaaaaatacatcttcatatctatatctttcttcaggtctctctttttcctacttactgattcctttctagcttacctcataattaacatttttagtccatagtttgagttgacctttagataacctctgaattacataaaattattattttcttttttaataagactagaaactgggagacatctggcctccaatgcttcccagagtgatgcagaattaaacaacccaaagaacaaaaatcattaagagcagaaagaaaattgtaagtgtaaagttcagggcatgcaagcatagggcaatgtgcatcagaagctgctgccacaatagcacacaggactctctattttactggcatgttgcaaataggcctagtttccacacaggaaagagtgtgctattcccaccagggatatccctgtggtaggtacttgtagaactacatgaggtttattggtgtttatcccagatttattagctggtatgcttgcatcccactctccccaagggtcaaagttcttaggcctcatagctgaataacagtcatcagcacaaaaggggttacagtcttcatcagcactgtaatgggagtgattagattgacataacatattttggaatattaaagtaataatattccattttatcaagaattccagttttggcccctagaccccatgcttcctttcctcttctgaaactgttaactgggtcttgaattatagctgcacccctattttgaccataataccattcctagcagggaaactgggcaacttggcactaccagaaattcttgttgaaatatttgggttctttgttttaaattgacaagtcagagaaggagtaaaaaatctagtttgtggcttttcttccattctgataacacttatagaccgagaggaaacttttcctgcatgagcagtaaggacatagtagttttcccctgtatcaaaaagaaactgaatttggatgcccatgctgtccagagttacctggggttcctcaatggtaattatgatattcctggaccaagggtggtgagggagaccctgggccccttcagtcttcatccagttcctccctttgcattgcaagagttttgactggccaagcccctagatgggagtagggcagtcaatcctctagtgccagagatcatgactggtatctttgcactgatggcaggggcctggtgggagtctgatacaatccttcatccaatgtccattctttttgcacttgaagcaagggttactacatttgggccctcacaggtttccctttgacatcttttgggcctttagggcattgccaatgacagcagccataattttagcttgtcatttattttccctccctttctctaggtcacaattgttgtataccataaaagcagtatccagaagctgtgtctgaggccctatttccaactttagaaacttgcatctaatattaagggcagactggcttatgaagtgctgagctataagcgctttcccttgttaagaggctgggtctaggttagtgtacagttagtttaaccagctgtaaaacatagccgggatttttctccttttcctgggtgacttccctcagttattccttttctcattcttccatgaaaggtcaaaacccaaagacaaggtttgaaaaccatttgcaaacttcctaggattttcagagtaactctctagtttttctttacattgctgtgtatctgttaccaaaaaaggggcttggactagcattgggcacactggccctgccacctctctgagagtaaataggcttggggggtggtgtatggggtaccttttctattgtgcagaggactcagcaggatttctgttgactcttgtggtttttcttccagtgtgctaggtgaagagttacatggaggcagctgtggttccctctgagagactggtgacccctgtagcagagaattatttatgatgtctacacctgtcttggaactctccttttgagtaccttttcttgaaactttgcatatagatgggttctactaggggaggcattttatctcctgtgttgttaaatgcacacagtgaacaggtttgacaaacttgcttagccactgaagccatattagatctgatgaagagtttgtttaccgtggctagtatggcatccctccccttgtggaaggagtcatgcaaggtttttatagctttccactgggctgcttgagggagatacaattttggccacatatgtcaccagagtctttgtttttgacccccttgctctttttattagttgtttttcttgtactgtgtagttaggttttacaggggaattagcataaggaaacaaagctaaaactggttggtattgtattctgagggttgccactttggctttcttatcagccttcctgttttccagcactatgggctaagtgtttctcatgccccctacaataaattatagctatagcctttggtagatatatgcttctaataattgaagaatttcagccccatgttttatgggggaatgcctgctggttagtaattctttttctttccagactgtggcatgaacatgaaccacaaggaatgtatatttggaaactgaaaaaatgttgagctttttctctttttctaatattagagtccaagtaagagcaatggtctcagctttttatgctgatgtgcctggaggcagcagctggacctcaatatgtgttgtaatttactattgcatacccagcctagcattctccatttgacacaaaattactgccgtctgtgaaccagccatcttcaggatctgggagaggctgatcttttagatcaggccagctcatatatgtgtgtacaaatatctgcttgcaggaatgatcactgggcatgtgggcagtagtggagctggattcagggtgttacaagttttaaggataacttctggattattttaaaaacatagcctgatatttggttaacttttctcctgtcatccaaatgtgttcttttgcctccaagattgatttaagctggcatggggttagtacttccagtggttgacccagagtaatcatagtggcttcctctactaaaatagcagtgactgctattgcccacaaggagcttggacatctcaaggacaccctgtccaatttatacctttccttttttttttttttttttttttttgagacagagtctcgctctgttacccaggctggagtgtagtggcaccatctcggctcactgcaagctctgcctcctgggttcacaccattctcctacctcagcctccccagtagctgggactacaggcacccaccaccttgcccagctaattttttgtatttttagtacagacagggtttcaccatgttagccaggatggtctcgatctcctgaccttgtgatccacctgccttggcctcccaaagcatacttttccttttagctacatgtaaagaaaaaggcttagtgaggtctggggtgcctagtgcaggagccttactgacagcttgttttaacttagtgaaggcctcccttatttttggtgtgcattcaattggctcattctctggcccccacatgactgcataaaggagctttgctataaatccaaaattgggaattcatattctgcaaaatccaaacatccccagaaaaggacaaatttgtttggtgggggtgggtctaatccacatatggcttgcacacgctctggggatatctgttgggattgaaccgtcccccagtgattgaggatgcagccaagggggaagtcgggtgagattgaaactgagtttcttgtcttctgtctgtagagaacaaggaaaacttgaaatttagagcgttctggcctagggccacacactggggcgtcccccattgaagggcctatgctggggttgagggccaagagggcatcccctgcttgggcctcttcatgacatgccacatgtctctggccttagatgggcatcagcaccacttgaagaaggattccgccatatttggtgacctatgattaagtttccctttagtccccaggtgctgccctcagcttttggcatctctgtagctggccaaaatagttttcttccccaaatggtttccttaactattgtggtaactgtagtttgaagggcaaggaattgcagactccccagcttgaatttgttaaagattggcctcttgataagggaagagaatgccctctgaccagataaactacatgcagtgatttccccatggatccgctgcacaacttaggcaatgatccgagagtctccaccaggatttttctcttagcaccaggtctgctaaactaaaacgatccagatctggtccctcacaaaagaagcagggtttttttccttatttagctattgcctgggtcctttgggtcggggtacagtaatttcttgtttcaacattacgaaaacaaaaatcagaatgttatgtcttgccacacacacaaatacctcacaggcacagggatttgtcttgtgcctggtgaagcctaattgctccgttccccaccagcttatcctgtccgagtcttccagcaggggggcaccctagtggctcttaactacccatcttgtgcccccaaagagtgccatcagaggaaagaatcagaaagcaaaaccaaaaataaaaatcccaaattggcgcttacctcctggctggcttaccaaaaatactacgttaccagctgatgttgcaaagtcccaggttcttcactgagcaaagaactggacatgacacacaaatagcaaagcagcaaaagatttattaagcacagtacaatttgcaatggactgggctgacccacaagtggtatcagccccgatttgtaacatttcatggccttttattatgtttttttactctaacttactcaactttatttttttgtgaccaattgctcatccttgcctttcccttattgcaccttaaccttactttatctcttgtaggctaattgctcattcttgcctttcccttattgtgccaacttactgtttacttctttttatctagtatgctctgcttttgtttttgttttgcttttgtttttgttttgagatggagtctcactcttcgcccaggctggagtgccatggtgcaatctcagctcactgcaacctccacctccaaggttcaagcgattctcctaactcagcctctggagtagctgggactataggcatgtgccaccatgcccagctaatttttgtatttttagtagagactcggtttcaccatgttggccaggctcatcttgaactcttgacctcaagtgatccacccacctctgcctcccaaaatgctgggcttacaggtgtgagccaccacacagccctctgcttttgttatcttgcatgttctccttaagctagcctacatccaacagttccccttcgcccccagcttcctctgctattcacctacctcaacagtgatatacttacatcgtatttcttttcattgatattggcctggtatctcttttgaatctgtaatttttagttgttctgtgctcttgagctttatgcttaacttttataaatagtatatatatgtatttgttttaacctaatctgaaaattctctcttttaaatgaatagcttattccattcatatttctggtgattactgatacatttggattattgccaccttctttttctttttttagagagatagggtctcttctgccaccccgcctggagtgcagtggcaccatcatagctcactgtaaccttgaactcctaggctcaagcaatcctcctgcttcagccgcctgagcagctaggactacagttgcatgccaccatacccagctaattttttattttttgtagagacgagggggccttgctatgttgcccaggctggtctcaaactcctggcttcaaataatcccccatcttggctacccaaagcactgggtttacaaacatgagctactgtgcacagcctatttccaccttcttattaactgatttttattcgcttcattttttatgccttttcttctttccctaaatttcccttcttcttcctcactcccagcagacaactttgcatcttatttcacagagataaaagaagcaattagaagataacttccacatgccccccacaacatctagctacttcactgcatgagggacccatctataaccctttcttctattgaggataaactgctcattctcctagccaaggccagcttcaccacttatccactaaataccatctcttcttgcctacccaatgaccttgctcaaacaattctctactcttttaaatcatcaatctttcaatctctgctggatcattcccataaccatacatatataggattgtttttccattttaaaataactttttttctggactctatcttctccttcagctaccacaccatttctcttcttcagcttacaagaaaactcttaagaagagttgcctatacttgctgtctccagtttctgttttcccattctctgaaccaattcctatcaggtaagttaccaataatcttcctttctttttgttttttttttttttgagatggggccaaagtgcagtgctgtaatcatagctcactgcagcctcaaactcttggactcaggtgatcctcccacctcagccacccaaagtgctgggattacaggtatgagctactgggccccctggcctgcacattttaaatcttgttctcatttttcattctacttgatcactcaaagtccaagctactcaggaggctgaggtgggaggttcacttgaggccagcatttcaagtctagcctgggcaacatagcaagaacttgtctctaaaaaaggaaaaaataaaaagtatttgacacagctgattattcccctttctttgaaatatttttttcacttggcttctaggacactcaattgtcctgctttttctcttacctcattagtggcatctttttagtttcctttatccttactccttctctctctcactaccaaacagtggaatactccaaaactcaatccttggggttctcctcttttctaactactcttacaccattggtgatttcatggtttgtatatctcatatgccaataactccaattaatatctctagaccagacttctcctctgaaccccagactcaaatatccaactcctcacttatcatctctaacataacattccccaaactgaattcctgatctatttcccatcctaattttgtttgacacaatctctaccttctcagtgaatggcaactccaagtcctcctgttgatcaggcctaaaatcttgccattatctttgactcttcttttctcagaccccacagtcaatctaccatcaagttctgttggttttacttttagaatacatttgagaatcctacatttcccctaactccactcctaccaccttcatctattccactatcacctttcacgtgtattattacaacagctccctaactagtttccctgcttccatccttgtctcccttcaatctatttactacactgtagccagagttagtctgttaaaatataaatcaaatcctatcacatctgcttaaaatcctccaaggcttcacatctcattctgttaaattccttatttagcctgcaacaccctaaacaatctcagcccaactgcttccccacatcctaccttctgtccaagctctctgacctcatctcccactagttggtctcattcagtcttttctagacaagctggctgttctgtggacacagctcctgtctggcctcagggtctttccacttgatttcacccttactaggacatttccccctagctgtctacatggctcacctacttatctctcacttcccactaaaatgtcaccttgaaggccattcctgtccatattccttatttatttccctttcttaatttttcctgtagcatttatcatcatcaaacatgcttatatttctatttgtataacttatgtattgtctgtctttcttcaatagaactgatgcctcatctttggcatcttggtacaaattagaaaatgattcaggcatgtgcgtgtttgctcgtacacacacacacacacacatacacatacacacatacacgttcatcccaccccatgcacaggatttggttagcagctacatttgtgtaaagaaaaaggcatgggtgggagcagagtaaaagacgaattttatccacctccagtgtccccctccccattcaactcctcagccaggtgcctttgggcagaacattatgcacatgattgacagctctaagtagaatgtaagcttcatgaagacagggatattttttgtcttattgcttcttgtgtccccagtaccttagaaagtggcacacaaacactcaataaatatttgaaacataaattaatagtttgaaaaaaaaacaaagggtaaaagttattagttgttattttaaaataaaaaactaaatgacataatcctggaaaagagggcctcagaacattgatgaagttcataaaatgggtaaagtgactgctgtaaaataacccagaaattaagataataaggcctagcatacataccaaatattggaaagtatgggaattattttactatgtaattgtataataaaaataagaacaggagaatgttgttcttggcacttttaagtcaatgacctactttttacttcttgccttgactaagatgcactacaaattttaaagtcctttgaatggtacattctttggtgatttacttttagagggaaatagttgattgttcaaaatcaataaacaggaaaaaataaaaagactatggaaagtctgtacacagtagctgtcccagtgtctcttttattaaagttttatttcctctttattaaaatgtttgcccaattctcttgcccatttatggcaagcataaactgttgcttctcatctgaatttgtgtgagctattttgaaatatttaagacattaatctttcattcagtttacagtaaatattttcactcagtttatgttttggaaaaaatatatagaactttaaattttatttagtcaaatttgtaagtctttatctttgagattgctgtcatctattcaagcttaagtagcctaccagcaatatgacaaactttcatttctgcttttctgattttcttttccatgtgactttgaaattttaaaatttacatacctaatagaaattagtttggtgtattgtatgaaactggtactataaagcattttgttacttaaaaacactgtgatcaattctggtaacatttgtttagaaataaactctaacctcttttcagagatagttggatttagagtcataaaattccaacatttcaaaggacatttccattttacttaaatttgctttaaaaataagttaactatcttaaatgtattttaaaagataataaaacagagattaaaatcagctcctgctttaatatctcctccattactaatcctctgatctctttacagtcatgaaggtcaaacatttatgtttatagaaacagaagtcctatttgtttcgtaaagctggtttattttatcaggtattaacaatgggcatcaaaaaggtgatgtaacagtatgaaagcatgaaataacgtctttgtgattttttttaaagaataaagcagtgcttctgtctggggacttgggaggctgatgagggaggattgcttaagcttgagagtttgaagctgcagccaggtgtgatcacaccactgcactccaacctgggtgacagagtgagatcctgtctctaatatatatatatatatatatatatatatatatatatccacacacacacacacatacacacactatatatatacacactaagtatactaatacatttatactatatatagtatatatactgtatatagtatatataatatatagtgtatatattttatataaactatatatagtatatatacactatacatactatagtatagtatattatatatagtatatatattatagtatactagatatactatatagtattctctatatatactatatatagaatactgtatatattctatatatatactctatatactatatattctatacatatactctatatagtatactatatatacatatattatatataaagagtatatatatagaactttgatcacagaattgatcacagtgttaagtaactatatatttatacatttatatttatactatatataatatactatttatatttatactatatagtatactatatatagtataaaaatatagcataaatatagtatatatagtatagtatactatatacagtatactatagtataaatataaatataaatgtataaatatacatgtataaatatgaatgtataaatatatagtataaatataatgtataaatataaatgtatacatgtatagtataaatagaaatgtataaatatatggtataatataaatatatgtatataataatataatataaatatatgtctataataataaagcaaagaagaaaatggtgtgctaaaaaagtgtttacaactgtaccttaagtttttgagcagtttgtataagagatacagaatatatattattgatcaaacaaggaaaatgaacatttttgggttcttgttttggttatctatcattgcacaataaattgcccccaaattgacagcttaaaacaataacttattattttcacacttcattttaaagacaattgtatttcacaactttcattttaaagacaattatatttcgcaactttcattttaaagacaatataactaaggctcaaaatggttaagcaagttgctaaagattcaaataagtcattgaagacattctaactcctgatccacattaatttgcatggcaacatactgcctttttcatttattaagtagtattccaactataactaaattatactagcaattcaactgaaattgggtatgactgatccttattaatttttaggacttaaatgtgagagttgtgaggtaatggagagtatagagcagagtagggaattaaaaaaaagcccaagttagttctagactagtgtttcccaactttgaataaaatatgactcattttaaagaaagaagaagggaaaaaaacccatgactacactgttgacttaaaacttttaaattaataaaaaatgataaaggggatatcaccaccgatcccacacaaatacaaactaccatcatagaatactacaaacacctctatgcaaataaactagaaaatctagaagaaatggataaattcctcgacacatacactctcccaagactaaaccaggaagaagttgaatctctgaatagaccaataacaggagctgaaactgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatctttgatgaacattgatgcaaaaatcctcaataaaatactggcaagccgaatccagcagcacatcaaaaagcttatccaccataatcaagtgggcttcatccctgggatgcaaggctgattcaatatatgcaaatcaataaatgtaatccggcatataaacagaaccaaagacaaaaaacacatgattatctcaatagatgcagaaaaggcctttgacaaaattcaacaacacttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccactcctattcaacgtagtgttggaagttctggccagggcaattaggcaggagaaggaaataaagggtattcaattaggaaaagaggaagtcaaattgtctctgtttgccgatgacatgattgtatatccagaaaaccccattgtctcagcccaaaatgtccttaagcggataagcaacttcagcaaagtctcaggatagaaaatcaatgtggaaaaatcacaagcattcttatacaccaataacagacaaacagagagccaaatcatgagtgaactctcattcacaattgcttcaaagagaataaaatacctaggaatccaccttacaagggacgtgaaggacctcttcaaggagaactacaaaccactgctcaatgaaattaaagaggatacaaacaaatggaagaacattccatgctcatggataggaagaatcaatatcatgaaaatggccatactgccctaggtaatttatagattcaatgccatccccatcaagctaccaatgactttcttcacagaatgggaaaaaactactttaaagttcatatggaaccaaaaaagagcccgcatcgccaagtcaatcctaagccaaatcctaagccaggaggcatcacgctacctgacttcaaactatactacaaggctacagtaaccaaaacagcatggtactggtaccaaaacagaggtatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatcccttctttacaccttatacaaaaatcaattcaagatggattaaagacttaaatgttagacctaaaaccataaaaaccctagaagaaaacctaggcattaccattcaggacataggcacgggcaaggacttcatgtctaaaacaccaaaagcaatggcaacaaaagccaaaattgacaaatgggatctaattaaactaaagagcttctgcacagcaaaagaaactagcatcagagtgaacaggcaacccacaaaatgggagaaaatttttgcaacctactcatctgacaaagggctaatatccagaatctacaacgaactcaaacaaatttacaagaaaaaaacaaacaaccccatcaaaaagtgggtgaaggacatgaacagacacttatcaaaagaagacatttatgcagtcaaaaaacatatgaaaaaatgctcaccatcactggccatcagagaaatgcaaatcaaaaccacaatgagataccatctcacactagttagaatggccatcattaaaaagttaggcaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactatgaatcatgctgctataaagacacatgcacacgtatgtttattaaggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcatatgtgggaattgaacaatgggaacacatggacacaggagggggaacatcacactctggggactgttgtggggtggggggaggggggagggatagcactgggagatatacctaacgctagatgacgagttagtgggtgcagtgcaccagcatgtcacatgtatacataggtaactaacctgcacattgtgcacatgtaccctaaaacttaaaagtataataaaaaaatttttaaattaaaacttgcataaatatgttcaaatataaaatgaattataaatttcttatgattacagtttacacacaactataaaaccaaaacaaattgcaaaattgttaaattatatctaacatgtatagtacataataagtactaggcactttacatctatcaacttatttaatattcacaacccaatgagttggacatgattattatcgccatttaatagatgaggcaaccaagactggaagaagttaaacaacttgtccaatgtcccaaaactgataaatggcagagctggatttcacagaaaagttaacagacaagcgaatgtgaagaatgataccgttttacagaagttaaattgttccttgtaatgtgaatatggtattgactttaactgtagatcttctggctttaacatacataaattaaaatgagcgggatagtgactaatttctcccaccacttgtttttctcttctgtcaactgctaaatatatattggcacagcacaaattaatgtcatttggtcttcattttaagggaatggcttgttacaaattaagtctacatctgttctctcaagttttttcttaagacaattcctgattactatttttctttattattgggatttaattcacatactatacaatttatgcctttgaagagtacagttcagtggcttttagcgtattcacaaacttgtgcagccatcatcactaattccagaatattttcatcataccaaaaagaaatcccacactcactaagcagttaatatagtttagatattcgtgccttcaaaatctcatgttaaaatttgatccccagtgttggaggtgaggcctagtaggaggtgttttggtcatggaggggcggacccctcatgaatggcttggtgccattcttactggagtaatcccatgagaactggttgttaaaaagagcctggcacctccctcctctctttccttttcttgccatgggaaacctgctccccttcgtcttctgccatgaatagaagcttcctgaagccctcaccagaagcaaatgctggtgccatggccatgcttcttgtatagcctgtagaactgagtcaaaaactcttcataaattacccagcctaggcattcctttatagcaatgccccacactcttccccaccagccagtaggttggcaattatcaaactattttctgtaatgattttcctattctgaatatttaatataaacggaattataaaatatgtggatctttgggtctggcacctttcacttagcataatttttcaaggtttatgttgtaatccatgccagtattgaatccctttttatacctgaataatgtttcattttgtggatgggatcatatacatttcatgtacattttaatcaattaatggacatttgagttgtttctacctttgggctactatgataatgctgtgataatatttgagtgcaagtttttgtgtaaaaatgttttcagttctcttgggtatgtaactaggagtgaaattgcccaactgttttccagaatagttgcacattttactttcccaccagcaatgtatgaggatgccaatttctctactttctcaccaagacttgatattgtgatactgactttctgattatagccatctcagtaggtgtgagtggtatctcaggtggttttgatttgcatttatctaaggattaaggatgttgagcagttttttgtttgcttattagccatgcatatcttctttgaagaaatgtgtattcagattctttggccattttgtaattgggttatttctctttttattcagctgcaagagttctctcattaagatctgacaggttaatacaacaccaatgcaatgataaatgcaaaaaacagggactctgaaattgcgtggttgtactcagttataaggtggtcatccatgagatccagaatcaaatttgatgaaatggttaagattataatgttttataatttgtttatttgaaaatatacattttaaatgtttgctagagagctctaatatcctcaagaatacctacaatgtaaacactgttctatgcatagactaaatccttagcaatagacagaaggaactgagtgctctttgagtgagggaatgggcttgaccagtgtttgaagatttaaaaatgaatatgaagacatgttgtgacactagggtatgattatatttttatatttaagtagaatctgattatcatcagaaaaactctaattttaaaatccatagctggcaatatccatgaattcagcccaggtcatcaaatgctgaaagcacatgggtcagattgactgtctccattttttcttgcttacttcaaagctatgaagaaatccaaagcccttgctgatactcttccatgatatattccttttaaatgcttgaaaagttttcccttcctacaggaatcccccaaacacagctgtccttacactgagcccctattcaaattttggttcctctttctaacattggtcgtcagtcaattttgctggtctataccaactgcagatctagagccaatgcttatagaacttttctgagaattcttttaatttcagataattttttaaaattaccacaaaattagtttagaagaattcgcagagaggtacattgggagggaaatagctttgaggccctttatggatttatgaccaaagctatccagtcaaattcctccaggtatttttgctatttcctatgggtatactgaaattacacacattttaaagcttccttaatcaacttaaacaaatacaaataataaaattcagtgtcaatgagatactgaatctaaaagataaaagtacatccatatttttataatgatttttcaattgttatggaaagaaatatgagactatgtaaacagaaaaaataaaatttcttttaattaaaaaacccacattaaaaaatatatcccaagaaaatattcccatcacttattactccaaagagtaatttgttcaaggaggttaaagcagtgttacttataatagttaaagaatcagaaaatgtactttcctaaaatttagggttaagaaaactattctaggccaaacacagtggctcacacatgtaatcccagcacactgtgagagggatgggtgatgtgggaagatcacttgagcctaggcatttaagaccagcctgggcaacctagggagatcccctctctacaagtaataaataattagctgggtgtggtggcgtgtgcctgcctgtagtccagcttctgggaggctgaggcaggagactcacttgagctcaggaggttgaggctgcagtgagccttgaccatgccactgcactctagcctggattacagattcagaccctgaaaaaaaagagaaaggaaggaaggaaggaaggaaggaagggagggagggagggagggagggagggagggagggagggaaggaaggaaggaaggaaggaaggaaggaaggaaggaaggaaggaaggaaggaaggaaggaaggaaaaactagtctataccaatatataaactatatagccattaagaattataagactttagaacatgttgatctctggaaatatgtttatgaaataatgttaattataaatatgtgttttgtacagatgtacattcaagcattttaatagatttataaatccttgtgtatcattttgtgttcaaacacagcgtatttctttttttaatcatacttaaacaatttattttttatttcaatagtttctgaggaacaggtggctttttgtgacatgaacaaattcttttgcagtaatttctgagattttggtgtacccatcaccagagcagtgtacactgtactcaatacgtagtattttacccctcaccccacttccccctggagcccccagactccactatatcattctgatgcctttgtgtcctcatagcttagctccagcttatgaatgagaacatatgtttggttttccactctgagttatttcacttagaataatcatctctaattccatccaggttgctgagaatgccattattttgttcctttttatggctgagtagtattctgtggtatatatatactatattttctttatccactcgttggttgatggacatttaggctggttccatattttttgcaattgtgaattgcgctggtataaacatgtgcaaacacagtctacttcagattatatttacatgtataaatctattgatgtatattaatgtacattgacaaataaatgtaaggtgatgttaacagaatttcatgtttattgaattctttggttttaaaacaaagcagcatttcacaaaaattattctattttattataagcactgcttacaaacaaatttgttcaaaacaaatttgggggtttggggaataggttaggtaaaatgtttttaccataggaattttcagagcctttaatttattaacatacattgtggatctctaaaatgaagagatttctcttattgtttatctcaaaatctactatttacatcacgacttacatttattttgtgtaaataaatctgcataaatcttatttgcacttgttactaatttatcgttttcaccaaactgtaacttctatcaggacaggtaaatatatctgtcttcttcaccactgttcctagagtgccagccagggcatatagaagtggctcaatatttttgaagtgaatgacttgctagagcagcatttaggcaaactagtgcctaaagtcacacattttgggaactaccactctaaagttatttaattgtataataacttcaaaggaaaaaaatgtgttaatgcccctaggccactagagatccatttaataattattgcttcgcttcagttgagtcacttactactttagggaacagaagagatttctcagagagcacctcatgacctggaaaagtcttgcaaaatcattttcatactctgcatctccagctgaaaaacaatgataaaattagttaccatggaagttaaaggaatcatgctttgcattaacaccaacagtcttctggaacacatttggtaacattagatttcccatcaaagatatttgtttattttaatagttcaagcatgaaaaagagatatcccttttggaagctgcaaattgttgactcactgattctcatttaggaaaagggatttcacattactttatctattttctcaatagtcaaagcccatgttaagagagcttttaaacatatttaaaatatatggcttacctacatgttttacatgataatttatggttatagaagttagaaagtgcaatttcttttaatatccccgtggggaagttatataattctatagttttttaaaatatatggaaaagcaatatactttccgttaactgctaagattcatgaattttctccacaagttctccagaggaactactagaaaaaactccacgaatctcattatttgacagttttgttgaagtgaaattattaaaattgatattagatttaatgacttgtttccagtaaccaaaatggaaagtattctaccagctgtcgatggttccacaccctgacacatcgttaaaaccttagcttctgcctaaactttaaaccttaataatatttggcggtaggggaggggttacatttcaagtcaaacaaaggatgtatttccaaagcagcatttacaaaggttaatctgtgtatggactacaaaggggaaagtgcagtgccccagtgatcgatctaagacccccctctcgttgttgttgttgttgggtttttttggtctggttaataaaccacctagagggataatttttaaacttaatttgttgaaatggtactttactaatgtatgaaaaaaatttccccaaatttgagaatttttggtaagttgattttatatttgggaataaagatctcttgcttcttctactgacaccttctacacaaaagataaaaggtacttttacttggtaatccgcagggagaaaatttacagaaacccagagccaaaggtgctctcaggggatcccctgaaacattcaaagccattgcggccccagaaggtaaatggctttcgcaggaacacaggtctcctgactcacggcctaaccttcctttcccccacaccaaagctcgcgcggcaccagctagagtgaaggtcaaagtcaacagaataatctctgcagtccagggtctgtgagggtcctcctatccgagggagttttcatgaaagggcatttccgaacattttattccaaggacacagtctagtcaaaagacgtttgggatagggtaaacatgaggcaaaagaacacttacaaaagaaaaaagcgcagtttcttggaggcttgtcagaagctaagactggggagatgagaaccagggcccttggcgagagttggggtgggaatcgcgtaagaaaagcaatttctagagcggaaaggtgaccccacattacaaaaagaaatggagtagaaaaataggcttgactattctaaagctgcttcagaaagaatctccggaagaccacggaggaaccccgcaggggagccaggcggatactcagccgctcgcggtagaagggcgcgcaaagctgcggagccgcgtgtgtggagctccccagtgcactcactgctggctccccctcggtgctctgggcccttcccagctccctccacacagcccggctcccttcacacacccccgccccctccgagctccccgactcctccccgcgctccacggctcttcccgactccagtcagcgttcctcgggccctcggcgccacgagctgtccgggcacgcagcccctagcggcgcgtcgctgccaagccggcctccgcgcgcctccctccttccttctcccctggctgttcgcgatccagcttgggtaggcggggaagcagctggagtgcgaccgccgcggcagccaccctgcaaccgccagtcggaggtgcagtccgtaggccctggcccccgggtgggcccttggggagtcggcgccgctcccggggagctgcaaggctcgcccctgcccggcgtggagggcgcggggggcgcggaggtgagcgggtcggggaggagcgcgaaagaaggtagcggcggcggagttgagggtcaagatgcagtctgcgccacgcgctgcatccatcctccccgattctgcgccctcaccgggcgtccgccctgagctgcggggtccctcatctcctggcaccttaaggtggaaagtgagaagggtggagaagggtgtctgttccactgattccccctcctcctcctcttggttcctagagctaagggcaagtcctgaggttgggcccaggagaaagaaggcaaggagacattgtcccaggtaggatgtgtcccagcaggaaaggacaggcaggttactttcgcccccttgatagtctccctgctactttgggttgatgcagggcatttcatggaagatcatgcagtgctgctttgcgaacaggtatttctagcagtcatttggtttatttcccagtaatgtaatcgtggtgtttaggccatttctgttagaaagtaattggcctcttctttgactgtcctaaattatctttgaaccctgtgttcagcctcagccaaaacttgttgaaaattatgccctaaaaatcttgctcttaaaatagagcagagagataaagagcatttttgttggaagatttccatttattatctctcccaccccgtggagaaggattggtgtcagtttttactcctcgggcagttagttttttagatggaaagacagtccaggccatagttaattatcgctcatcagtataggagaaaaagaattcagactcctgccccacccccacccccacccccaacctcctgacttagattctggtccttttaacagccccgctgcttggaaccctttttgttttctaaaccacctccccatccttccttttctccactttattatttcttcattttattgatctgtttattttttctttctttaaccctataatttttttactccgattctctcttggttgcttcaaagcttagaggctatttaatggaaaagcaaaacaaaacaaaacaaaacacccgtcctaaataatttgcaggatgtttagaaacataaagagtaactatgtgtgctgccattgggatggctgcactctctgcctcttagctagtcactctgtcagggtatggggaaatgagacaatattgagaatgacaacttgagcaaattgtgcagtaaggaaatgaaaagctttatccaagtcactttttattgtactggtgctatggaaaatgtggtgaatgaacatagttgtattttagtactgaaaaaacaggacaggtgaagacaaatttttaaagaaaggattgtaaatgagttagaaaagtgagaaagaagatacaccaaaaatgtgaaagagtaagactgcaggcgtgataaaggacataggacatcaggagatgtatttatccctgctgggccagaaaccaggacattgaggtaactgagacattaacataacaataacattgataaatcacctaccccttaagggcccacatgtgttttcagcaaaaagagaaatctgatctagagaattattacatgtctttttgtcctgaatttttttgatgtattccataacaaagaatttttattgcatccttagttacactgccagccaatgtggaggcagtgatcacggacaagacaaacatggttcttccctcgtgcagtttattgtccaatgggggaaatagtaaacagtaaagaaacaattatataaaatattacaaaataaatttaacaagggctgagtgaattattctgctatagagatggaacagtatatggaaagctcccaaggtacataaagtggttgttgttttctctttctagaagagaatgctgtgggtggacaatatacagataaggttagagaggggaagcggggactaactcattcaggaccttttacgtgatagtcaggaagatggctgtagttctaagtacaaggagcaccgattttaaggagagacattttatgacgatttacattttaagatgattttagctgctgtggagatgtttggaaagggtcaaaagagaaagtaggctgacccattaggaaatgtttgcagagttcaggtgagatgatagacacctggactagcctggtattggtggagagggatttatgaaatatgttggagaacaggaattggtgcaggattttatgtcaaaagtgagggtcagcaaggacttaagaatgactcccaattttctgattggagcaactggtggataatggtggcatttacacatttccaggcgaatgggaccagctctgggtggaaaaagttcaggtttgaacctgtgaagtttgagatgtcacagaaagaggtcataaccatatccccttgggaagcaaaaagggaggctctccaggacataagtggatagactggtctttgataggtaaaattggtgattgttaatttaaggtgaaactaatgagctcagttttctggtttttctccagcaaccttcaccaacgtggatacagatacagagaaaatggatagctgggtccaggactagagttttgccaagcagatatgatggagagtaagagagctgaggatctttttaagggagtgactacaaatctagcctcggtttaaagagaaaccagagcaggctgaaggagagtgcaggatattaagcaattagagaggtagaggtcaacggatcagatttcttttgctgtttagaattatcagtgtgaatatttaaactaagattattggaagtcctggagacagtgcttggagatttcaggcagtgagtgactgaggtggggtagaggcaaaaattcattgtctccaatgagtaagtcaaggaaataagagcccctgaagttgaatggttcatccacttgaatgataaagtccaggaaaaacatgatagctattagggtagagaggatgaccatgtatatactgggagccagagtctgcagtcataaggaataaactagaagtcagtagaggacagcagtgaggacagcagtaaggacagggagagggtatggtgaagtaccatgagcttcaaaggagctgggtgtttgcaggagagacaatgaagaagagatgttcagatgtgggcttacaaagtgaagattacaccaccccacctcatggccctggagaattatgttttcttgatagcctctccaaatctgcaggttgtgaaatgtcatcaaaacctctgtggacagccctttcagagttgctgtcatccaataataaatgccctatttatgtgtgaaacaaattaggttctatttttcaaaagtaacatagcacaacaggtgccattcagcttcaggaatgttcaggaaatccttctaaactgaaaaccttaagaggctgtccagctgaatgtaactgaattccctatcaaaataatacattctcaagtattaaatgtgtacagcaagtcaaatgcccattcaagaaaacgatgtcattgacacagacttttagattgagctcccgaagttgaagtgttaaatatagggtggtgatattaccattattacacagcttcaagacttatttagtgttggaaactaccaccagagtcaagtataacctatttgtttgctgtttaacaaaggaaattgagactcagagaatcaaagtgattgcagaagcttaggcctgctctttcacccctacactatgaagacaaaactttctataaatgacatagttgttttttgtttttgtttgtttttgtttttgttttgaggctgagtctcactctgttgcccaggctggagtccagtggcgcgatcttggctccctggttcaagcgattctccttcctcagcctcccaagtagctgggattacaggcacctgccaccacccctgcctaatttttgtgcctttttagtaaagatggggtttaatcatgttggccagtctgatcttgaactcctgacctcaagtgatccacctgcttcggcctcccaaagtgctgagattacagacgtgagccaccatgcccagcctataaatgacatagttttatcagttatttaatttggattccttatgaataacttcaaaagaaaaggtatagacactgtggacatcacctgggagcttgtgaaaaaatgcagaatgtctaacctccctctagacctaaagaatctgagtgtgcattttaaagaggtccccaggtgatcatatttgcattaaagtttgacaagtgcctttctagtgagtcattcccttggaaacagtggtctgctcaggtcagcaggatcatgatgcctggagaactggggaggggatccccttgtagaacagaaagaagagatacagtcatggaaatattccgaattttgaatattatgaaacaacaggaacaaagtatgttgtgcaaggagtgacgcattttaaggaatggcattgcctttcccagaaagtgaagagaggaaattggaaaattgtgagtggaccttctgatactgctcctccttgcgtggaaaaggggaaagaactgcatgcatattattcagcgtcctatattcaaaggtaactactactctttcgcaagtgtaatttttcattactacaaacaacaacgtaaaaattaacataagtgagggtcagaaagccacatctactatcgccaaatgatgaaagtattagattgaattctgaatcttttactagagtgattttcaatcttggttgcataataaaacatctgctaatcttttttaaaaaatgctgttgctcaggatgaaccccagaacaattaagtgaaaactgggtggtaggggggtgacccgtcatcactgtgttttaaaacttgccaggtcattggagaatgcacctagggttgagaaatactgctttagtagctcattcagaagcagctctgagattgcagttctgctactccatgtgccaaaacagtgggactttccctcactaccataagcgtagtgccaagccaggtcagcaatattcaggtcaccctcactggccagttttcagaacattgagggaagtaggatttatttcttgaagaagcctgcttagactaacttttaaaacaaattgatacatgttacatatctatggggtacacatgagtatttgttatatccatagaatgtgtaatgatctggttggagtttttggggaatccatcaccttgagtatttatcatatctatgtgttaagaacatttcaagtcatctcttctagctactttgaaatacacagtacattgttactgactataggcaacctactttgctattgaacattagaacttacttcttctaactgtacatttgtatccatgaaccaacatctcttcctcccctcctcccatcaacacatccttccagcctctgatatctctcatgctattctctacctccatgggatccacttttttagctcccacacatgagtaaaaacatgtgatatttgcctttctgtgcctgggttatttcacttaacataatggcctccactcctatccatgttgctgcaaatgacacgatttcattttttaaggctgaataatatttcattgtgtatacataccacattttctttatccatttgttgatggacatgtagattgattccatatccttgctagtgtgaatagtgcgcaaaaaaaaaaaaaaaaaaaaaacatgtgaggacgggtatctctttgatatactaatttcttttcctgtagataatacccggtagtgagattactggattgtatggtagttccatttttagtcttttgagaaacaacccctatactgttgtccacagaggctgtactaatttacatttccaccaataacatataaggattcccttttctctgaatcgttgtcagcatctgtcatttttctcttttaataatagcagttctaattgggataagttgaaatctcattgtggttttgatatgcatttctctggtgattagtgatgcttagcattttttcatatacctattaaccatttgtttgtcttctttggaaaaatgtctattcatgacctttacccatttttatgggattatgtgttttttattgtcagttgtttgagttccttgtatattctgaatattagtcccttatcagattaatagtttgcaaatattttcttctattcaataggtggtctcttcattctgttgattgtttcctttgctgcacggaagtcttttagtttaatatagtcccatttgtctatttttttgttgttgttgctgtgcttttgaggtcctagccataaaatctttgcctagaccaatgtcttcaaatatttccccaatgttttcttcttgaaatgaggggttttgggtcttatgtttaagtctttagttgaccttgcgttgatttttgtatatggtgagggacaggggtccagttttattcttctgcatacagatatccaattgtctaagtaccatatatttgaagaggatatcctttcctcagtgtatgttcttggtgcctttgttgacaatcagttggctgtaaatgtgtggattttttttgtggattatctaatctgttgcattcattgatctgtgcatttgtttttataccggtaccatgttttttcggttactattgccttgtaatatattttgaagtcaggtagtgtgatgccttcagctttgttctttttgcttaggattgctgtagctattcaggatattttttggttctatatgaattttaggattgtcttttctaattctatgaaaaatcacattggtattttgatagggattgcattgaatctgtgtattgctttgggcagtatggtcattttaatattaattcttccaatccataagcatggaatgtttttccattcgtttatgtcatctttaatttttttctacagtgctttgtagttttccttgtagcaaactttcacctccttggttaaatatattcctagttgttttttgtttgtttttgttttttttatagctattgtaaatgggattgccttcttggtgtctttttcagcaagttcattgttggtgtatagaaatggtactgatttttgtatgtcgattttgtatcctgcaactttattgaatttatttatcagatctaagagtttttgtgtgaaatctttaggtttatctagatctaagatcatatcatcagcaaagagggataatttgaccttcctcttttccagtttgggtaccttttattctttctctttcctggttgctctggctaggacttccaatatgatgttgaatagaagtggtgaaagtggcatccttgtcttgtttctgttcatagaggaaaggctttgagcttttccccatttcaaaataatgatagctatattattattatatagatcatataagcccttattatgtgaagcatattttttctatccctagtttgttgcaagttttatcatgaggggatgctaaattttctcaaatgttttttctgcatctattgagatgatcatatggttattgtccttcattctcttcaggtgatgtatcacagttgttgatttgcatatgttgaaccatccttgtatccctgggatgcattcctggaataaatcccctttgatcatgatgtgtgtgtgttttttttatgagttgttagatttggtttgcttctacagacacacacgcgcgcacacacacaatttttaggagacagggtcttgctctgttgcccaggagggagtgcggttatgcaatcataaatcactgcagccttcaacttctgggctcaggtgattcttctgcctcagctcccgagtactaggacttcaggtgtgtaccaccacacctagctattgtttaaattttttgtagagacgagggtctcattatgttgcccaggctgggcttaaactcctggcttcaatccatcctcctgcattggcctcccaaagtgctgggattacaggcataagccatcatgtctggcccttggtttgctagtattttgttgagagtttttgtatctgtgctcatcaggaataatagtatgtagttttcttttttgttgagccttgtttgcttttggtgtgaagataatgctgacctcatagaatgagttaggcagaattccctcctgtttaatgttttggaagagtttgaagagaattggtgttaggtctgttttgaaagtttggtagaattcggcagtgaagccatctggccctggacttttctttgttgggagttttttaattactgcctcaactttttttgttactggtctgtccaggttttccatttcttcccatttcaatcttggtagcttgtatatgtgtagcagtttatccatttcctctaggttttccagtttgttggtgtatagttgttcataatagcttctcatgatcttatgtatttctgtggtatcaattgtaatgtttccttttccatttctgattttttattggagtatttcctcttttttcttggttagtctagcaagtgctttatcaattttatcttttcaaaaaacaaaactttttgtttcatccatcctttgtattgttttttaagtcccaatttgtctagttctgctctgatctttattattactttccttttaccaatttggggtttggcttgtttttgcttttctagttccttgaggtacatcattaagttgtttatttgaaatcgtaatgattttttggtgtaggtgcttgttgatataagcttccatcttagcactgcttttgctgtatctcatgggtttcagtgtgttgtgtttttatttttatttgttgagggaaattttttgatttcttccttaatttattctttgcccccgtagtcatttaggagcatgttgtttaatcatttatttttacagtttcaaaagttcctcatgttgttgacttctagttttattccattgtggtctgaggaagtacttgatatgacttcgatttttaaaaaatttgttgaatcttattttgtgttctaacatggtcattcctagagaatgtctatgtgctgatgagaatttgtattctgtaactgttgtataaaatgttctgtgaatgtttgttaggtccatttggtctaacgtatagtttaaattcaatgtttctttgttaattttctgtctagattatctgtcagatgctggcaggcggtgttgaagtccccaaatgttgttgtattggcgtctgtttctccttttagatctgataacactttatttatattaatatatctgagtggtctgttgttgggtgtatatatgtttagaattgttatatcctcttgctagaatttatctattatcattatataatgaccttcattgtctctttatactgtttttgactcaaactgttttatttgatataagtatagtgacttttggtttccatttgcatggactatctttctccatccctttgctttcagtcttatatgtgtttttatatgttagatgggtttcttgtacccagcatatacttgggttatgattttttatctattactagtccatatcttttcagtggaaagtttaatccatttgcattcaaagttattcaacaatgaaaacttcccaagtctagtgagagatgtagacacccggatacaggtaacttagagatctccaaacagatacaatacaagaaggtcttccccacagcacattatagtcatattgtcaaaagtaaaagacaaagagtgaattctaaaaacagcaagagaatgaccagtcacctataaaggaactcccagcaaaataaaatttttacctgttcacattctgatttacagaagggatttgaacttgctttgtaaaataagcagataattaatgttgttttgtttttgtttctgtttgaaaaagtcttgatcatcatgagtgttagatttaaagattttgcaattcttatattttgggagatgctgcagtatatactcagaagaactccaggctgggatataggaaacttggattcccttgtgtgaatctagcaacctttttcacccttagataatgctcatgattaccattaactttcgaatgaagtgagcatggatttcattacttctggtttttttaaccactcctgattcccagcatagctagtgacatctccaaatggatattgacaggtttttttcctaccctggtacctctgactcctgcctgcctttctgggtgcatggaccacaccaagggagtggtctatcttgaaaggtgtgaaatgaaacatgtaattgatttaaaaatagtaaatgttcttctttcccaggatcgggtgctcctaggtaactctgaggagcaatgaaatgaccaaagaaaaaggaataatatactactttgagtacaactgtaattgttacaccttgatacttataaccccccaaaaacaccctttcctaaactccttacatgcacctaaataacacatgtcttagctggacaactacctggcttccctattttctgtctttatgtccttggataaattaattatcttctgcaggtctcagtttcctcatctacaaagtgggtatgacagtattagcacctgtctcttagggtggttgtggggattcaatcagttaatacataaaaaccacaagagagctgaaatacattatgtcctatataagcattaagtaatattactataattattgtctttctaaagtttaacatactgatgtatttggagttactggatgtgactcatttctagggtaaaaagttgaattttcctggctgtagtcatttcaaatttcatttagtaaaaaccccaacttttttttgaaacattccacctgtgcctgtaaagtccattaaatcctctgaaatggtccacatctgctatgagcatagaagaaattgtgcaatgagggtagaatggaagagtatttttctttcagacccaatttcgacactaattcatggcaacctgatttgtattcttgagcaaattattccaaatatgaacatttcagatgctagtctctcaactaaaaaataatttgagagatttttccaggaagaataactgcatcatagtttatgcagccaacaaatgaaagggtgtcatgttgcggtccaaagggcgtgggtggatgagcagaaagaatacttgaagggctgtaggcaggtgaaagatgattttattcaacagcagctctgatcaacaactttctcacactgtccatcctgtctcagctgcttagtctggtggctcccacacacacagctcccttgccttcagggtcagcagcttaactatttctctctctgggcatgggcaagccaagctgggtcctgactcccccatctgtctgcaaagacagacagctctgactctctgtctctgagcacaagagtgcctctacagtgtccacagggcaattataccttttacagacaatagtggcttagagccaagtgatgagttttccctatgtcatagcgatggtggtgagcttctgttatgtctacatggctatgataacaagtaacaagtgaagttatatgcttgcgctctgaactcactcactctggatgtttacctctgcctgtccttgaccaaagcacagccatgttctttacaaaggggaagaaaaagatttcatacatattatataatttaagatcataaacatgttactaatcctttttccataggtaagctatctttctcaatgatacattgtaagatgtagggtgaatgatagaagtccatggtatttactcttttgttatattttgatgcctatttttcttaagatattatttaagtgccaggattcattgttagctaatttgtctagctctcatttaatgataaagtcactagctactgaagtatatagggaactttataacctctaccccaaatgactttagacagttttggtttaaatggctttttaaaaaatggtttttctttcttctcttgtcttgtgagccatcacttagtatcacagtcctctctgcctccagcagcatttgtgatttgctgcctctgatctgctcaaaagctgggtaatcatacttgttacaagtgtgtttttccaaaaagttctgagtgaaaacctcagtcccttttttcatgtgctctagtgaggtaggaggcagaacttgaatccagaggcaaggttcagacactggaccaaactgaggtcagggcagaagcacctccccataagacatgcccatcagtgtgccatgtcagttcactattgccatggcaacacctagaagttaccacccctttccatggcaacagcccaacaacccagaaattaccaccctcatcctagaaatttctgcataaatcaccccttaatttgcatataaatcaagtaggtttaaatatgactgcagagctgccactgagctgctactctaggcacactgcctacggggtaggcctgctctgcaaggagcagtacctctgctgttgctgtaaactgttgcttcaataaacgttgctgtttaacaccaccagctcgcccttgaattctttcccatgcaaagccaagtagtctcctgggctaagcccccatttgggggctttcctgtcctgcatcactagtgccttgctgctcaaagaggggtctcagaccagcattggtattgctttcattagaaatgcagaatgttgagcctccctccagaactactcaatcagaatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactgggaaaataacgtgaaagtcatccagttcaacttgagaataaagcagatggggcactctgtcaacaccattgtggaacaagcttttataagtaaacacataaaatatgttttaaaaatcttttaaatgtgcttatgcattacaattaagcatgattataaaacacttttattgtttttgtccataaagacagttgattagattccttagaaaataagtttcagtattatatcattgtatgctgtatatcagtcatgataaccatttactttccagtctttattttaatgactggtaaaagaacataggctcttctacaggctatttctgaatccttttttctcttttgcatatccaccaaagtttagcagtggatatagaataagcaaattagaaccaggacctgtgagacaaacctgaatttaataatatgcccatatttatgccaattttaaatttttaacagaaaaaaatgtggaacagtgattaaattccaaatgagctacagaaatagtctaaatttgtattatgtagcatttgtgcctttattttgagtgtttggtttatttttagacttattataccgtattataatttatacaaaattttttccaaatgagtttttaaaaaagtttattccaccattgtcacaactgtaataaattaatttagaatacttttttcttatttgtgttataaaaggacctctattttaaaagttcataaatgattatataatattcattcaaataggatttgtcattcatctggctaatgttatccaagattaataatccaaagagtgttatattgtcaccattatgtaaatagaaacatgcaaatatttctatgtggtctattttagagtccttatacaaacatcttcagggatatatttaggaatttgttttccccaaacattacttggagactctgtagcaatatttttctagccctgaatgaggtggcctacccattagtaatagtagctcactccagtaatgaacttggtgctcaataaatacttgttgttgtaggctttcaaactattgaaatctgttagatactataatatagctgaaaattcaacaagtatttattcctcaaggtcatcacaggtgatggtccgtaagtggagcatgcgattgctaccatttttataaacaacaatggtaatgctgagtctttttgttttttccacaggtttatatatgcagcaacaatattcaagcgcgacaacaggttattgaacttgcccgccagttgaatttcattcccattgacttgggatccttatcatcagccagagagattgaaaatttacccctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatggttttcctccataattcccaatccacaaatgtaatttaaggggtttccctgaagctgtttggtgtagcatttctccatgaaagccaagaacattgcaccaaaacaaatgtgtaaaagcatctgcattttgtaaggatcgaaggcatcatagtccaagtatgtggcatctagtacttaagcttgtttcaacaataaaacctaaaataatatttttctaattagtagattgataacctttaaaccattcactccctgaaaaaaaacttctcttaatgggatactaaggcttttattgttgctcagtcagctcccttgcctccttccagtcatttgcccagatctcaccttctcagcgagtcctatgctggataccatcttaaatgccgctgcctctgccccaaccagtattcccaatccttctgacttaccctgctctacctttctttttttaataacacttaccatcttctaacacacttgatttccatgttaaaaatacatttaccagtgtctgccttcccccaacagaaagtaagttcatgagaagagggatctttgtctatctttttcactgatgcatacccagtgcctagatttgagcctagacattgtggacactcaaacagcccatttgtggatgaatgaatgaactgggagagcaggtagatccaggttgtagtctccgagtacactgggtagtgctgtttttctgtattgtatagatatcaaataagaagatggtaagaactctgtggcctctttcaagatgatggtatgattgccttagggaactaatagctaagaagcagcttttcgttgttaaatttcaagtatgttttgttaactggaattggacaaagttaaactgttgttaagttagaatctgttttccattaatagatacttatttaaatcaaaaatttcagctgaaggagtccaatacttgatttatactctaattatattctgaatgtaaatagaacttctaaaggtagtccctacacaaaataccacaaattcagagttcaccgtctgacttgattatatacacattatcaatgtaaggaaaagacatttggaaaaaatactgcatataaatgacacaattggatagttggggatcatattaaatgaggcagttcaagtggataaatgagctccattggcctttatagctagggaaatcacagctttctaggaagagaagatgagaagaaagataaaacagagatatattattcatgtgatggaagaagatactgacatagtttagaaattccctgaccggatccaagttgaactaaggccagactatatcccagatattcaaccaagtttaaaccagcttgtaatagtacttcaaaactaagtttaactgtcagtaacttcttttgtgtcaccctagaaccaactactaggtattttatggtgttggattccagagtccctgtaatgatgatggcaaagctttgcccctctattctagcacgtatacaaggaaagagaaagttttgtcctccttttgtttaattctcttttcccttacacctggagcagtatcatccagtaacaggttctctgtaatggtttgttagactaaattagtacaacttaaatacgtccatatatgaccaggttcttcttatgccaagagtgaactctgtgctgaatcagttaatgttctactaaataaaggaaattcacattcgctttcttgttaggttcatgcaaatattgaaaactcttggaatgaggaagaagtttggagaattgaaatgtatatctcctttggcataatgagccttggcttactttccctcctggcagtcacttctatcccttcagtgagcaatgctttaaactggagagaattcagttttattcaggtatgtggggttttgtttggtgaaggattgtgcaggataggatttccttgttaagaacaactgcattttaaatatgttccttattaaaagggtgcctttgaggctgtatttatgcatctagatacattatgctggaagccagcttaggattgctctggttaaataagtgaaagaccagtcagtatatgattgtactggaagactttgacagcactgccttccagtatactatgttaagaacaaaaaagttatcttaaaagagaaaaaaaaaatgaaagttgggaaggatgagcttagatcaaatttaatgttgaaagtcaatttattattagccaagtgaatgaaaaattattttatgttttgagtcatcttgatttgtccagaaaaatcttattaatttgaactcaagtggggatgtcaatctgaatattttaaagaaatgtgtgtatatatacacacacatacaaacacaagcagtggcaaactaggtaactagagtaatggattataacatgcaaccagccttaagaattttgttagtatatcagtagtatactaatacgtatggatgtctgtaaagggatttcaaaccaccattgtattctttaataagttaaacattcaccttctccaataatatctaaataataaggttgcatattttaaaaatatataactgaaacatagacccttcctatattttcacaaaatctgtactggttgtatccaaatggtttacagcatagtagacagattcatgtcctttggtggtacacttaagttttgtttcaattcattgcttatttgcttgtttttttttttaaggtcctgtaaaaatctcattcaaagcagggccaaaatgcttatctgaatttatttttcctttttgaagaaaagggagagtactttcccaacagctagtttaatcatacccgaaaagaaatagaaggttctagacagatgcaaattatcattataaatttagatgagtaattgcaaatattttgcctgctggagggttgatattttccagtaaagttagacattacatcactatactgatgtaatattacttttatataacagactattcttcaaagtaagcactcttaaacataataatttagcgaactaaagaatgatgagcttttagaatttaaactgtaaagtgcctaactgaagtattcttaataaactctatattttaattgttgtttatattaatactgcaggatttttcatatttgcctattaaccagtgtgtatatatgtgtgtgtgcccatgaggatgctcatttaattttaatttaatttaattaattttaataattttaaattagtttatttaattttatcatatgtctgtttatgtattaacagtgatgtgttacctaacagtagggaacgttctgagcaatgagtcgttaggcagttttatcatgtgaacatcatagagcatatttatacaaaccatgacctattgctcccaggctacaaacctgtacagcatgttactgtactgaatattacaggcacttgtaacacaatggtaaatatttgtgtatctaaacatatctaaacagagaaaaggtacagtaaaaataaggcatataatcttatgggaccaccgttgtatatgcagtccatagttgaccaaaatgcccttatgtggcacatgactatatttatgtgtatgtgtatacacacacacatacatacacatttctttaatacacaactggtgggaatgtgaataatttttataaagaagagtctagcagtatgtatcagtacccttaaggaaaagctagatgttttgaccaataatcctactattagaaaccagtcctaagaaaataaatcaaaatatggaaaatggcctaacatgacatttatagttgaggaaagttggaaacagtgaattatcaacaaaaaggaatggtttaataaattatgcacatccattcaatagaatattatacagtattaatgtcattttcatatttaatgacatgaggaaaatgttcttgataaaataaatgaagtagtaagaatattaaactgtatgcagtagggccttatttgtgtaacataaggtgtgcatataaataatacatatatatgcatatataaaaatattaatattatttaattcagtagaggacaaaggttaacttgataatttaagacaaaatagttttatcaaaatataaacatggtgtatcttgatagtttaatttatgagtttcagtcatttgtttcttattctttgtttcttttccttcctctcctggcccaagtctacacttggatatgtcgctctgctcataagtactttccatgttttaatttatggatggaaacgagcttttgaggaagagtactacagattttatacaccaccaaactttgttcttgctcttgttttgccctcaattgtaattctgggtaagattattttattccttccatgtataagccgaaagctaaaacgaattaaaaaaggctgggaaaagagccaatttctggaagaaggtatgggaggaacaattcctcatgtctccccggagagggtcacagtaatgtgatgacaaatggtgttcacagctgccatataaagttctactcatgccattatttttatgacttctacgttcagttacaagtatgctgtcaaattatcgtgggttgaaacttgttaaatgagatttcaactgacttagtgatagagttttcttcaagttaattttcacaaatgtcatgtttgccaatatgaatttttctagtcaacatattattgtaatttaggtatgttttgttttgttttgcacaactgtaaccctgttgttactttatatttcataatcaggcaaaaatacttacagttaataatatagatataatgttaaaaacaatttgcaaaccagcagaattttaagcttttaaaataattcaatggatatacatttttttctgaagattaagattttaattattcaacttaaaaagtagaaatgcattattatacatttttttaagaaaggacacgttatgttagcatctaggtaaggctgcatgatagcattcctatatttctctcataaaataggatttgaaggatgaaattaattgtatgaagcaatgtgattatatgaagagacacaaattaaaaagacaaattaaacctgaaattatatttaaaatatatttgagacatgaaatacatactgataatacatacctcatgaaagattttattctttattgtgttacagagcagtttcattttcatattaatatactgatcaggaagaggattcagtaacatttggcttccaaaactgctatctctaatacggtaccaatcctaggaactgtatactagttcctacttagaacaaaagtatcaagtttgcacacaagtaatctgccagctgacctttgtcgcaccttaaccagtcaccacttgctatggtataggattatactgatgttctttgagggattctgatgtgctaggcatggttctaagtactttacttgtattatcccatttaatacttagaacaaccccgtgagataagtagttattatcctcattttacacatgagggaccgaaggatagaaaagttatttttcaaaggtcttgcagttaataaatggcagagtgagcattcaagtccaggtagtcatattccagaggccacggttttaaccactaggctctagagctcccgccgcgcccctatgcattatgttcacaatgccaatctagatgcttcctcttttgtataaagtcactgacattctttagagtgggttgggtgcatccaaaaatgtataaaaatattattataataaacttattactgcttgtagggtaattcacagttacttaccctattcttgcttggaacatgagcctggagacccatggcagtccatatgcctccctatgcagtgaagggccctagcagtgttaacaaattgctgagatcccacggagtctttcaaaaatctctgtagagttagtcttctccttttctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaagacagagtcttgctctgtcacccaggctggagtgcagtggcacgatctcggctcactgcaagctctgcctcccgggttcacgccattctcctgcctcagcctcccgagtagctgggactacaggtgcccgccaccatgcccggctgatttctttttgtatttttagtagagacggagtttcaccgtgttagccaggatggtctcgatctcctgacctcgtgatccgcccgccttggcctccaaagtgctgggattacaggtgtgagctaccgcgcccggcctattatcttgtactttctaactgagccctctattttctttattttaataatatttctccccacttgagaatcacttgttagttcttggtaggaattcagttgggcaatgataacttttatgggcaaaaacattctattatagtgaactaatgaaaataacagcgtattttcaatattttcttattccttaaattccactcttttaacactatgcttaaccacttaatgtgatgaaatattcctaaaagttaaatgactattaaagcatatattgttgcatgtatatattaagtagccgatactctaaataaaaataccactgttacagataaatggggcctttaaaaatatgaaaaacaaacttgtgaaaatgtataaaagatgcatctgttgtttcaaatggcactatcttcttttcagtactacaaaaacagaataattttgaagttttagaataaatgtaatatatttactataattctaaatgtttaaatgcttttctaaaaatgcaaaactatgatgtttagttgctttattttacctctatgtgattatttttcttaattgttattttttataatcattatttttctgaaccattcttctggcctcagaagtaggactgaattctactattgctaggtgtgagaaagtggtggtgagaaccttagagcagtggagatttgctacctggtctgtgttttgagaagtgccccttagaaagttaaaagaatgtagaaaagatactcagtcttaatcctatgcaaaaaaaaaaatcaagtaattgttttcctatgaggaaaataaccatgagctgtatcatgctacttagcttttatgtaaatatttcttatgtctcctctattaagagtatttaaaatcatatttaaatatgaatctattcatgctaacattatttttcaaaacatacatggaaatttagcccagattgtctacatataaggtttttatttgaattgtaaaatatttaaaagtatgaataaaatatatttataggtatttatcagagatgattattttgtgctacatacaggttggctaatgagctctagtgttaaactacctgattaatttcttataaagcagcataaccttggcttgattaaggaattctactttcaaaaattaatctgataatagtaacaaggtatattatactttcattacaatcaaattatagaaattacttgtgtaaaagggcttcaagaatatatccaatttttaaatattttaatatatctcctatctgataacttaattcttctaaattaccacttgccattaagctatttcataataaattctgtacagtttccccccaaaaaagagatttatttatgaaatatttaaagtttctaatgtggtattttaaataaagtatcataaatgtaataagtaaatatttatttaggaatactgtgaacactgaactaattattcctgtgtcagtctatgaaatccctgttttgaaatacgtaaacagcctaaaatgtgttgaaattattttgtaaatccatgacttaaaacaagatacatacatagtataacacacctcacagtgttaagatttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaatatattatcttctttttaactgtgtaattggtaattactaaaactctgtaatctccaaaatattgctatcaaattacacaccatgttttctatcattctcatagatctgccttataaacatttaaataaaaagtactatttaatgatttaacttctgttttgaaatgttgtatacacgtggatttttttctcattaaataataattctagtatttgatggaggccttctaatacttttctgagttatttcttttcagaagcatccagaaagcaatacatgtgatagttatggaggggttttgtttgtttttactaaaatagtcatttagaaaaacctccatttacatttattttattacattatttcattttactagcattcattaagcatctttaaatcagaacacacacaatattcaagctattctgtaaactccccgtagcagaaattttgtcttatttactactaaatccccagtatctagtataatgtgatctatgatggatactaaagagatattataataaataattacccatttttacagaaaattatgttttttatcatcccgcatccatgcagccatgcctacatcctcttgcctcttcctcatgccttgcctcctggccagtggcctagcgctaccctgttgtcctaaagagtttctgctgctgctgccactaccaccaccaccacactgctatatgttgaggagtcctgtacactgtgccactgacaaggagtaactgacctttgtgcctgtgcaccagatctgtctgtggaggttctggcttccccagctgctgcctggaaatgcttaggtgctaatatcctgagaggaggattgtcaggtaaaatacaggactctcagttaaatttgaattgcagacaaacaataaattactttttattataagcatgggctttttaaaatttttctaaatctggcaaccctacttaaggagtgaactttgatcaaggaggtacagcacaaaatgaagctagtagataaattctcccttcctttcccccagataggctgttctaaagtgcaataattcataagaccttcatgaaaatatcctcaaagaccgagcaattaactgcacttgttgcaaagctatgacaagctcactaacacctgtgtttgtgttcccttctcctactgcctcacttccatgtttttcctcacttctgtttctcagagatagtactccccatagagtggcagcaggtgagtgttggtgttgtttgtttatggcaggcttggggaacctagactagtacagtacttttggtagtggattcttctaatgggaagtgaaacaagagacaaatgatgactttgagaaagtcaggcacgggaccctgcagactcaaaatccagatttgttgagacccctgagagtagaaaaacccctcaggggcagattcacattgatcaaatgtacagtcatacactgttaaatcaaaatagtaactcagcactactgtgtgaaatatcagtgtcctgtaggcgagaataccatttgtgccttgattaaacatactttattcttgaatctgctgtttataagaattgaagttataattcaaaagatactgggatctgttatgggctgaactgtgtttcctcaaaattgatacattgaaatcctaactcccacactacctcagaatgtatttggagataggatctttaaagaggtaaagtgaggtcatacagttgggccctaatccagtatgactggtgtcctcataagaagaggagattaggaatcaggcatgcacagagggaagaccacgtgaagtaaaagggagaagacggcatgccaaggagagatgcctcgagatgaaaccaatcctgccaacaccttagtcttcaacttctagcctccagaactgtaacaaaataaatttctgttgttaaagccacccagtctgtggtatttgttacagcagtcttcaaaaactaatacaaggttcatagaatcaaaacaagtcaatttagatatagaactcaaataattaatgtcattggaacaaacctgtctgattaatcttgctccacaacaaagacagttctatcctggggttattgcactataactacccaccatttaaacacaataaatagttgttctaaaatctcgggaacatttttttttcatataattattcccatgtcatggaactgaagctttgggtaaaagcgctttataaattcttcttttaattttttttactttcaatttgtttacttttccactaaacacgagtagttcctgcagcttcctacttaaaaatcacttgcagtttgggttattgttagtatacctttcattagaatggttgtcttcaggggtgactattcttttactttcgttttctgttccacgtgcttattcttcccaaatgtacattaatgattctgttggaaagaggtaattacttttgttttgtttttaggctttgtttctgtgctgtcaacctgaaaaagttttttaaaacagtgaagtataggctgggagcggtggctcacgcctgtgatcctagcactttgggaggccaaagtgggcagatcgtttgaacccaggagttcaagaccaacctgggcaatatggtgaaaccccatctctacaaaaaacaacaaaaattagccagacacggtggcacacacttgtagttccagctgctcgtgaggctaaggtgggaggtgggaggatcacctgagcccagggaggtcagggctgcagtgagcagagatcacgccactgcaccccagcctgggtgacagagtgagaccctgtctcaaaaaaaaaaaaaattaagtataataaattctggttttgtatgcatttcttctcttacagaatttccctaaagctaacctactaaaaactatgactagatttcatatgtgctataaacattctttatttaaaataaattactctaattcagaaaggaataacatttgcttgcacatttagaacatctggcattagagactataaaattcatatatagtctcaaatacttattagacatattcttaattcaagaatatataattattcatatgattagaaataattataattttactaaacattgctaattaggcagagtacaaacaagaaaaagtcagaaggaaaatagaaccacaatttgcaatatatttattttaaaacatttttagctttctttgttacttttaaaagtaaaacttgtaagtcaatatattattaaaactactagttaatctttaagtctacaggtgctactaagaaattgcaatttgtaacttaacagagatattaaattctgtagaattgttaccacattcaagcatttctattctgtaggtataactcatttcccatgtttctctgctatttatctttttgctgaaataatttactccttcagtagtcatttcaccctttcacccttctgtgtttttgtgtcataacagaagaatcactaaataatgattaaaattaagtcaacataccaaatataaagttaaagcttttatgaagcttaatctttgtgcacttaccaagaagaaaagtaaacccactattatttgggaacaaaggacttggaaaatccacgaatggaataattagtgaaaaccagttttatggatgctgttaaaactactccaaagcaataataatgacaacacacataaacatacacacacacacacacacactcacacacatgagcagtgcttctcaaattttgatgtgaggctgaggatcttgagagatcagaatctcagaatggagattctgagtcagtaggtccaccaggcggcaagagagtctccattcctaacagagtccctagtaatgccagtgcaagtagcccaaggaccccattttgagtagcaaggacctggagtatttaccttactttggataacttacaaaatgctttaatttggcttcaaatcaaaataaaaagtaatttataatccttgaaatcttttaatgaacattttttgagtgactagtatgatatggaccaggaagtcccaaagtatgttctccagaccaatagcatcaacattgtttgggaactggttaaaagcacatatccttgggcctcacccagacttactgaagcagagactctgcaggtagggcttgagattctgttttaactatttctccagacgattctgatacacattaggttttgaaaactactgctctagacagtatgctgagggtctggggtgcatatcaaagtgactctcaagaatctcagtacagtaggaaggggtccaattgctgaaccagttgataccattaagtatgtgatgagtacaaaaacggaatgacagacaaggttgcacccaacacagcaaaggatgtaaaggtttcctagaaaatgtcatgttaactgaatttcatagggattagccatctgaagacggtggcatgtacaacataatgcaaatgttatgcgggaggaaacctgctggcacctttcgaaaactgcagtaattcacccaagatggctggctgtggggtgtttgaagactcctctacccttgtccttctcacctgtccatgagtaaaacaaataccgttagagctagaaaaaaaaaattacaaagctgagtctattaacttgccaagcaagagaacttactccatgaagaatttcactgaggagggaaagtcaggggtttttaaatgttagaagtggggagcttatggggcttatgctaattaagcattggaaactggcactctggatatggggcagaatgaatatataggtctctacaccattggttaaataaaataaatatcccattgttcactagtcaggaaagtctcttcagttaggtccagtgaggaaggtgcctgtctaaggttactgaggcttaaagacccttatcagcttcagcctgtgctgttaaaatacaagagtcagttgatgtctcctaggcaagctctactttaagtggaaatttttcctttcccctccctcctcttcatctttcctgatcctgagatgctaggatgaccacacaaaggatatgcaaataatccaattgtcagctctctgccaccatcttggtttggggtgccattccacaggattccattgtattcatccaagtagtttcagtctcctttcgatgtggtttacttggactgtgtaacagcaatttaagtcatatgaataaaacacttaacatgctttgcactttccctaggtggaagcaaccttagacctactaaactgccctctagatgtaataaggcctaagaatggttctaaagatatctatcagtagctaggcagcagagtggtgcagcagaagcatgctgggcccataaagataccaatgagtagctgtagagatgaaagaaaaacaaaaagaatgtggaagcctaggcaagggggttgtaaaaagaggagaggggtcaacagtgtaaaatactacagactagtataacaggatgagaactgaaaaatgttaatagactttgaccccaagtgttggtgatctcacagtttcagagggctgaggatgagaaaagcggaagaatgactagaagtgtggaaacaggtgctagaaatgctcactactctcaacaaaacttggtctcttcggctaggatttacaatcaaatgctgccagtcctaatctagtgttaccatttttcttttagggccagaaatattcaacgtctgaggcagaaggaaccttcaaaatcacttatcaacctcattctagaaatgaggagagaagctctgagaagtgaagtaatatttattttcattgaatttatatgtaattttaaattcataaattctatggaagatacaaaaatgcacgtttaaatcttgaataatttttgaaagtttaaaaaacagattaaaagagttagagttttttaaattttcagttatggtgtttgagttattaaattatactgatgatcatcatgagaagctttccattatagtcttgacccttcttgtattattattcagtctacaatggataggcaacaacatgtcaactgaaaaatcataagatctataaatttagaaaggagactttgtttcttataatgagttacaacctgcaggctggccattctgcaggctgggaagcccaggctcccacagagacagtcaacaggcactttgaaggaggtggggttggagcagaagctttatgctgaatgagttggctaaacagacatattcaacagattgtaagaagagctgtgaatcttcactaagaggggtgctgaataaacatgcatgtgacatgcatcccatgctcactgtggagtggaaacttaacatttaaatgcattacagtccctatacatcaaaaggagaagcagagacatgaatgtactagtgctcagtctctgtaaacctgccagaaccagtccatagtgggtggtcttttatcaggggaaagttactgaatcggtcccttgtccaatcaaacctgcagttatgacttgtggaacaggagggtcttgttagtcaacatctggccatggatgagctgcaattatttcaatattgcttatgtcgagggcagttcttatttaacagctagagaaaaataaaaacattgcagcagttaaaacaaaggttattctttaagtgtaggtgtgagtgacttaactcttgcctggcatggccttaggtcttgcttataatttgttattgccacagagtccattctgttagccttctgatctccattttaacattaatgctggtcagttgttgagtctaagccctcaaagggagggggagccgagcttggtggcatgtgcacctgtactcccagctattcccgaggctgaagcgggaggatcgtttgagccagaggttggaggttgcagagctacgatcctgccactgcactccagcctgggggacacagtgagaccctgtctcaaaaaaccaggggtgagggggacgtgaaaagggaggaggtaggggggtatagcgaggcgtgtccgtccttccgtcccgtcagggcgaggaattcagcttttaaggtttatcgggggtcctcttggccaaaagggggtccgttcagtcggttgtggggcttaggatttaatttttagttctcaaacagtaataaagataatgataatcttgaccatacgggatgctgtgccaagcaccacttaacaaacactgtcatctcattcaatcctcacaacagtcctattttacagatgagaaaagtgagacttcaagggataactcgctctagattcaataaactgactcaaaagccttttaacattctgtacaataccttttatgtttgtttatttaactgtccagttgggccactaaagtacagataaaagctggggaatgtaagcgagactggtcacttccctggggtgagagaaacgctttcaacactatccgtccatcgtatcacgcctaacgtatcccatagacatccctcacccctccacccactcatgcctgtttgaagcaagactatgaagaccgaaacacaccgggagcctaaggcaccactccccgctacctaccgaggtgcatcctgcaggctccttaccgcaagcctgcaaactcgccctgccgggcgcggagtgcaattaggctttggggtggtttggctctccggctttccgtagcctctggccccgccccctagcaacgcgctggcttgtgttaacaaccggcccgggatcagaggtctgggtcaactggggggcggcagcggcgctaagcggactgtatggcggtggcctaggcccctggcggaattttgggacctttcgcgactctagcgactctcaggctgccttcccttctcggtggcggggcctctttgggcccagcggctgcgggcgcactgtaggacaggaagatccccccactctccaccccgccgccaccggccatgtggacagaggaagccggggcgaccgccgaggcccaggaatccggcatcaggaacaagtctagcagttccagtcaaatcccggtggttggggtggtgacggaggacgatgaggcgcaggtatgagcaggtgtctgtgctttcagaggtggagggggtgggagtgaagtctcgagacggggtccagacctgggggtggcaagggtggaactggggacaggagtgaagatgggggaagccgcgggatggagattccaagcgcagagctaatcctgatcccccaccccctgcgaactgcaccggttgcgaggggctggctgttgtcaaccatcctgtctggggaccagcgctgtgtggtcctcctggagggtcctagcaaactgagtaggcggggttttgccgcgcttcttcgaaaagtggtcatagagctacagggaggaaaggaatcattcttagcaaaatcttgatttgatgacctgatcagtttgaactgaactttttaatacgtagatccctgttaccgagtgatgttcttgatatagatgtaaattttcccatgcttaaatttgctgcgactaaagcctgcacccagaggggaggaaaacgctgttaaattagaaattaagcatttttaaaatatgaaattggaagctggttgttacacgttgggtcggagagaaccgggagagaatagagttgatttgttttattatgcttgtactgtatttggttttgggtttgcttttgttatgaatacaaaattcactcttggaagttgatctgttgagaaattccatttgaggcccttggatctctattcgaggcggaggtgtttagaaaccccaagttgtttgtttcctactaggattccattgatcccccagagagccctgatcgtgccttaaaagccgcgaattcctggaggaaccctgtcctgcctcacactaatggtgtggggccactgtgggaattcctgttgaggcttctcaaatctcaggctgcgtcaggaaccctgtctcttgcgttcacatcctggagccttggagagttccttgggagtggtcagttgactggggaatagagttgagctctctgaggtctgacatttacgcagtaacctgcggagcaacagcattttgcatgaggagaaataggtgttaggggaatttgcctaatcgattttgtggacctattcccctctgggcggggagaattttgaggaacaatagctctccactccctgggctgcaagaaagatcaacaatacagccatactcccaggcaaggggcaaaactgaaaagtatgtgaatttgataactgatggctctcagtcttcctttacttgctccaagaaaaattgggcaacgttatacaaggcaagcaagcgtggatttttttttttttttagggaaaaatactttttaaaagccattgccaaaatagtccaaaacataccaaatgaaacaagtatacctgtgtatatgtgtgtgcattttctccccattttaattttctttcttttctttcattactactgctctttccagggcctaggattctcttccaagaagaaagcaatcaatttgcattaattcatgtttctgacttgttaattactaattctaagagtagtaacattttcgaagtactgaggaaaaaggtagtttctccccaaagaaatagaataggaactttttatagctgggagaaatcttagtgatcctcagccttcttgttttttgcctgtggttgtttttacaaatgagaaccctaagttcatgagaagttaactgagttactcagtttctttactcatagaatgggggtctagagaccctggaacgaaaaaatgataaccttttaggcctctgccttaggccagtttaggaaagatcctgggaactgtttccagttctttcaaaccactgcacatttgcaaacttctcttctgcctgtgtgtgcttctgagacagtatatcctagtggctaaaggtgagagtatcacaactacttcagttcattgtcagcttcatcacttaccagctatgtgaccaaagaccagtatcttaacctttctatcaaatggagataatgacagtactcatgtccattgtaaagattaaattaaataatatatataggccgggtgtggtggttcacacctgtaatcccagcactttgagaggctggggagggcagatcacgagttcaggagatcaagaccatcctggccaacatggtgaaaccccgtctctactaaaaatacaaaaattaggtgggcatggtgatgcacgcctgtagtccagctacttgggaggctgaggcaggagaatcacttgaacatgggaggcagaggttgaagtgagccaagattgtgccactgcactccagcctggcgacagagtgagcctccgtctcaaaaaaacaaaacaaaacaaaacaaaaagaaataatatataagcaaacttatacaataatatagagaacttatagagagacctatatatataattgaaaacaagcagttatcaacatcatcattgtcattgtcatcatcctttatccagggaactagagctcataaagttatttgggccttaaagctaagggattctctagaattctgattgttcccactggcttccaggatgtgagagtgagactggatgcccctgaaatcttacttgctttaatgcagatttcggtctgctcactttatcccttcagagatgtttctaagttgcagctggatttcctaatatagaaatgctactttggctacctgggcttttgatagctgttttatatcattttctttattacagacctaaattgaacctttcagttaccctaaccttagtttttagtaattaaagaaataggcttgaatattgctgcctaaggcagcaggtaaaatgtacgggttattttgctgatttttctgtgtgtatgctttacttctgcattaagtggtatttttttcctgcatctttcacaaaaataactttgtaaaaggcaatagcgcctataaattctatctaagctactacaaatgatattcacagagtattagatttttctaactttaataactttgaaatgttctctgatagaattatggaaaatgtaaatatagattatgagtaaagttattagtaaatagggaaaacaatagtttaggaatctgggattttgaattgttattttcattccatgttgtgaacttctcatagacatattctatgtaaacattatatcttcaaattttctctctataaaaattttgataatccctactgtagtgattccagcgtcttcttttttaaagtgattatcatacttttccagtttcgaaacaataaaatagtaccagaattttggtggccattttctaattgtgaggaacttaggacatgttgcttgccctttctgtgtctgtttcctcatctgtaaaagatatttttagaaatgcctacctcatcgaattattgtgagaattaaagtatttgtaaggcatttagcacagtgcccagcacatacattccaagtgccccataaatggtaactttctgctattattaatgactctagtcataacagctttattaaattattaaataaattcagatgatatttacagggttatatggtttggctttgtgtccccacccaaatctcatctcgaattgtaatccccaggtgttgagggagggacctggtgggaggtgattggatcatgggggtgatttcccccatgctgttctcatgatagtgagttctcacgagatctgatggttttataagaggttcttcctctttgctctctctctctctgtctttcctgccacctgtgaaggaggtctttgcttcccctttgccttccgccatgactgtttttcttgaggcctctctagccaggtggaactgtgagtcaattaaacctctttcctttataaattacccagtcttgggtgtgtcttcatagcagtgtgaaaacagactaatacactgggtatcaaaacctaccaaataggaagatagttctcagattgtttttctagtattaatcccagtgtttatgtggctctggcttcctacaggaaggtagaggtaatgtagtttaaagggtgctttatcccctggagagtgatgggattggcagtgaaattcaccttaatcatatgttgaaatcacaagatatctaatttatctattttctatttagttttgttcccctcattctaaagtatcccaaccccctttagagcagtgcttctcaaattttaatgtgcatatggagcacatggggatcttattaaaatgtggattctgattctgtaggtcttagatgaaccccagcactccgcttttctaacaggtttccaggtgatgcttgtgctgctagttggaggacctcatttcccactttgaataacaattaatataatgattagttgactggcgtaggtatcatgcctgaacttccttgctcaaatttgctctccctctgagaacccatgagaacttccacaatcttttagttgatatcatatcctgtcactgtcagtaatacttccatgaactgtgtgcttaaaattgtctagccttgtttatagggtttttgcaagaaataacctctgtagttggctgcatgtgtctatagtgccagctacttgagaggctgaagcaggaggatcgcttgagcctaggaattcaaagctagcctgggcaacatagggagacccccactctttaaagagaggagagagagagagagagagagagagagagagagagagagagagagagactccttggttgtccattgaggagtcaggcagagaactaaggaacaaagaaccagagtttctacattagacagacctgctggcccatttattattaatagctacgtggctttaacaagttaggtcccagggcctcagtttcattaagagggataatagtgctacctttacttggtagatttgaagactaattgagatcaaaaatgccagacacatgaaaggaccactataagtgttagtctctttccctgtaactgagtatcaaatgagcaggtttctccctctgaaatgtccctgggtaaagtgggaaataagttcatcctataatttgaatgaagtaagtctgattgtcttcaaagcaatttattaaacttttgatcttaaaaggttttgtgaatgcttttacaatttctccataaacatcttaagatgatagtattttggtatttacatatgtatgttctgttttgtttctattctctgcttgtgtgatctcatttacccaaaatcttcaattgtcacgttaagcctatgattcagaaacctctgccccaaatttttctcatctccaacccccaacacaaacctcttcctccagcattccctgtctcaggaaatggtgaaatcatttatgtaattcctcaagccagggaattgtcttcagctttttccttctttctcccactgcgtccagtaactcattaggtcttgatgaatctacctcttgatgtttttaattccatttgctgttgtctataccagttgctgctacctattcaaggcccaaagttacaatctacctccaacccagtcttctcccagtctacctccaaatcagtctcacacagcatacaagatgatcttttcataattaaattcttctggttaaatcttgtggaaataaatgaaggctaccacaataaacagagactgtttattcagcggttgctatagggagggattcagccactatcactttttggcagagactccaatgcagcctgggaagctttatagtggtaaaaagaaaggtgtgggggaggcttcaggtctactctaattgtaggttgctgacatgggaaagctagaggtggactagctggaagtagggtatcctctgtgattgacttggaaagcatatttggctttctctggttggtcttaagttggaagcagagggacaaaaaccgggaaagctggcagtcattggccaaatcctgacttttctgagccaattgcagcagaggttgttggccagagttattttgtcacatatagtctgaccagttttgtttatatgttcagtctcaaaccattcaatggctttttaagatccttgtgttacatacaaagccttctataaaatcccatgccagaccaatagctgcatgaggtgaggacattgttattccccacacctagcacaattcctgaaacaaaaaaaacctactaataaatagttatagaaggaggaaaagtctagggaaggtagagggagagagagaaatctttaaaaatctgccaagcaggtaaaactagagtaacatgaaatggataatgcaagataaatctaagaggaatctatgctttaatctttactactctctgttcttttaaaaattatacctgctcatttggagaaaaaatctgaaaatacacacaaatattagaaagaaaatcctgcaattggggtggcccaagtgcagtgctctttacagctaattgattacagctagttacggatttcttccttttccattcccactgcttcccttgattagccttaaaaaaaaaaatcctgcattgacatttcattccaatatccttgtctaaccttctaaacaaatatttcagaaaaccagaaaagaaaaacccactgtgtgtgtgtgtgtgtgtgtgtgtgtgtgtgtgtgcatgcgcgtataaaatctgagagtgtaggaggaaaagagaaaagacagctgaggtagtggtggatatcactgccaaatccccaaatcttaaaaggcagaagtctatttaccaaaattttttgtaacagtaaatttaactatttaacagtaatatttaacaatttttaatggtaacataagaccaggtatagattagtatttagtaaatcctttttaaaattattttaaaaagtaaaaatggctgggcatgttggctcatgcctgtaatttcaaaactttgggaggctgagactggcagattgcttgagcccaggcattccagaacagcctgggcaacatggcgacactctatctctacaaaaactacaaaaattagcaaagtatggggtggtgtgcctctgtagtcccagctgctcaggaggctgaggtggaaagattacctgagcctagggaggttgaggtaagcagtgagccgtgattgcaccactgcactccagcctgagcaacagagtaagactctatgtcaaaaataaataaaaataaatataattttgagtaaatgagctcattcagatacttactccacagacttaaagttagcatgtttcattacaaattgtttttgatgccatgacatctcagttaggattaatttctaaaaattgtttttgaaagaaatttcttgagatcagaatatatgaatttgtaatttttaaaggcaaggaaatactaaaactaagacaatgaataatgattatgtagaagtatggaaaagtatgtattgcagatttaaaactcagaagctgccatggtattaactaacactaagtgaaattgtgtaaaatacttatgcatgtaaggaaaaacaaaatatataaaaataaaaatagatgcatttactacatgataggaataagtaggattttttcgcttttgtttgtatcatcattacatcaccttttcaaacatttattttaaagtagaagtaagcgtgaaagcaggaaagaggatacaaaggaaactgggagagcttaactcctgtaatgggggtaagcactgtgacataaccctgaattaagataaaatgtcaggtagcaaggcattaacccccaagataaatatagtcaaaaccacacttagaatttgtagatccctgtatcatcataaatactttacctctgatcggattatttcatttttgttgttgttggggttgtttgttttgttttgttttgctatttgtatttgtttgtttgttttttgagacggagtctcactctgtcacccaggttggagtgcagtggtgtgatctcgaatcactgcaacctccacctcccgggttcaagcaattcttctgcctcagcctcccgagtagctgggattacaggtgcccgccatcacacctggctaatgttttgtatttttagtaaagacagagtttcatcatgtttgctaggctggtctcgaactcctaacctcagatgatccacccgcctcctcctctcaagcgctgggattataggcgtgagccatcacggccggccttgttttgctattgagttgtgttccttgtatattcttgttattaatcccttgtcagatggataggttgcaaatattttctcccattttttgggttgtctcttcactctgttaattgttttctttcctgtgggtacactttttagcttggtgtaatcccgtttgtctatttttgcttttgtggcctgcacttttgaggtcctacccaaaaaaacctgtgcccagactagtgtcctaaagtgtttccccaatgttttattccagtgacttcttagtttggggtcttatatttaagtctttaatccattttgatttgatttttttatttggtgagacataggagtctagtttcattcttctgcatatgtctgtccagttttcctgacaccatttattgaagagactgttctttccccactgtatgttcttggtacctttgtcaaaaatgatttggctgtgaatgcagggacttatttctgggttctctgttctgtttcattagcctatgtgtgtgtttttatgccagtaccatgctgtgttggttactatagttttgcagtatattttgaagtcaggtagtgtggtgcctccaggtcttttctttttgctcaggattgctttgggtgctcgcggtctactacttaaactttggatgatagtacccatttccttccccgtttacctatgaataactttattataatatagcctcttcttggttgcattttccaaatctttattaagcaactaacaatattatatgtcaggcccagtgttggatgccgggagtgcctgaaagcaaaaaaatttttgctcttgagagaactttggggcagggagtggtggggaacgaacatgtagaccctttcagaacaatgtgatgggaattttaatggatataaacttagggtgctatgagagcacggcatttttctagcctttttcatcctttgggaaggtaacacctgagcttcgtcttgaaggacctgtgggaattaaccaaggagaggaataggaatgtaacaacatgagtgacaacagaggagatgtgagaggcattaatggggagtcattgaatagtttagacgggtcatgttcagatttcagttttattgttctgatggtagaatagaggatggtgttgaagggtgcaagagtggagtcgacgagaacagcaggaaccccttgaaattaagtaagagctaaaaactgaataaatcagtaagatggaatggactcaagaaatatttaagatgtaaaatctgtagaacttggaggttcctgtttttttaatgtggatgactggaagaatgctggtactaactgagataaggggatacctagttgagaaaagcaatctcctacctatagtttagaagctactcttaccatgtatctgcataggcaaacttagtgtaatgtgtatacaagataattttatttctcaacttatggaagtactattattctaaatattttcttgggcccttcagggctgatgaaattttaaaacattaagattatacaaaatactagaattcaggaggggttttttactccaaaatctatttattcctgtgagttttcatctactgttcattctccccttactatcgtagtgtcataaaacattttttaagttaccaagggaaagtatcatataaattagtgtgttagatatgacttattgatatagaagatgatctagaatagtaagagttgtatgttttttaggatgttttcaagcctatggaccttaatcgtgtcatcaaactcctcgaagagactgataaagtgagtaagctttgagagaaaattactccgctgcattacttacaaactatttccctgaaaggtaacatatattccttcaaatgtaagtctcatttatctcgttttgttgaaaacattttaaatagtacatatcttatattcaaggactatttaaatttagtatgaatatatttaatgaagtggggagactggaggaagagaatagatttgcttttatgagatagacaaacccatggtggctgtaacagaaggaatcctaagagtacagaaaggatcatctagcctctgttaagtgcttgttacctagtaggattggaggacagaaatggtagaaaacagggtaccgtggtgtactaattatgaaatcaggatagatacacacaaacatgtacacatagataatttattttgagaacaatcatatataagatgtaatggaaattaagttattttagacacaagactcaaaattgggaaagcaggcattgagagaaaagacaacaaatgtatatgcacacatgctcatataccacctgatgttatcaagaatcgactgaatgcctaaaagccagcacacgctaggaacttatgtggtgatttccaaaaaggaatacgtattgttagtaagtagaaaatgagttgaccacaaatgcccatcaatgatagactggataaagaaaacgtggacatatacaccatggaatactatgcagccataaaaaaggatgagttcctgtcctttccagggacatggatgaagctggaaaccataattctcagcaaactaacacaggaacagaaatccaaacactgcatgttctcactgataagtgggaggtgaacaatgagaacacatggacacagggaggggaacgtcacataccagggcctgtcaggggatgggggactatgggaaggatagcattaggagaaatacctaatgtagatgatgggttgatgggtgcagcaaaccacatggcacgtgtatacctatgtaacaaaccttcacattctgcatgtgtatcccagaacttaaagtataaaaaaaaaaaaaaaatttttaagtaagtgggttgaccatagtatagcctatcaaaagaaaacaatgtcctatgaataggaggcacaaaaatttggtcactgttttaacattttttattctctgcttttttacatataaaggagaaaaagtgactattggaataatttatctttttctggctatcattgttgtgaaaagttattttttattgtgactatatctacatttccttaaaaaaccacaactgcatagagtgcctattagctgtttaataaggctacagagaaaaagtatagacaatatcacagcttttcaggaacatttaagattaaaaggacagacagaattcagtcatggaaacacatcactgtgtagaagttttacttgcttattttcatttttaattgacttaagatgtttggcttgcacagaacactgagcatattttagaagttaaaaatacaatctctacagtcagctttccaaatttgtcttctaacaccaccactttttagctgtgtattttggacacgttactttaaaatgtttcagcttgtgtttcctattctggaaaacagagatcatagtagtatcttcctaatagggtcattttggaaattaatgaagtgatatgtatatatggtacccatgtggtacatgacgtagaaaaaatattcaatgtactttagctgttgttaatattatttctggaaacaattactgcttttatattaacctggttttgattcccaatttcctaatcaaatttaaataatagtttatttttgatacataatgtctgtaaatgtttatggggtacttgtgatattttgttacatgcataaaatgtgtaatgatcaagtcagagtatttaggctatctaccacctctagcatttatcatttctatgtgttgggagcatttcaaatcccctcttctagctagtttgaaatatacaatacattgttgttgactttagtcaccctactttgctaacaaatattcactaacacagtcttcctatcttttgtaattatcattctagtctatatctccatgagaacaacttttttagcttccacacatgagtgaaaatgtgtgatatttgtctttctaaacatggcttatttcacttaatatcttctagttccatccatgctgctacaaatgacagaatttcattcttttttatggcttaataggattccattgtatatatagaccatattttctttatccattcatccattgatggacacttaagttgattctgtatctttgctattgtgagtagtgctgcaataaacatggaactgtaggtatctcattgatacactgatttcctttcctttggataaatacccagtagtgagattgctagatcatacagtcgttctgatagtttatttttaccttcactgtttcagaaaacattttataacgtttacattataatatagtaatttaagaattacttgataattttaaagtgtctacttttatgttgaagaattttttaaaatctcaacagatttaaaagcacaaaagaactaaaataggtgatctgttttaggatggcttggaagaaaaacaacttaaatttgtcaagaaactggtacagtgttatcagaatggacttgtatcctttacatatatatgtatgttcatttcatttattctgaaatgagaatttcttttagaaaatgtgttagttttccattgctgttgtaacaaattaccataaatttgatggcttaaaacaacataaagttattatcatacagttttggaggttagaagtccaaaatcagcctcagtggactaaagtcaagatgttgacagggctggtttctcctgaagactctagaaaggaatcatttccttgccttccccagcttctggaggcttcctacattccttgcctcatgccctcttccccccactggcatcactctcacctctgctgctgtcgtcacatcatcttctctgtctgaccctcccttcctccctctttcctttataaggatccctgtgattacggtgggcccacctggataatctagtataattttctcatctcaaaattcctaatcatatgtgaaaagtccctttgctatgtaacatagttacaggttccaggaattaggacatagatatcttggggaaggccattaatctgtctaccacagaaatactggagaggccattattctgtctaccacagaaaatatctaacattttatgttctttataagactgtattttctatcagataatgtaaataaaattgaagaaacaatataacacaagtaactgtggataatgtcagtttttgtcgattcagaaagacaatggatgtagttagagggccaagtcaaagtcattatttctattaatttacatgggcagttgtacctttgataagctctccacccttgtaaagtaatagaagctcatgaggttgttagcaagattagatgagatcatgtacatccaagtgcttgataatctgcaaaatattatataaatatattatccctactaaatatacgaccctgaccagaatacatgaaaaccagtgtgtcttaaaactatctgtacgtaaaagccaggtgtgatggcttacacctataatcccagcactttgggaggccaagacaggaggattgcttgaggctaggagttcaagaccagactggtcaacataccaagaccctgcctctacaaaaaaacaaatagccaggtgtggtggtgtgtgcccatattcctagctactgggaaggctaagacaggaggattgctgaaacccaggaattcaaggttacagtgatcaaagattttgacactatactccagtgtgaacaactgagtgagaccctgtctcaaaaacaaacaaacaaacactacctttggataagaaccagtttgttttgttttgttttggggtgtttgtttgtttgtttgtttgtttgtttttgacacagagtctccatccagccttagttgcccagactggagtatagcggggcagtcatagctcactgcaacttcaaactcctgggcttaagcgatcctctcacctcagcctcccaagtagctgggactacaggaatgcacccaccacacccagttaattctttatttttttgtggagtctcattatgttgtccaggttggtctcaaattcctcagctgaaacaatcctctcgcctcggcctcccaaagtgctgggattacaggtgtgagccaccacagctggccatttttttttaacatttacatatatatgctattgtaaaatacaataaaagtatcccacaaatattagattgttataaaagtttttatatgtccactctcactttatgtattcattttgtcacagactagtaaatatacttccagaactgacagtggtccatagaccacactttgaatagtattcatctaaatcaagcttgtccaaccctcaacctgtgggctgcatgctgcccaggatggcttggaatgcagcccaacacaaatttgtaaactccttacaacattatgatttttttgataattttttttagttcatcagctatcattagtgtttgagtattttatgtgtgacccaagacaattcttcttcttccagtgtgggccagggaatccaaaagactgaacaccctgaaaatgatcttgaacagttgtctgacttggtctaaagaagttatcaagcccgtgcattgtggctcatgcctgtaatctcagcaccctaggagtctgaggcaggaggatcatttgaggccaggagtttgaaaccagcctgggcaacatagcaagaccccatctctaaaaaaaaaaatagccatgtatggcgatgcacacctgtagttttatcttctccagaggctgaggctgaggtggaagggtcgtttgagcccagaaattcgaggctgcagtgagctatgtttgtgccactgtactccaacctgggtatgggtgactgagtgagatcctgtctctaaaaaaaagaaaaaaagaaaagttatcaagctctaatattagctcattccagttcaaaacctcttaagacttccattcaggaaaatgtttcttataatttaatctaaatcttttattatgttttagccttggttttatttggacctgttccatcttagggcttgtgtatatcaagccctatttactggtagctgaaaatgtctactagcagggatttcttttcctattttaacctgacatctcaacacctccattttttttttcttcatgttaaaccgttggtggcaattggctctatttctaaatccctctcataggctggctatagaagttgtaaaacttagcaaagttagagaagtatcttggtcacttctctaggaagttaacagagctttctatttccagtgtaccctgctctcccatcttttcctaaaaggtcctagaaaaaggctaggagtaataagattcaaccaagaagtgtaagtcacatctaccataatttcttagctgtaaaacaaaatcaatgaaatgtgtttatgtgccaataggatttttttttttttttgagacagaatctcactgtgtcactcaggctgcagtgcaatggcatgatctcagctcactgcaatctccgcctcccggcttcaagcgattctcctgcctcagcctcctgaatagctgggattacaggcaccaccacgcccagcgaattttgtatttttagtagagacggggttttaccatgttggtcaggctggtctcgaactcctgacctcgtgatccacctgcctcggactcccaaagtgctgggattacaggcgtgagccagcaggatttttaaatagataaaataaaagatgcttttatctgaatatctagaaagtccatattttgctttcatattagtttcagataaaatcctaaccaatttaagccttaaacacaggaaaatgcatctcagtttaatattaataaaatagtggagtaaagtaatgtttaggttgcttattctgagacagcatatgtttgtgtgggcaggggtagggggtgaagatgaagggtataattgagcctaatcagtaagttaatgttttcaatgtgctattactcattgccagtgggaagttattgatcaactgaatctgtgttgtagcagttggtaatccaattctaaagttgtgagaggaaaaaaattttgagtaggcatttactgaggcaaaaatgaaatggtttttttaaaaatatggttctaaatttccttttttagacttcaaaataagaataattaaaacagtatctaccacatttggcaaaatagttggaattctatagactttcttcacagaaatactataaagaatatgttaataaagatattaatctgaattttatttcttaactaaaaatattaaagccattaagggatttagcacagatatttaaaattctgaatctgtgttcaggaaaaataaaaaaccagcctcgttttatagaatctgcatatgatatcataaaactgtgtgggtaagttatctttctttaactttattttgtagtaacatggagtattttattatgtttcttatatcacaaacatactatgcattatagtgtagcagattgctacagaactcagaaaacttcagttcatcacttgattccagcagttggcatttcaggtaatcagtttgctgtggtctgagattgctagccacaagagattaaattctaagtatattgaaatgctttcttgtaattagttactctgaagtaaatgctaaatattagatgtaaccaaggaattatagtattttcagaaaatctttgagtgaacttatggatatgcttataatttcagtctagtttttttctctgtctttagaaaatttgagtctcaaagatatattaggttatatatgtcatgttttatttgatttttgaaatttgagtgaagaataaaaatcaccaattacatttgatatatattttaaaaatgtaagttagagataagaattgtaaaattaacatgtcttattctttctactgttggttctctaacaagttctgggaactgagtatatggtgcttccttggtgccacatagtggctaatctaggtatatattaaaatatccatttttagttgctaaatgtaatgtagtagggaggaataaaccttttggacaattttaccttctgaacctttctaccaatttaactttttagatagcaattatttattttaatatacaaataatatataaataatagaaaggtttagtagaattatgcatacatgataggttctaactctcacttttagatttactagcaatatttaatatgtaaccacttaaatttgtattttctgatatctgaataaaataaccaaaataatatattgaatgcctataccatgccttgctttttaatagacaggtacaatggaaaataaatggttgctctggtgttttcaaggaacaaattggaaattattattatattgacatacgattatataatgtaaaacttttaaatctcaaggctttgcaaatcctagaatgccaagtttataagaattgctttcaacatctatgctcctacagagctctgcacaaagttcattgtctatgaaaacttgtgactgaatgtttaattgtataatatgataaatcctttttagctgcagtcttcattttccctcatatttcataattattcacattgttaattttttctacttttctaatttcagcttatgtctagataacttctctatgcctcaccctcacttgtttctcttttcaagacatttttggaagataaaaacaataaaaatagaataataatgtcaagcctttccgttttggcctccaagtagtatggttttctcatggcattagaagtataatgctaattttttcataaactttttggttgaaaactcttctgatgctttatcttatagattgtgtcctttgctagaaaaggaaaaagtttgggaacaaaaagtactagttttagagtccttcactttagagatccaaaaagcagctggataacaaatataatacattatttgtttcaaatgacaaattctgacaaacactagaaatgaacttctgtggcatttataaaattgtcctttttgtagcttgctcttcagatatctttaaattcaaattggcctgtatattgctattgatacatcctcatgtgatagttctcaataccattttcaactacttctttaatttttcttgaaaaatatgaattggccaagcgcggtggctcatacctgttaatcccagcactttgggaggccgaggcaggcagatcacgaggtcaggagatggagaccatcctggataacacggtgaaaccccatctctattaaaaatgcaaaaaaaatagctgggcgtggtggcaggcacctgtagtcccagctactcgggaggctgaggcaggagaatggcgtgaacccagaaggcagagtttgcagtgagctgagatcgtgccactgcactccagcctgggcgacagagcaagactccatctcgaaaaaaaaaaaaaatatatatatatatatatatatatatatatatatatatatatatatgaattaaaagtcctgtctctataggatatattgtactttaaatagtacaggaggttcaaattttgaactcatgaaatgtcaagatagtttatatatttaaaaaataacttttatattttctttgaaatttagactgacccaggtttatgtgctggatcttttatgatttataaataagttactttaaaataactttggttatagaagttgtgaaatgcgattctaatataattaatatttgttaacttgaatgccttaatgtctgcaaaaccattctgttattttgtggatagttactaacccagctaataagcaaaaatgcactgatctctaagaatgaataaactatcgattttgcctagagttttgaaaatttcaggaaaagctcttaaccagtttttaagttactggtgagcttagatctatggtttgttccagattatccaatgtcgtactaactttgatataattatagctataatttattactattttgacctctaagagaaagagggttcctaagtttttttattcatgaagcgatgcaaaatggctttcttaacctatgccttttacatccatttcttaattcttataattaatataatattttctttttggtcagttcattagaaacattttttttctttttttctttttgatggaggctcgctcactctgtcgccaggctggagtgcagtggcgcaatctcagctcactgcaacctccgcctccaggattctagcgattctcctgcctcagcctcccgagtagctgggactacaggtgcacgccaccatgcccagtgaatttttgtatttttagaagagacggaatttcaccatgttggccaggatgatctcaacctcttgacctcgtgatccacccacctcggcctcccaaggcgctgggattacaggtgtgagccaccgcacccggccccagaaacatttttaatagttacaatactattaaactgtaatactgtgtattacaactggtagttaataattgtcaatccccagggctaaagaatagaatattattattaatttattctttagaaatgaactctcccccacttacaaatgatgcttcaattaaagactttattaaaaattactgttacaattcttcattcttattgaagcttgccatttttgaaaaagaaagtgtcggatgaaataacttatgctgaagatactgctaattcaattgcacttctgggtaagttaagatttccttaaggtatagggatgtaacatacgacaggtcctactgacaagggaatatctattttccccaagtttcactaagaggactccttctccatgtctaggatcttctcttgttagtgaattaatcacagtgtgcttggtgataattctggtattgtattctgttcaggttgtttcgtgataccaataaaagtccatcttctaagtacaaggacaggctgataatgtagtttgatgaattattatttagtttaatgaagtgtttgttaactatttttgtaaatcagaaagtgtacataccctttttaaataatcacaaaaacatttcaactttgaactctaatattgaattgctgcaatcatagaattattcattaaatgatctaaaattttaaatcaaatcataaaatagcatattaagaacttcagcataatgcacataaagatgcagatgcctatattttgtacacaaaaatatgaaaaatatcataaaagggtaggcacttatgtatgggttatcacttgattttctagagaaagaaaacaatttcctaggaaactagatcagggaaacactggctctttgagtcagctcctgggacatgatggcatgttcccaaaacaaatcctacattaaatctatacttactagtttaggtctttatttgtacaggaggaataaaagatacacaattgatccagtgcatttttaaaaatatttacggaataatgatgttcccagcattatactccatatagaaagatgttagagattcaactggaatgaagaaaaaaaggatttttatttttaacatagacactaacccttttatatctcagtaggttttatagtttttagttactttgggaaaactacctagggttcacctactctatatcctagagtaggtgaaggtgttgttgagattaggttaaacatgaagggggcaatttaaagaaaaacaccttaggaagcaggcaggttcagaaatatgggaatttttaattatgtgaatctctatcatcagcagaaatttacaatgagaagccaacccaaaagaggacatggtagtattaacagataaaaagtgtagtttttgttggtaacattattttttaaaatacccctgttgccattatttttaaatattgcttccaagagtgttgacagtcacttgtattataaatacatggctcactttttactgagtgtcaacttattctttgcttaatgactggtaccctgcctgcagaacatgttactatctcatatgacaacagtatgaactcttaactttaaatgagcttccttcgctgattactgactgcgagtactgctcttctgtttcttggtttttttaatggctggaaacattaatttaaactaaaataattgtatataagatgaaatgttgaacaaaaactcttcatgattttagttagaacttccagtttctactacgtactaataagttatattacattttcttccaaatgatacatagatatttctgactcagaggcaagattctggaaatggatgggggaagaagttggtactctgccctgggattatgaaacaggaagctatgataaattatctaaatttacaggaactaaaacagtggaaaagcagacgaaagaccctagaatttcccataagcctgcatatttggatagtcttgttggaaaagcttagttgttcttgttgcctaatatgttttaaaacctaagtagtgattttgcaactccaaaagaacagtccgaaaaataaataaaatttagagttagaataatcttaaaactgtcttttaagtgatatcttttgcagagattctcctgaagctagggtcaggctttcctttgtgcttcctccttctttccacttgccaccccacttgctgaccacctccagagatgagcgtcttgcaagggctaatgcaaaagaggaattcctaattattcttttactctcagagagtccaaccagttctagtttagttctaaggtcgatattactgactaccgctgtccttgggcattcagagaacctggatcatttccagagtcccacagatcattttcagatacccttggggatcatgtttataggacttcaacagagtagatgcaatccagtttgaaatacaggctgaagccaatttaattgtagtttagatatgactgaaaacgaaccttcctattcgccaaccccatgcagacagcttgaacataaaactattacccttgcatgtggggcagctgcttaaaaactcactctcttccagtctgccaacaaactgaagagcaaagttcacctggaacttctctaagcaaagaatgcattagtaaaggcaaaaaattactgaccctctagttagggagaaaaatgctaacccatatcttgtcaaaataataatagtatctaacacatgtagaacttacaacatgctagatgcttttctcagcccttttctcatattagctaatttaatcctcacaacaatcttaaatgtggtaactattgttatacctgcttaatagatgagaaaagtaaaacacaagtttacatgggtagtaaatggcatagccaggatttaaccttagacagtctggttctagcatttgtattaataatcatcattctttcttccctagaaaggagaggctgaattgattgaggggccaaatgtataaggatggattcagggtactgtttatatgtatgtatgtgtgtgagcatatgtataaaaatatgcatataaattgaacatgatccagtttgaatctctgagaatatttttaataatcatcatattattaacattttatgcctaaattctacaaataagcttatgacagtgttgttaaatagcacctgtttatctttctggcaggtgacttaatgaaaataccaagttctgaattgaggatacaaatttgtaagtgtattgttgatttttatcatgcagaaccaccaaagaagcatattccaggtgaagtttacaatggtctttcagtgataacttgtgtatgtagaaaacagaacattctcatatctctttgaatttgacagacacagtgggctcataaatgtaacacattaaaaagaaaacttttttgtagtcttgagctctttggtcatcttttgaaagttatatatgtatttttcagtttttgatttgcatatttttattctgatgctaaatatgaacaaatttgtaaagtgatgcccaatttagtttattaataattataaatgttactattatgttatttaataccattgataaaattattttttaaacactttataattatttataatatctgcccccactcagttaaatgttaagctaccaatgccagggccattctccatcctgtttgggaaaatagttctatgtgttatagctaagggaccttaatatatagtggtaaatgagccacactgaattggttgggaccaagacagtggcacgtgcactgtgaggatataatgttaagatgtacttcttaccttcatagtttctgtaatttctaatcaatctaggaagggagagaggatataaacaataatttcttaagttatatgattcttaatataggtggaaataagtgtctgtggtagttcaaaagaaagattatttaagactaaggaaaaatgggaaccagaagtcagttaaaaaaagacaatttaaaaaaaaaaaagaaattcagggaaaacagaaggaagtcaaaaagtaaaacaaaaaaatggaacagcacctaaactagagaaatgaataaggagattattaaatgtccagtttgaactgttgatgagatagatggggaaggagtgtcttggtagataaaagatattggatactaaaagcaacaggaccagaaatacaggtttggaatccacccaaatagagttgaaaattgaagccaccagaatggttgagtttgccaagagataaaacatataagcagcaaggcatcaagaatgacatggagagtgtccatattgaggtttggaaaaaatgattcaaagaaattggcagtgaagggaggctcaaagaggaggaagaaaacctaaagactgccatgtcttgtgtgccagtgaatcaaatatttgacaaaggaggagaaagttgtctcagtgtcaaacgctgcagttttctgtaatggaagagttaaaaggccaagttaatgtgacacttgaaaagttgtagttaaatctttgacagatctattgatataaagtggtcagggcagatgcaggattaaagaatcagaggattgtgagagtagaggcactggatttgagagtgagagagtagtggcagttcatgaatgcagacatatcttaagatcagatggtgaagaaaaagaaagaagatggagaacagctcagctagtgcaaagtcagagaaaggttatttgggttttgttgtttttaggataggaagaaatcacatttgtaggcagaggagctagaagctggtaagaaagaaatgggaaggtgaaattctcaaagaaagcacaagaggatggaattaagagcacaagcttagagttaaccttggcaaaatacagacgcccttcaaagaaagggaaaccagtggtgtaggacttaagaaaaaggagtattatggggcaaagacgtgaggttgatttggtcagtctctgaaaattaggagtcagtgctctcactatcacacagttggtttcaagtgatgggtatggccagacatccgggaccacggctgaaaagtcctcagtatggcagttgaaagagacatagccctggagacaggaattaagtccatgagctttaatggtgttatatccctctgttaaaatgtacctgcaatagaaaaagatacagtaagtataaagtacattttggtccatccatatgatagactattatgcacataaaaatcattattttagaaaacactttataggatggggaaaagcttacaataaaagttttagtgagtacagtagaatataaaattctgtatactagtatgttgttaaaattgtatgcatacattaaaaatatcacaagaaatatatgaaaatgttaatgttatctctagattatgaaaatataggcaatttttaccttcctcttcttactttttaaatgctttttataattcatgaggtgagtagctagagcatatcatagaaagctcatcacagcattggacagggccttgtccacagccagagatcatatttacaaagataagacaaactgacagatacctcagaactagggcaaagttaaagaatctagttggactcaaaaatcaaaaagtcagggtgttagataaatgagatcactaagaaaaaataaagcctcatctcagtaaatgaggaccctttggtgtttatttaatccctctagttgaatgtaattaggtatacctgcatcaaaaggagagatagtatttctcacaggtgctaagacagaaggaatttttataagacatgtcaccaagaatcaaacttccctaaaatactattaaattcactcacaattatcagagtagcattacatttttcacctcttattttattgctgacactacgtaattgttgtcccttgaaagtactgaagtaatgcattgaacctgaacagtgaaactgactagtgaaaacattcagtatttgtcattaaatcattttccattattgaaagtcatatctactgacaagaaatattgttcttttttagaatttaggatgtttccaaaattcatcgtcctattttaaatactacaccagggatcagcaaactctgggtcccaggtcaaactaggcctactgaaaacaaaattgtgttagaacacagccatgtccacttatatttgtactgtttattactgctttcttgctacaatgtgctatagagttgagtagttggcaagaaaccttataacctgcaaagcttaaaatactatctggccctttacagaaaaaatgtggcccatccctatgctgcgcaatttttaaattccatatacttttaaaaagtttttcttgctgttgcttaataataaattactcattcttttgtcttaatgatcattctgtgagataactgtatgtatttattaatgaattgttgttaggttaccagcaagcgagttcatcatacaagattcaaatggctgaagttggaggattagcaaaaacaatggtccagtcaatgaccttgcttgaaaatcaacttgttgagaaactttgggtacttaaagttctgcagcatctctcaacttctggtttgtatattattaagtttaaacacttcattgtcaactacttttgtttatgtctaaaaatgtcaatattgtaaagcacaaataatttttaaaatttattttcagaagttaattgtactataatgatgaaagcacaagcagccagtggaatctgtactcacctcaatgacccagatccctctggacagcttttatttcgttcatcagaaatactttggaacttgctggaaaaatcttcaaaagaagaagtcatacaacagcttagtaacttggaatgtttgctgtaagcgtatgtggttagataggaatgttcttttaatcttaaaatgacagccagtgacataactaacatctttgtttgaatctgtgttcaattatgttttagattcatgtaatggctatgtttcaggacatcttttttgttccatggtataaatgaatctgcacaataacaagccacacttttctatgtggaaggctcttgaagtagcttcttaacactaaaatataacttggaatatagataaagtaaaattagactttagaagaactatttcatttatttatccagtgaatctattattgagtgcttactatctcccagatattgcagtaagcattagcaacaaaatgtgcgtaagccttcaagttgcttcttcacttattcaacaaataattgtctgctctatgccagcttcagtattaagccatagaaataccactgaaaacaatatagatattgtctctgctttcgtggaatttacattgtgctaggagggatggacaagtaaatagacaactaaaagagaacatactaaatgttatgaaacagattattgtaagatgctacatgttcttcagaagaagatcagtcagcacatttttgtttgcaagtgactaaaaacccaaatgaccaaagcaatatagaaaatttatggcttatttaactacaaagtcaaggataaaactggtttcatgtgcagctttattcagggatcagcagatactaggacttcgtccctcctctctctacattgtcttccatggtgctggcttcacacccaagcctatgtagtaagacctaagaagtctacgatcacatcatttcaacctcaaatcaagcagaagagaaaccttgctatcctgaaggctcagagaaaagtctttgaattgagtccagtttggccctgaatggtctaatattggtcaaatgcctgttccacagtgatttattagtgccaaaagaaaaaatgctctgactggcgaaaaggcagctgaaggcagcctcacaggagcaaaagtcaggaaggagtaaatgcctaaataaaaataagaatgctgttcttataaaaagggcaagtaggtcccaggaggcaaagcaacaaatatctactattaatacaagggaacctaactcagagttggagaattaataactgcttcctaatgaactcaagtctagtaactgaatgacaaacaggacttggtaacagaaaagttttgcatgcggagagcatcctagacagggaaaacaagtgaaaatataattagcaaaatcagaaaactaaaattcagtatgatgagagcagaaggaacaggctacaatggtgagagatgaggctaacaatgttatcagggaccataacatgaaaggtctaataagccttgttaaggaggtaggacttaatcctaagaacaaagaatagtctttaaatggttttacaaaggaaaatgacatgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgagaagtatccattatttcaaatcgttattcccctatgtataatatatcatccttttctctcactgttttcaagattttaactctatctttggttcctagcagtttcgaaatgatgtgctaaggtgagatctcctttgtatttgttctgcttaggtttcatagagcttcttggatatataaatttaagtctttgagaagatttggagaactcttggccattatttcttcaaatattttttcagccccattctctctccccacttcttcagaggctctgattacttttatgtttgactttttgatattgtcccacaggtttgtgaggctctgctcacttttttcaatcatttttctctctattcttcaggttggataatttgtattagtctatatatttaaattcactgacttttttatttctgtcatctccattctgctgttaatctcatccagtgcatttttacttcagatatatttttcagttttagaatttatttttattcctttttatagtgtctctcctgagagttcttatctttctattcattatgagcatctttactgtagattctggtatactcctctgaagaatttttaataactacatatttaacttagctgtactcatccctttttgaggtatggcagcccaaatcttaattcagttcttgcctgggatgcttgagtattctctgcacttgtgtggttcagctatcagccagatatttgggaagagtttgtacacagaatttagcattctctctctctggctctctcctttatgggatttctcccttcactttccaatggctgtggttgcctctgccctctggttcttcaggccactaagaccacagggttactctgagttttagcatttccacgaggtgtagaatacggcctgctctcaggccaaaagcctttttttttttttttttttttttttttttgagacggaatcttgctctgtcgcccaggccggagtgcagtggcgcgatctcagctcactgcaagctccgcctcccgggtttgcgccattctcctgcctcagtctcctgagtagctgggactacaggcacccgccaccacacccggctaattttttcgtatttttagtagagacagggtttcactgtgttagccaggatggtctcgatctcctgacctcaggatctgcccgccttggcctcccaaagtgctgggattacaggcgtgagccaccgcgcccggccccaaaagccttttttaaaatgggaaactcgtgtagtgccattcccttctacaaaattctgacatccttccagtgtctgcttactcttggtcacaagatagttttatttgtcaccagcaggagaatttctctcggagctactactcatctgtaccagaagctgagccttcacatattttataattaaaaatcattgaatgattgaaattatttaatagagatccttggcaacaatattcacaagtcagtcacgtaagttctagttgtgctacaaagaactggctgtgacgacctcagcccactaacagtggacgtcaagtagtcccaagagtcatggaattcatgctgtgcaaatagggaaacagtgctacatagtatcctagttaaagctgcaacttataggtagacctttgtttctctagaatcccctggtcaggtagtaatttctcattagtgtccttgcaaacattcagatgaatttcacgaatgtgagtcaaaggaaataatatcttcagcatctaaagaaaccatatagatcctaaagtaatggggctataaaactacaagctcataagcccagggtttgcccctgtaaactctccctaatgtgcaaaatccaactaggatatctctgtcaggaatgctgatatgctaaaatgtttgcaactctggtgattcttcagggcttttcatgctaagtaggaactactttattatctcttgaccaaacatttgacataacaagaatggttggggtagaagtggaagtgtttaagaagaaaagctgttgagaataactggattttcctcccttactgtgtcatttgaagtataggtaacgaattatagaagtaactataaagacctaatatactttggatccttaacaattttaaacagactattcatagaataatataaaatatttcttagaacctacagaagtaagtttaaaattaaataaatctggcttatttaattttaaataagcttatctggctatatgtttttattttttgcctcactctttattactattcatgctttatgaattcaaatgaatgacagtaggagaatttgataaatgtacttaagtagtaaatatgagcatctgcatcataactttcatcttattcattcatctttctgcttattttatgtatttatattaggaatgtggctttaccaaggatttgatactgtttgccacctttaatgaaggtaaaaagaataaaactttaaacttcttataattatcttgataagtcttgtacaacatttaagctttcattttactttttttccctcacagttaaaagtcaaaatcttttggtaaaaggacttaagctttctaattcctatgaagattttgagttgaagaaattactattcaacgtaattgtgatcttatgtaaagatttacctactgtacaggtaaagagtaatcaaggcaggaaaatcaataaaaattgtcttactttgtagtataactattttaaagtcttgactgtaaatattttatcggttcatatatttaccacagaaagcagtaaaatcttactggcctgaattttagcttttaaattttttctttgcttatctgttagtaaacagtgaagtacttaaatttaaaccacataaaccagagaaaaatagtagaacctaagagatttaataatacagttagatctcttgaattagacagcataaaatgaaagaagcttcacataggcccattccagcctaataatctgtctctgaccataacaaggactgatttaatgctggagaaaattattaacctctgtgatgccaatctcaaactcttatgaacctgctttttcatcacacaaacctaatgtctttaatcacttttactctctatgaatttatcttaatactttgtttcctgcataacagcgtgatataatttgaaaaatattggaactgaatttcacttctggcttatcacctactagctatgtggccttagaaaaattacctcgtctatctgtggttcatttcctcctcctgtaaaggaaagattataatgcttcagctctgctcacaggtctatcgtgaagttgctatgaaggctttttaaactataaagtgacagtaaatgtattattaacaattctgtttagttagttactgcattaagtgaaatttccatttaatctaaaactctaccaagctccaaggattactatgaaaaagaagtaggaattcagtctatcaacttcactaccaataatagaaagatggggtagtctagcagtaaaggctttagtcagacagaatctcagtgctaccgctttctagctatgtggcattaaatgggttgtttgatttctctaaatcccaggtagctcaacttcaacatggggataacacctacctcgagattattatgagcatttaactgagctgaacattttcttagtaatgcaactttaaggaatatatatattttcaaatgctcaggaaaagaaaagttgtctttataattataactttattatttgtgacaaaaaaatacatactgtgtagaacctaaatgtattttccaaaatgcaaatggaaaatcatttggaaaattattccataaagtatggtttattattccaatacagtattatataaatattaaaattagacctataaagataataaaatttatactacagtttataagtcaattctaattaattgaacaacactttataggcaacagagccaagtagcacagattatggtgaggagcttcttaaaacactttgtgagcggtgaaatcaacaatttttatgtgtcacataatttgtggtccagtaatattactagtaatgataatgaatatgtacactatcatttgcaatacacaggggtgttttttgaaacattatatacttaattctagcaagaatgttagaactagtagttattcctgttttctcaactctaaatcttgcattcttttcacatggactagtaaggaactagaaaaattaattgtttttgttaaaatctttatagaataatgccaaattaaaagaaaattaaatatagcatatggtgttttattctcttgtgaatcataaatatgtatccatcagaatcagctgtattaattctgttgtcataatagctatgcattttaatctcatttttattaaaatgatgggttcaataaaattttaaaatactaggcatgtaatgaaacatggcttgtgacctaactgacatttatttggtagaatgtttatgtaagtactgttgcatgtggttaaatattcactgtagtcattacctcagacaaaattcttttttatggtacacaactgagtctgtgagatatttccttttaaaaaaagagtgaggaaagagatgtcagcacttgccccaaaatattctatgttttattgtacgttaaagtaaaatacgttatacgttttattatacgttttattatacgttaaaatatcctatggttttattataagcaggaactacattacatatatgagcagcaaaaacaaaaaattaatacatattttatattattgtcagggagtacatacctcagaaaagaggattataacttatttaatttttggtgttttttttttggtacctatcatagattggggttattttataaaggaattattttgaaataatccccaataaaacatcaaaatgtaaatttttatttaattgccttaaagtatttttggctatgtttctaacaaagtatcctttgttctttctcacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaaggtgagtggcccttcaagattcttgtcaaaattctaatcttcatatttcaactgaatgctcagtatatgcatagaaataacaatgaagttaattaaagcaatgagaagtaaaaacacacagacctatcttcttaatgtatttatatgttgttttaagaaaaacacagattttaaagtcagacgtcagtaaatgtcatagttgatgcacacccgaaagaaatcatacatgtaatttgaatttttgtattattagacctatctaaaaattatatttgggaagaaaataaatgctggcaatattttatttgctttgtttgtttgttgagacagggtctcaccctgtcacccaggctatagtgcaatggcatgctcatggctcactacagcctcaacctcctgggctctagcgatcctcccaccccagccttcccagtagctgggactacaagttcatgccaccacacgaagctaatttttgtattttatatagacagggtttcgccatgttgccccggctggtctcaaactcctgggctcaagccatctgcctacttcggcctctcacagtgttgcgattacaggcgtgagcctgaaatgaattacaatattgcccagtctggcagtattataatgcattcattcaacaaatatttatgactgcctactgagtactagatactgtcttaactactgaaaatacagttaggcttaaaataaatatccttttctctatggagcttaaaatctagatctctagccagaagtaatgactccagtgtggtctaccaaattagtagagccccaatttatttgtattttgttttagttcttagaaaggaaataagaaatacattccttttttaaaaagttttataaggaagatattgcctcttttctggtagaaattttgctctggcaataattttgtatgatgcattttcattagatcaagaatatcacccatttatgcatgaaggaggaaaaaatgataggctttttattctctagtttctaatatgctgagctactaaatttagtcttgtaaaattattttccactgaataaagcaattcttcagcctatcctttatatcatttatgtttgtagaagactttaaggcaaaaggggaaatgctggctaataagagaaagactgatagctaatagttattcagaacctactatctggtgagctttaaacaccttccaagtattaagtcatttagtcctctcaacaaacctaggaggtataggtactcttattatccctttgtatcagatgggtagaactcagtctaagaagctaaataattattcctggccacaagtggcagagcaaaaatttaacccaggttctataatagaacccacaattttaaccaacatgcaatactcagaacagtattttcaactttttttttttttagctagaaacataaagctacttctaaaagcagcttttaaagaaagcatagcataaagaagggaggatttgccttgctatttatcaagacctacgataaagctatagtaattaaaattatgtggtactgggtcatggagagaccaatggcatggaatatatgaaaggttggctttatgagagatgatactgccaatcagtgagggaagggtggtgttggggcagttggtcctccatgtgaaaaaataaaaattagacctcttcactttgttttttctaaaaatcaattgcaaaagtaataaattaaagatgtaaatatgaaaagtcatacagtgaaactcttagaagaaaacatgggaaaatatctttttgctagatatcagtgtaggaaaggtttctttaaaaagactcatgagttaaaggtataagaaaagatcgatgcatttaactactgtaaaacgtacaaatgtctatttgacaaaatctaagtgaaatactaatttacaaagtgagagatgacatttattacccctgtgactgataatagattagaatccaggttcataaagaactcctatatatcaataagaaaacaactcagtagagaagtatacaaggactagggactgccatgtcacagagaaaaccccaaattttcaaaaaacattgaaaaactctaaatcctgttggcaatcagataaatgcaaattaacagcaataaactaccatttcacatttaacagatttcgtgggggaaaatcaaggccaggtgcagtagctcacacctgtaatcccaacactttcaaggcaggaggatcacttgaggccagaagttcaagaccagcctgggcaacatggtgagaccccatctcttaaaaaaaaaaagcagctggtcatagtggcacacacctgtagtcctagcttcttgggaggctgagatgggagtattgcttgagcccaggagattgagacttcaatgagctgtgatcataccactgcactctagcctgggcaacagagcaagaccctgtctcttaaaaaagaaaaattaactcatcttatacattgtatctgtataaacaccttggaaaacaatttagcacctttagtaaaattcaatgtggatgtatcctgtattattctggtcacatggaaaaactcttctcaatggatataagaggacatgaaccagaatgtttattgtaacagtttatagtagtgaatggataaactataatttatttataaaaatgaatgctgaaacgaattaaaattaataatctagatctacttgtgacaatgtgaataatttttaaaataaacatgttgaataacagaagcaaattacaaaagatacatataatatgatacatttgagtaaaattccaaaacacatacttctattctgagaatagtaagagggaaaagggataatattttatttctctaaaaaaaaactaaagcaaatatgacaaaattttaacatttgtttaaacttttgatagatgtataagatatctgatatatttgctttatttgaaatgtttttgttttaaattatcactttttctccacagatccgtttttcagtcatggtaacagttttcatggtacaggtggccgaggcaacaagtttgcccagatgcgttacagtttaagactcctgagagccgtggtctaccttgaagatgagactgtaaacaaagatctttgtgaaaagggaacaattcagcaaatgataggtaaaatataacatggtggtttactgatgaaagaggaatatttttaatagtagtagttttgtttgaaatgtttttccaaaatttattttgtctttatgactgagaaattcctgaatattttcttgatttttgtttcatattgctgctataaattagtgtgtcttattgaaatatcatacttactaaccctttaagcatttatttcttcaactcaaatatcatttcatttaggattatctttatctttttttaaaatggtctattgttatgttttattcttttagtaataaaggtcaccacttttgaccaaggcttttggagctattttaaaacaggataacatggcatattccaatgcatgtgtcataacagaacactggtacattggtatttacagaaatgtacagaggagtttcttttctgatatgaaatatcagaatatccttgacttttagcttacacttgactatgctagaaaagaaaatggaaattatgtgtatcatagaaatactgcatgtgttaccctatacgtcatcaattagacacttaatgagtatctcataaaataagtacacataaactcagtgtaaaattcagaacccctaaacaaaagctgctttgccttttgttatttaaaaaataaatagttctctagatccttgactttgaaaagagctatttcagtcgttcgtattcagtgattgcttcactagtcaattatataatctgctagatgtcaattaattataaatgcctactcaaaaaatcttctacttgttaaattaaggtggttactcttccatcactagtggagtggagtggtgctctccaataataataataataatataggaaatagcaggaaatcaaagtatattgaaaaggagctaggtgaaaacatttacctttttgcccagtttgtttgggatgaacaaacctgaaagtacagtttatcattcctgtgcacattctgttgcacaaaactcagtctaactagaggaaatccaggaaacgtaatctttcatatgtctaggaagaattcttaatcctgcctgcactagggaatagggtagggaaaagggaaaacaaatagcaatggtttttttcttcttagaaccttttccctttaaccggaaagaagctgatctttatgttaagttcttagaggcagggaccttgtcttattgagtctaacatggctgtgtagtagtaacgtgctcaataagtagtaactagattttaaatgtaaatgtttatacacttcctgggtacagtgtacactgcttggtgacaggtgcaccaaaatctcagaaaccaccaataaagaacttatccatgtaaccaaaaaccacctattccccaaaaactattgaaataaaatataaatgtttatatacttcctgtgtagacactggggttacaaacatgtatagagcaggacaccaaggaccttttccttaatgagaaaatagaaactacatgtatcatagaaagatagcatgtgttagcctacacgtcatcaattagacacttaatgagtaggacagagtaaatgttacagaaactaagaggcttgggtagttttcaaggctaggaagtcttaggattctgtgaggtaaaggtagtttagaggtggaaaagaagagaaggccttcaagcaaggaaataccatgaacagagagacatggtcctgaaatatgcatggtgatgtgttcagaactagtttaagaggagccaaagttttatgaagataaataacacaagataggttaattgtatagtcagaggccaagatggaatgagttttgagtgattgacagtagttcgaacttcatcctcttaaggcatggagagcctcaaagggttttgattagtgaggttatatgtacaatgttatgttttaggaagaagaaactgggagaaatagaatgatctataacaaggagagaataaaggcaaggagttgaagggtacataaatatgagcattatactatgtgttacaggcagcagggaaagtttctgcctgcacccaggtaggaagaagaatgctatgatctagaaagaagaagcagaactatggccagtcaaactggattcccagaagatgttcctgataaagcgatataggcccctctgtccatggcataccccagcactgggcctccagcaggctcagctagcctctcttagggtctgatcccccacctgtaattcatcctaatgggacctagaatagtcagtcgctcagggccagttatggagataggctatgatttccatggcccttctactttggaacatagctccatactttcccactaatgccagttacccctttaaccgagaaaaagtcactttttttctttatttaaagcttaaaaaaatcctttttgaggcaaaagtgtatcatgaatatcatttcgtcagtgttagtggccatcttcagtccttttcaatttcaactggaagcaaaagagggattttaaaggacatggaatactgttacctaaaattgtttaaaacaccttcagttagacatcaaggaaagatgcagaaagcaataacaggaatagaaagcacacctaaagagatctgccacctttgcttagaattgaccctgttaaccatgaggagaggaagagattaggcaaaccacagtcaggaaatttggtcatatatttgcaaaggcactcatttcctacctcatgaaactctgcatatttttaaacccagtttgctgagcaaagtgtcaggttattggggcatcctttaatgacatactgttaattctgaactagaatttctatatatgtgaggctatggattacattcagaaattctatatatgtaggtagggctactgattgtattgaaagctccaggaattcatttatcatcttcttttcacagcctctaggttactatgcaatgaaaatatcctcttctaaaatagtttttctaggctgggcatggtcgtgcacgcctgtaatcccaacactttgcaaggccgaggcaggaggattacttgagctgaggaattcaagattagcctaggcaacataatgagaccctgtctctttataacaaataaaaataaataagtaaataaaataaaagtttctctagccaaataaactttttagaagagatttccaaacagtaattgatcaaaataaaagtagtgtccaataactatacagtctttaaatgttttcataccaggaatctttaaaaatataataagcaagcctaatgaaaaggaagaagccattgttttggaaatccagtctgatatattacttatcctatctggcctttgtgagaatcacattcaaaggaaggtatgtatgcctgtgaaagttttgttcaggtctcccagtcacctaacactataaactatttttggaagtctctataattgtatttaattttgtgaaaatttaatatttttgttaataattagagcataattatataaagtaaaaggtacagaatatacaacagtatacacccatttaactcatacccccaattaaaacagagaatatttctatctctataaaatttcctcatcccattagaagccatgcccctactcacttccagacaaactactgttctgttttctattcctataggttggttttccctattctttaagtttatatcaatggaatcgcacaatatttactcttttatgtctggattctgtcacccagcatcatattttagaaatatatccatgttggccgggcatggtggctcaggcctgtaatctcagcactttgggaggctgaggcaggtggattgcctgaggtcaggagtttgagaccagcctggccaacatggtgaaacctcatatctactaaaaatacaaaaattagccaggcgttgtggtgtgcgcctgtaatctcagttactcgggaggctgaggcacgagaattgcttgaacctaggaggtaggttacagtgagcccagatctcaccactgcactccagcctaggtgacgcagtgagactccatctgaaaaaaaaaaaaaaaaaaagatagaaatatatccatgtcattgcatgtatcaataattcatttctttttattgctaaatagtattccattgtgtgactatgccaaaatgtgtttatctgttcccctattgatagataggcacttgggttgtttttatttacagctataatgaataaagcttcagtgaatattcttgtactagtctttactagtgggtataatgctttcatttctctcgggtaagtatctacaattggaattgatgtatcataaagtaggtgtatctttataagaaactgccaaacagttttccagagtgggctgtaccattttaaatgttgtttggggtttgaattgggttcaaacccaaagccaaaatttagaacgagatcttaatccccttttatcttttttagctccatagtgaactctgagtctcagagattgataatttaaatgttaaatagcaagggatggaattggaaagataaaaacaaaaaaatgatggtttcaatagatagattttaagtgaacgcctgtttagctccaagctttgatgcaatttctcatcatattctaccaccctgtgcctgggctcctctggaaaaataatcataatcttgcttactgggaaccagaactgaacagcaaggcaataagaaaggtaattagtaagagaaaaatattaagtggttaaaacttcacaaaaattattaaatgttttaactacatttatatcttatttctctcggggtcattagaaaatcttgcatgatagttcttactatctaagaattgatctgacataatgctagactgcattgattataatattgaagaaaatcaaggtacaaattttatgacttcttttaggagaaagggaataaaacaaaaaatatcaagggatattattaagctggcatgttgattgatgccccctcttaaaatgattaattttataataatttgttttaaattcctgagaacaagtaagtacggttttttaaattgcagtaaaaatagtatttttctaacaatgttgctgtatttctctggtaaaaaagcaatattaggggaccgataaagtaggaaagggaggaattatttatttatttcaagaaataatttaaaacaaatatcttaaacaggaaattttcggaactgaaggagtagatatcgttcttcatgtgatgaaaacagaccccaggaagttacagagtggcttaggctataatgtacttctttttagtacattggacagcatttggtgagtattgctataatcaaattaggtagactcacagcagtcatgcatcactttacaacagtgaggatactttctgagaaatgtttccttaggcaatttcatcttatgcaaacattataggatgtagttacacaaacatagatggtatagcctactacacacttaggctagatggtatagcctaaaggctacaaactgtatgtcatattactgtactgaagattgtaggcaattgtaacacaatagtaagtattgtgtatctaaacatacctaaacattaaaaaaggtacagtaagactacagaataaaagataaaaaaaaattcttaacgcttgtatagggcacttataaatggagcttgcagtaccagttgctgtgagtgagtcagtgagtgaatggggaatgaatgtgaaggctaggaccttattatacattactgtagactttatcaacactctacatttagattacactaaacttacttttaaaatatttttcttttctcaataaattaaccttagattactgtaattttttttttactttataaatgttttcattttctttatgtttttggctcttttgtaataacatttagcttaaaatacaaatacattgtatagccatacaaaaatattttctttctttatatttttattctataagtttcttctgtttttaaaaaaattacattgtttttacttgttaaacattttgttaaaaactgattcaaacacaaattagcctaggcttatgaaaaaatatttgtgtgcatatattttattaaacatcatagatatttctgtccagtatacacctagatgtaaaaatgcccagatctgggcatttttacgtctgttcagctttaggagataatactaaaaaattttccaaagtacttacatcaattacacctttcccagtagtgtggaggtttctcctttttccacacccttaccaacacactgcgttgtatctttcattgcagccatccttatggacttgtgccagtgtctctttgtagttttaattttcatattcctgattgctagtgagttcatttgccatttaaatagcctttttttgtgtgaaatccctactcaagtctcttgctcatttttctactgaattacctattgttttttagagttctttatatgtcctggatatgagcctttttctgttatatgtttgtcaaatatattctgccactctgaggcttacattttcactctcttcactctctttttgttgaacagatagtcttaatttcagtgtggtccaatttaccagtctttttttatggtcagtacttttagtgccctgtttaaacagtctttccttaccccatagtcatgaagatcactgcctatgtttcttctagaagctttattgttttgccctttacatttagacctacaatctacctggaattgatttgtatgtatggtgtaaggtgaggtacaagttttactttttttgtatggttgtaattcaatgctgtttttggataaaccatcctttacccactgctttgcagtaccttctttgtacaaatcaaatgtccgtatatatttggatctatttctaggctttctgtgctgttctactggtcttttgtctatccttctgtaatgtgctattttaataattaggtcttgataagtctagacatctggtagagtaagtctttctacgttttccttccccattaagattgtcttagcttttgctgaccccttgcatttggatattatattagtcaagattccctagagagacagaaccagtaagaaaaaaacatagagaaagagagattgagatttatcataaggaattggctcacacaattataaaggctgaaaagtcccaagaactaccgtcagcaagtggaatacccaggagtaccgatggtgtagttccagtctgagactgaaggcctaaggaccagaaaacccagtgttctgagtgccaatctgaaagctggatgcttgaagcccaagaagagcaaatatttccatttgagtctgaaaacctgagtcccagctcagcagtcaggcagaggagttccctcttactcagcctttgcattctgtttagatcttcagttgcttgcataaggcccacccacattagtaagggcaggctactttattcagtttactgattaaaatgttaattacatccagaaacaccttcacagacacacccagaataatgtttgcccaaatctctggccaccccaggggtaaaacctgggaccacctgaatgggaggagcaaagctgatggcatttcatataccagcctctaccctactcctactttctatgcactatgatgaaacaggcagtagaaacaatgtcttttgaaacaggcagtagaaacaatgtcttttcttttcttttcttttcttttcttttcttttcttttcttttcttttcttttcttttcttttcttttcttttcttttttaaggggagctatgtttagaaaggggacacaggaaagtgaccacagcaggcttgcaatttctgggaggaactgagaatagtatctgttgcaaccaccagtgatagcttgttcagtccacattccctatcaggaagaagagtgcaagtagccccggcagcagctttaaaccttgattccatgtgagctgcacaaaccaaagtaggcactttagcaaattcttataggaaagggttcctgatccagaccgaaagagagggttcttggatcacacacaggaaagaattcaggatgagtccaaaggataaagtgaaagcaagttaattaggaaagtaaaggataaaagaatggctactccataatcagagcagccctgagggctgctggtttcccatttgtatggttatttcttgatgatatgccaaacaaggagtggattatttatgcctcccctttatagaacatataagttaacttcctgatgttgccatggcatttgtaaactgtcgttgcactggtgggagtgtagcagtgaggacaagcagaggttatttgtgtcagcatattggttttgatgagttttacctggcttattcactgcaacctgttttatccccaaggtcttcatgacctgtatcttttgcgacctcctatctcatcctgtgacttagaatgccgtgaccatctgggaatgcagcacagtaggtctcagcttcattttacccaggccctattcaagatggagttgctctggttcaaatgcatctgacattttccccatcccttttataagagaagccttaatccttagggttgcagagggattaagatccgtcttctgtaacatcttcaggctgaagaggggtgatgatattcctgcctatctattagggtctcttgtgttcagggtacaggggagctcagtcagaaagcactggtatgttgagggtcattcataactcttgagttctgacagaaggtgatatctgaaagagtaacaattgaaaattaattattgattaatattgataaaattgaatagaatatcaattctggttttcacattacctagccctcttgtttcttctgagcagcagtcagagatcactggttggttcccaggaatgagcagcgttagcctaaattgcagaaacaaacttgaaaacagctgatgagactagaatctaacaacaggtgtaccatagttcttgaaacatatttctctctccagtttcccatttatcctaaagacaaattataataaggccaatttgctttattatacttggcctgattatttgtataaggtgcagcaagaataattatttgccatatgggctatttgaattggctttgatggaactctgttccataaggaatctcagataagacttttttaaagccaagcccagccatgggtttgtaccctcacatacctaagagtttggtaaatttctcttctcttgaggtcccaagataacttggggctcctgggcctgtcagaaagtgacattctttacttaccacaggccaggaaccctatacagagactgtgtagacaaagtatcaagttttcccaaaggacttttattggctttacacatcaagtctgattcctcaaagcacaccattccagtcaaagccttagtaaaataatcagtttctccaattgtgtcctgttgcaaaagaaaacagattcttattatacttcttgttgcaaatacctatattgccataaattaagaacactcacgaatagttgtcaaattctggagaaattgggtagaaaaaacaaatatgctccaaattttgttcacacgagcatactttacccaattgttaaaagctgtaaatagctccaaagatgagttgtcttgactctgggcggaaaaaaggatcagcaacattttaagcaacaagttaaaaaagatgattttagacttctgttagtttagtccacaaaattaatttctgtttgatattcatgaacatttcagctctctatgagagttctgaaaggttttttcctctattcagagatcacaatctccaaagttatcagaaacctgcatttaagaatacctgttagagttctatagctgactataaacgaccttttgaagaggatcaaaacaaaacaattgtttgtggatgacaaaacatcgcacagtcaaaaacatgattgacaaagcaatttagttatctcagtggcatacaacgattttatgtagcaattataactattagtgacctatactaagtcatatgagaattgtaggcgtttcccatcattttggaacacataccaataacacatttatgcaaatatagcccaaagaaagctaaatactgtttcacatttgacaatgcttcctgtatgatgtttataccaaataagccaaattttacctttacattagtgtactattaattttacactcaattcttaataaaaccttatagacatatctacccaattttaatgtttgaccataaggtaagattctcataaaccttttataaccctttacaatttctgttaaagagcagatcataaacaggattttgctccaagaaaaacctgttgtcatttatgccaatgttcagtttacagaaaaactgaataatacccctttaattttagccaatggccacacacagaatttcttttacaattttttcacaaatctgccccaacttgcttaaaccttcagctttatcttatctaattgtaaaataccctttaatgtaggaaaaaaaaatccacattcccatgacttcttataatcttttgccaaaaacacatttcactttctttatacaccttacatataaaactgtttctttagtagtctcaaatacttgttacgctgttaactcttggcaacttttgcttttggcaaaaagcttggtaagttcagcattctaattatgtactaggcatggagcctaggacccagacagaagtacagataaggtctgactctttccagcatcttattccatgtgtcccaggccttacctagccataaagcaggcaagttacagtaagagtcatagtggcattttatgaagcattaagggggcctaacgaccttcaaattgtacaacatttcttgcacaaactccctttcactaatcctttcacgacttacatagactatgacatgcttagactttctgacttttcctaaacatccctctttttaagcaaccagttgttttactttaggacaagaatctaccatacaagattgttttttatataacatctgttttctttacaaccttctttgcatagctagggggcatggctaatttcacatgtccccagccctatctacaatctaatgctcctaaataaattgaacaattttcaaaagtcaaagaagccatttatgaccgtaaagtatttggaaaacctgatacctgatctgcataatttacaccaaatgttacatttttgaagaatttttgttttaccaataatctttattaaaactgtcttgatttccctaagattactaaagtcacatgaactgaacatcattctactttttacttttctgaaaaaatatttgatttaagttcttcttattaataaactaattagagctctttcatatataaacatcacacacataatacatttaaatatggagacacgcagaagatgaaggactccttccctaagccaggaattgaaccctggaccggggccgccattgtgaaaagagaaagcatggccacaaggttacaaggtcaagctcccaaggacatacaagacgagggaaacctcgtccagttttagttttttgggggacttgcagcaaagtttgtaactgaccagtttgctgggccatcttgaaagcaggcttacaggtgtcctaaccctatgttctctcctaaggtacccctctttatgacagaacaatacagaaagacaaagtacaccagattggctacaggttaagattaggctttcaaatcatttctcccattaatcaaaactttacagaggagacagtgatttttaccattcattcaactggtttgcacagaggggaagggaagggaaaaagggaagggagcattgcttttggcagtgtggggaaggtgaggtgctcagggaggccagagaaagacctgcccattggtgccaacactgaatcaaaagttcagccagttgcttttcagtcgagacgggatcttttccagcattcccatttgctctcaagtttccccttttagggaggaaaaagcttcctctgtcccacaatcctacatgcgcctaatcctctcacccataaccataagcaaaaagtgcaaggcagattattccaaagagaatagcaattaacatcccatagtgccaaacccattcttagccaaaagggactttactgagaggggcctctaacttcctaaatcttagaagggattctaaccctcctaaatttgccttcaaatccagggtcggtcaagtttccttgctttttaataagaggggcttttaacccactttgacttaaggagagaccctaactcccctaagttgacctctaacccaatgccatccttcagccgagtacccaaccactcacccaaggtcggccaaccagtgctgtcgtctctttcctttggtttggggctgagggctttcttcagtatcgtcccttcggggcttgccagaaagatgttaccagaccccaacacttacccaatattagcctttgagtcgggggttttctcactattgtcccttccatggttgccagaaggatgttacaggaaaggggtcccaatccagaccccaagggaaggttcttggatcaggcgcagaaaataattcagggtgagtccacagagtaaagtgaaagcaatttattaggaaagtaaaagaataaaagaatggctactccataatcagagcagccctaaggactgctggttgcccgtttgtatggttatttcttgatgatatgccaaacatggagtggattatttatgcctcccctttataggccatatagggtaacgtcctcatgttgccatggcatttgtaaactgtcattgtgctggtgggagtgtagcagtgaggatgaccggaggtcacttttgtcagcatcttggttttggtgggttttagccgccttctttactgcaacctgttttatccgcaaagccttaataacctgtatctgtgctgaactcctgtctcatccgttgacttcgagcgccttaaccttctggaaatgcagcccagtaggtctcagccttatttcacccagcccctattcaagatggagttgctctcattcaaacacctctaacaaaataatctcaactgcaaagatgagatataatcaataattatccaatgtttaaagtgcaccaacatcttgaaacagcaatgtcgacaaggcctgtaaatattttacagagtttcattctgagcccaatataattgaccaaggcctgaggcacggttttttgttgttattgttgttgttgttgttgtttagacggggtctcattctgtcacccagcccggggtgcagtggcgtgatctcagctcactgcaacctcctcctcctgggttcaagctattctcctgcctcaggctcctgaataactgggattacaggcgcccaccaccatgcccggctgattcttgtatttttagtagagacctcgttttgccatgttgaccaggctggtctcgaactcctgacctcaggtgatccacccccctcagcctcccaaagtgctggtattacaggctgaccaccacacccagcctgaggcacagttttaagaggtcctgagaaaatgtgcccgaggtggttgggctacagcttggttttatacgttttgtggagatataagacatcagtcagtacacataaggtgtgcattggtttgattcggaaaggaaaggcaactcaaagcaggagtttacaggtcagaggtggattcagaaatttcctgattgctatctgttgaaatgggtaagttattatctaaaaactggggatcaatagaaaggagtatctgagttaaaataagggattgttgagaccaagtttcttattatgtggaatagttggtaaatgtctcttatcagaccttaaaaggtgccggacttagttaaatctctcctggatctggaaaatacttggacaggggaggggattcgctacagaatgtagattttccctagaagagacagctttgcaggaccatttaaaaatatgtcaaaggaatatattttggggtaaaatactttgatttctttcagagcctactgtcatgtgatgctataccagagtcaagttggaatttggtatctcattgctgtgaagagtctgttttttcattcttaagatctctgttttaacgttaatactcactggtcagttgtgcctgaattccaaagggaggaagttataatgaggcatgtccaacccctccttcccatcatggcctgaactagtttttcaagtttactttggaatgccttggctgagagaagggttcgttcagttggttggggggcttagaattttatttttggtttacagcaacaataaatggatatatcttgcaaaaaaagttatgagaccagccagagatgatcactaagaataattaatatcatgaaagcaaaggagaatgttttatttgtaggaaagaaataggcagttatggaaaagaatggatattgatttttaaaaacgttgaaactgaacaacgctggtaaagtttcttcaaagttctatttttttaggtaaaaacattagctacttgatttaagaaaatgaagaaaacatattctttgaaaatgctttgataaagataaagctgtacaaattcagtttaacaataaatgtttgtcaaatgaataactttcttttaatttaaggtgctgtattttgggatgttatccctcagaggattattttcttgaaaaggaaggcatttttctccttttggatttgttagcagtaagtatggctataacaatcataagacaaaagacaaatatgtctattaaaggccgtttccaaactgaatgccacagagcacaagtctatgaataaatgtgccccaaatcatgttcaaaggtacggtcttaaacaaaattgctcctagaaattcataatacacagtgttttaaaggctctgaaaattcctctggttggaaagtcattttaccagtgttttttcagtgttttcaaatacacgggaacaaagaatttgtttttctttgtactccatcaacctgttaagaaacagtttgtgaagagcttgaccatatgaaaacccatagtcatttattaataacttctagtttcttcccctgatattaaaagataagggccacgttagacaaggagcaaagataagcatttttaaagaactatgtattatttggaggtaacctgaagaagtctagtgactcatggaccattgttttgcagaatgagcagatgtgagcaagctaggccttccaatagagacagtgccatctagcagctgtgaagaatatagccccttactagcctcaattctaactggaatccatagtcaggatgatatgggaggaaacgtacaattttgtttcaataaaattttgagagagattctcacacagagttctagcccgctccctgtccgtgattctatgattgccactattcttgattttattaacagaataacaaacctactttgatttagcaaaagtgctaaaattatttgtgccccttaacctccctgaaagttagttcatttctctcttttcgatttctttacctgtaaaacagagataacaacattatatatcttattgtattgttggaaggattaaatgagtgattgtatgtctgtgtgtgcatctaagtgtgcatgcatacatatatattatagattaaatatagtgcctaacatgattcctgtatttactgttattatgaatattattgctagaatatatttaatgctgattcaaccaaattaattgcaaattacagatattatttaatgaagattttatatcaatttcaatctttcacatttgcctgtctcctgaagtagagaaataaaaaaactcatttccttgagtgttttgcttaatacaactctgctgaaatataaagtatgtaatgataactgctaataatggttaaatgttaatgagagctgactatgtaccagggagtctcatataactcataataaccctttgcaggtaatattattatcctttcattttataaaaggaaactgatgatgttcgcaattaaaacaaaagcttacatatttcctttgctatattcaaataacagtatactgtaaaagttaatcaacaaaaagtatttcacatagaagaattagattatggaggccattgctctggatggaattttctatacctaaattttggtgtactgaaaactacttgtagcaaaataaaggaaatatgctttataataggagaatttttttgaatccttaaatactcttttatggatgatgattgccacaaaaccaaattacatcttgttttattttcatatgtgattgtcatttgcagttaccatcagttactctcttaataacaaagagattacagttagtatgaatctttacaagccttaataaagcatataaattggaaagatcctgtaattacagtgaactctgtataacactatcgagcttcgccacttaaaatgaacatcttcacttatttgtgcaaatctttttccaactcagccacatcagtcacattttggtcatgatatatgtttataatgacttcagaattatattaaatcttttactttttatccttttaaatttctaatgtttgaaaatatagtcattacaatgggtgtccattttaacaggagattttcctgactctgagtttagaagaaacttaatgataatagaagtgtttctctcttttttttttgaagacaataattcttaatatttattgcaacttttttccttttctgtttccttgctaaagttgaaccaaaaaaaattctgtaatctaatacttggaataatggttgaattttgtgataatcccaaaactgcagctcatgtcaatgcttggcaagggaagaaggatcagacagctgctagtcttttaattaaattgtggagaaaggaggaaaaagaactaggagtaaaacgtgataaaaatgggaagatcattggtgagtatatttataattgttagtagaagcaattaatgtatatattttaaaagatctttaaatggtattaagaaagcatcaggcctttcacccctttgtctaaagttttttttttttttttacaagggtttgaaaaatttgctatcctaagtgactggaagaaaactaagtaaattagtagtaggttcatatttttagagaatatttttaagaaatggtatttaattatattcttttaactaaaaaaaaaattaaagtagttcctaaagatgcttctttgggttttctgcttttatagatagattcaataatatttcattgagatgtaaatagattgcttcaaaataatattttggtattttatacatttctgttcatttttcctttttctaaatccattaggcaacatgatctgattaatgtttatagagtttactttttatatgaaagaagatattgtttcctaaataaaaatagtccaaatgttcaaaaattttaattactagattctaaattaatgagacttacagtatcataatttttagttcatttacatattccatactgctatattacatttttttcttttttttttcttttttttttgtgagacagggtttcactcaggtcacccagactggggtgtgatggtgcaatcttggctcactgaaacctctgcctcccaggctcaagcgattttcctgccttagcctcccaagtagctgggactacaggcatgcactaccacacccagctaatttttgtattttttgtagagatgaggtttcaccgtgttgcccaggctggtctcaagctcctgggctcaagcgatccactcacctcagcctctgccaagtgttgggattataggcatgagccaccacacctggccaatatattacattttctttttttcttttttttttggagacagagtctcgctctttcgcccaggctggagtgcagtgacatgaactcggctcactgcaacctccgcctcccaggttcaaatgattcttctgcctcagcctcctgagtagctgggtctacaggcacgtgccaccatacccagctaatttttgtatttttttaattagagacagggtttcaccatgttggctaggctggtcttgaactcctgacctcaggggatctgcccaactccacttgccaaagtgctgggattacagacatgagccactgcaccccgcctacatattctaagccttttaagattcttatggtttcatctaaacggttcacttttttttttaaattttattttaggttcaggggtacacatacaggtttgttatatgggtaaactcatgtcacaagggtttgttgtacagattattttgtcacccaggtactaagcctagtacccaatagttattttttctgaccctctccctcctcctactctctaccatctaataggcctcagtgtgtgttgttctcctccatgtgtccatgaattctcatcatttagatcccacttataagtgaagacatgcagtgtttggttttctgttcctgtgttagtttgctaaggataatggcctccacctccatccatgttccctcaaaatacatgatctcactatttttatggctgcatagcattccatggtgtatatggaccacattttctttatccagtctgtcatgatgggcatttaggttgattccatgtctttgctattgtgaatagtgctgcagtgaacattcatgtgtgtgtctttatgatagaatggtttatattcctctgagcatatactcagtcacaggattgctgggtcgaatagtagttctgtttttagctctttgaggaattgccacactgctttccacaatggttgaactaatttacactcccagcaacagtgtataagcatccccttttctccacaaccttgccggtatgttattttttgactttttaataacagccattctgactgatgtgagatactatttcattgtgatttgaatttgaatttttctaataatcagtgatattgagcttttttcatatgcttgttggctgcatgtatgacttcttttgaaaagtgtctgttcatgtcctttgcccacttttgaatggggttgtgttttttcttataaatttgtttaagttcattatagatgctggatattagacctctgtcagatgcatagtttgcacaaattttctcccattctgttggttggcttttcatcctgttgatagtttcttttactgtgcagaagttcttaagtttaattagatcccatttgtcaatttttgcttgtattgtgattccttttgacatctttgtcatgaaatctttgcccattcctaagtccagattgctactgcctaggttgtcttccagggttcttatagttttgggttttacatttaagtctttaatccaacttgagttgatttttgtatatggtataaggaagaggtccagtttcaattttctgcatatggctggctagttatcccagcaccatttattaaatagggagttatttccccattgcttgtttctgtcagctttgttgaagatcaagtagttgtaggtgtgtagccttatttctgggctctctattctgttatattgaactgtgtctgtttttgtaccagtactatgctgttttggttactgtggtcttgtagtttagtttgaacttaggtaacgtgatgcctgtagtgttgctctttgtttaggatttccttggctattggggctctttctggttccatatgattttttgaatagttttctctagttatgtgaagattgttgttgatagctttatagaaatactattgaatctgtaaattgctttgggcagtataaccattttaatgatattgattcttcctatccttgagcatgggatgtttttccatttgtttgtgtcatctctgatttctttaagcagtattttctaattctcatcatagaggtcttttggctccctggttagctgtattcctaggtattttattctttttatggcaattgtgaatgggattgtgtttctgacttggctgttggcttggctgttgttggtgtgtaggaatgctagtcacttttgtacattgatttcgtgtcccgcaactttgctaaagttgtttatcagctaaaggagcttttgggccgagactatggagttttctagatacagactcatgtcatctgcaaacagggatagtttgacttcccctcttcctgtttggatgctttttttttttctttctcttgcttgattgctctggccaagatttccaatactatgtggtgaaagagcgcatgcctgtcttgtgccagtttacaaagggaatgcttccagcttttctccattccatataatgctggctgtgggtttgtcatagatggctcttattatttttagatatgtttccttaagtattgtttatttttaaatgtaaatacttccccttctgatgacttgtatcttcaatccatttttattgtttctgagttttgacctatagcatcataaaatagtttttatatttatagcataatatatagaaaccaaaagtaaacaaggttacatcactgttaaactgacattactcaagttctggatttcaaaattttttaaattatttacatagaagttttacttttaaaaagtaattttgtgaaattttaatattttacataaacaataaaaatgaaggctctaagttttgccacagagtggggaagaaatagctgcttaattattatttcaaaagtgtaaccgtgtaataggcactatttttttgctacaatatttttatatattttatgttatctagactaaaatctcaaaattaagtatttgtttactatggtttttatctgtcccttttctattttcatgctatccaatgattagatacaaaaaaacctctatttactagctttcaagaagagcaaaaaatcatcccactgcctgctaactgcccatctattgcggttatggatgtttctgagaatattagagcaaaaatttatgctatattgggcaaactaggtaagaagttctcttcaaatttgcaagagtctgttttgctaagtatacacactgattttactttggagacagtttttcaaatataatgagcaaaaatctctttatatagagaaattcattttccattgttaccccaattcccaaactgcacccctcaccaattaaatcagaatctctgtgtgtgggatccaggcaatagtattttttaaagctccccaggcaattccaatgtgcagataggattaaggacagttagtttagatgattaagcttaaaatactgacattctgagtcacttgagtttttttttttaagtctttgctgtctattaaggaaaaagtttatcaaacactcttcagcttctgaagtaagatattattgtctgactacaacacagaaagaaatgattcctatatattggatgacctggcagaaatgtgttatagaaagaagcctactcacaagctactcacagaattaactttttcataaatcaagatgaaatcaaaagtaactttgcatttgtttttagataggtagatagatagatagatagatagatagatagatagatagatagattcttagaatcacttgctctgctaaagtaattctgtctttataaactttattttagattttgaaaatttacctggcctatctgctgaagattttgtcaccctttgtatcatacatagatatcttgattttaaagtaagtatctttttaataacctgattattaaaatctagatagcaaaaaattaactggaaaataaaatatctattcatggttgtgagcaatcatctacatactgtatagtttttatttttcattttgcatctgatgctgttgaagaaatacaccatacacccatcccatgattgggtgtttttcatgggataagatttcatccaacttagtttgtgaaagaagatgtacaaaactgatataagccgggcacggtggctcacgcctgtaatcccagcactttgggaggccaaggcaggtggataacgaggtcaggagatcaagaccatcctggctaacatggtgaaaccctgtctctactaaaaatacaaaaattagctggatgtggtggcgggcgcctatagtcccagctactcgggaggctgaggcaggagaatgatgtgaacctggaaggtggagcttgcagtgagccaagattgcgccactgcactccagcctgggcgacagagcgagactccgtctaaaaaaaaaaaaagaaactgatataaaactgttcagaagcctagcaaaaaaaaaaaaaattatttttatgagatggagattttgctcttgtcacccaggctggagtacaatggcatgatcttggctcaatgcaacctctgcctcccaggttcaagtgattctcctgcctcagcctcccaagtagctgggatgacaggcacccgccaccacgcccagctaatttttgtattttttaatttttgtattctcatgcctgcaatcctagcaccttgggaggccgaggtgggtggatcacccaaggtcaggagttcgagaccagcctgaccatacagtttcttctctttggagttgaaattaaataagtttttatttattaaaataaattattaatacttattaaagtattattttatcattactttatattatgatccaatcttgattaaaagatagtaggttacttaccttgctagttatatttgtcagtaaatacttttgaagtctcaagaaagtctttttaagttaacattgtccttctactaatattagtactgtatatttggatgttgtaaatgagtaaacctctattttctttctttccttctttttttttttttttttgaggcagagtctcatcctgtcacctagcctaaagtgcagttgcatgatcacagctcactgcagcctcaacctcccaggctcatttgatcctccagcctcatcttcccaagtagctgggactacaagtgtgtacccccatacccagctttttattgggggggggcggggcggggtagagacaaggtctcactgtgttgctcaggctgccttcaaactcctaggctcaagtgatccacccactccattcagcccaaagatgaattttttccttatcatagatatataatttttttctttaattttatgggtccagcacacttctgctgcacaactctgctcttttttctctaattctaaatacactcaagaacgttaacttctagacagcctagaatatgagatggagccactgacatgatggaaccatggagttaaaagcttgagattccattataatttgccttagctagaaagtgaggggcagggcccctttctcagggtggctgggttctagggtcctagtaatccccatgttcattctcctaaaagttcatcttgacctagccttcaatatagggctttagggaggaaagtaacgatagttcagaaagatcagaataaatcagcagtttctgcagctgtgaaatcaaggtaactataaactagagggcagtgatgatggtgatgatggcagggaactaggcataggagagccttatccatgaataacataccattgaaaaacatttgataaattcctactgagtactcaaatgtagctggtaccctcaatcattcccaatgcacttattcccaggaagtaatttaggaaaagtttaagtgttaacaggagtgactaaccatataaaaaattgtataattgtacaattgcatgatttgtttttggttaatttaactttgttaaactttgttataacagattggagaaatatggaatgaaatatatgaagaaataaaattagaaaaattaagaccagtcactacagataaaaaagctttggaagctattacaacagcatcagaaaatattggaaagatggttgcttctctgcaaagtgatataattgaaagccaagcatgccaagacatgcaaaatgaacaaaaagtatatgcaaaagtaagctacataggtagtgaggagggagaatgaagataggttggttaatgggcacaaaaatacagttagatagaataagttctgttgttcaatagcacagtaggacaactatagtaacaataatttattgtacatttcaaaatacccagaagacttggaatgctcctaacacaaagaaatgataagtgtttaaggggatggatatcccaattaccctgatcattacacattgtatgcacatatcaaaatatcacatgtatgccataaatatgtacaactattatatatcaataagaaagtaagccacagataccattaaggcacaagataataatttcaatgtataaacccagatgaagttatccataagatatatttttcttacttgtgggtgtttcagccttgagttattttgtggttttctcttagagttattttcagtgtctctgtgcagttttaaaagaaactatggagtttgagattgagttactatattcaatgctgtttttttgcattataattttatttctacagtcttaaatttttaaaaggcagagagatacttgagacatgccactggactccagcctgggtgacagagtgaggttctgtctcaaaaaaaaaaaagaaaaaaaagaaactgaaacttaattatctttctcatttcagatacaggccacgcacaagcaaagagagctggctaataaatcatgggaagatttcttggctagaacatcaaacgctaaaacgttaaaggtaggatttttaatgtattatagtatccacaacaaatagccaactcttacagacagactttttcaggaacaaatattcattcattttttcctagtgacctttccgtacaataccagcactattagatgctcatatgcaatttagagtgataagtgaaactgcatttcacagttacagaagatgctgctttgagtttcatttggtttatcagggagaaacaaggctgatgttcttgacctacataaagaagaagatgatagccaggaatgagcaggaaaatgtgttctgctttccattctgaacctgcttattcattgatttcttttctgtgagaggcaaagtaaaggacacaaagagcaactatcttgtattactctgtcccccaagagcttttccctctgtgatcaccaaaagaagcattatgttaaacttaaatgtgaactggggataaatatccctttgtagaaaaatgtggtaagctacttcaactgtaagctagaaactaatctaaaaaatgtatagtgctaatcgttcacttgaaatatgtgagaaacaccatggatttccagaatttcattacttttccccacccttttccattaatatcttggatacactttttaaaaaatctctccttcatttctgatactttggatagactttacctaatgtttcaatacttcctatagatataaaattgctaaatgttaagttagtccacaagacggtggaaccatattaagatagcaaaaccaaatttaagaacaagctcactcaaggtaccaagttatctccctgttcactgaaagttcttcccaattctacttataaaatgtcttcctaactgcctgtatttttagcactagttaatgaaaatcagctcctttcctgcaggtcatttattacttcacatttcacttgtttagtgtagcaaataccttgaaaataacttcaaatagcttaaatataactgcaatgaattacataatttatattattctgaatgcttaaaacatttaagtgtacttaatcagttggtaatttatgcaatatgttttgcaatatgcatcacctgatataaatttaatagcttattaaattatgtgctaaaaattgaacctgatttcttcaggatctgcttgactccttggtcatatatggatttcttggactacttccagaaatctctggaagacttttaggtgactggagtcttcttcaatgtgcaaagtatctaacttactaataactgtctttttagtctaaatgagtaaatgcagatttcagcgctatctaataaacaaccaaagcataagccagacacaattaaatatgtttttcattgtaagtaccatcattactgatttaatagcaattaatattttctttctaatttaaaaatcctcagaaagcaaaaagccttcaagaaaaagctatagaagcctccagataccataaacgaccacaaaatgcaatatttcaccaaacacatattaaaggccttaacacaacggtaagattctttctccataacattttcttaatagacattaaatttagagtgtttgaacaactgtgcaaatatactgaaaaccattgaattttacccattaaatggatggattgtgtggtattgaattatatctcaataaaactgttcaaaaaaaattttaaatttaaaaattagaagttaaaaaaattaataaaaaaaaaacttaggcccccaaaatattatgtcaatgggattttcatctcacattttttctttttgctgttcaaatttcacatcattaaggcatatttatctccaatgtatatccacttttgcccggttctggtttagagtaggcccagccctccaggatttctaagaaactgctataaacactagtcagcttataattgtccttatatctctttaacagaaaagacgcagtgcttccccttttcctggcgagtagatcccaagtgttcctggtatcctctgctagacttaatttgcccccagttacaaagctgataagcaatagaaatagaattcaaacctacttttcctggctccgatgcccttatctttctattataccataactgcctcctagttattcattacatttgtgtcttttcaaaagtaagctgaaggatgaatgagtttttctcttgttgaaaattgtgtaaatggacttttagatatttaccttttgcctttttaggtgccctctggtggagtagtaacagtggaaagcactcctgcccgattagtaggaggacctctggttgatacggatattgctcttaaaaaactgcccattcgaggaggagccttgcagagggtgaaagcagttaaaattgtggatgcaccaaaaaagagtattcctacgtaatatactatagagactttttgaaataaagtcagcttataattttttagctgaatatatctttatacatatgtaaagccaatattttagaataagtattttagtataaatattttagtaaaatactataaaaataaaaggacatataatttatttttatggaaaacatcaacatgtaatatcagaagagttgtcatcagtttctttggaaaggctaccaattttactaagtgaaattgtaaaacatagtacatcagttaggactctgttggttgcatgtgaactattctaactagtttaagtcagaaaaaaaatttcttacaggctctatacctatcaaatctaggaggaatttagactacaggcattgctgaatctaaggactaaaactatatgagtaggatcttctccttccctagcagctcctggcttacattctcttaggttcatgcctgtgtctctgtggtttctgcagctgcctatgcatctcaggacccctgattgcccacatgcctacggtagtcctgagccattcaccatgactttggccatggctgagtactgcctattcctggagccagaagcagggcaactccatccaaaacatatggatagagtggggaatcagggtactattatcagaagcaagtatatatgaatattgggcagcaagataaacaataactctgcaacaagtatgttggtcaaaataaaattatgttttctctgctataaaagcaaatgttagtcatgagccaaatggtaaaaaagaaaaaaaaatgcagctggttttactcttaatatataaatatacaaagcaaactctaatgctacttctcttctttaatggggaagggaaaggtgtaatgggggaagtgttttccctcatttggtagtagaggtatcttgtcaaagaataggagataaatgcctttatgctggacatagagcaaatctgtgtccctggatgcccttatgaagtctccctctcctgccttcattcccttcacacccctcctccagcctggaagccacaaaggacatgagttcatgtccaggaatcagagagacaaggacctgtttcttaggaaaataaactggaatttgagtctagattctgggcccatggggcacactcagcagtgtactggtaaatggataactagctttccaggagggaaaagccctgatttacatcatgttctcaccaattcacacagtataaatactgccactattaccaatctcaagctaccaacatgatgccattgaatacatggttgggaaaacatagataggttctttcattattagataagagcaggctctatcacctcaatgtacccacattttcctccttcttctttcctcctcctcctcttcctcctcttcccccaactcacattcctctagggattttccattatcctgtctgtgaagacagtagcatcttcattgagaggtaggggttgcagctcttgtcattgttctaattagaatgagttgccagttcaccttagattggcggcttctcaccctggcccagatgcccatcctcttgtgccccataggagtagataacatgcatcagcttatcagtgagctttgttctctcctgaatccctttctctagtctaccaccttcaagaagatattagaaggcataatttgtttctttccttcacagggaaccctaagcatgggtaggagcatacaacgagatgcccatacaaaaaataccagatacatcttaggtacacttgaattgatgtgaagtgtccatggctaacaatgaatctttgctccattttgtagactataagctctctaagaacaaggtagagaccatatctcattaattattgtacttagtatctccggaaataaattattagataatgtgatggtggcctcagctactggcagtctttcccttgagctctgcaaatgcagcaaagtactgagctcaaagggaagattcagccaacaaaatactacacaagtaatgctcaacacagacaacatgttagtttaaatgtatttacttcataacatgatagattttctccaaaatggtgaggcataaatactactacatgaatataaccaaggtgtggaaatagtattacttgcttgagtatcatttttgtatgtagtacaactaaatgtctcagattgattaggactgtaatctagacaatttctgatgtctgtgaacctttcttcttccatgtattttgcccatcagcaagaagaaaggtaaaacagggcagattattatgtagcagctatttaatagacaaataagtgtaagttgatggaaagcagtaatgttccttaatacagacacttgcacttggtagacagattcacccaagtttgcatattataattccagccaccacacagtgagtgagtgactctttctcacaatatcactaactctaagtctctgtctctcatcacatcctatattctcacaccacccctgagccctaggggacatgatgcctacccgatcctgccggctgagagaaggatggtatattttcttacattagtcaggtgagacaaaatttgaagctttcaaactgaaacttttactaaccaactgaatgaaaaggaagtcaaaagaataaaagtgtggaattcagtgagcacagataaaagtagcttcaacaatctcagtaatgagacttttaccacatgggggagctcattctagcatggttaaactaattgtcagacagtgctgacttacattgagtgaaaaattagtgaataattaggtgaataactttcatccatctggcatcatcagtctgccttatggaacataaagtattttatatacaactatattatccaccttaagtcttttgaggtcagatatccagtttctttcatcattcttctgataatgtagtttctagaatgtatgaatctggtcagctccatctgaagtgctacaatttgttaatactcctctaaactgtgaccaaacagatcaaagatttttcaggtgagcaggatcaatgtagttcctctcatttttacacacattctgccaacacaaccttaacttacattagtttcattagcaaccattttttattgcttatatttagttgcctttcaaggaaaatgtcagggatgctttctgagaaagaatagcagaccctgacatccaggaactgtcctggtactatcaggtcaaaattctatagatagacccaataccccaactttggtttccagtatcattctccaataaaatgagccagggcttcttggagaaatggctaattctaaggctggcgcagaaatatatgagtctggagcatcttactgagctcccagtggccaaagctggaatgatttgaacaaatcaataatgtagtgttggattataaaccaaagtataaacaaatgttcataaatccatactgatataaataaatgatgaaaggaagggaaaaaaggaaggaagggagagagaaagtgggggaagcctccatacaaagaattctaaatgatttatgtagatattccctcctcaagaaggtagaagataactacccattctcaagtatgggttatgcttagtgacttctttccagaggatgtaatatagaaagaaagtggaaagaaactttacaatgaagaaaactggcaaacactacctaagccaaggttaaacaccaccaatggcaagtcacgtcaatgacatgtgcctttgatatgacgtgttgagtatgatactttacctctgtggtcttcatcccaaaaacctataatcccagtcaaacaaagacatcaggcaaacccaaattgaggggcattttgcaatatacctgaccagtactcaaaattgtcaaggtcatcaaaaacatggtctgagacattgtcacaacccacaggaacctcagaagacatgacaactcggtgtaacgtgggatcctggaacaacaataacaaaaaaggagcttagggaaaaactactgaaatctgaataaaataggaagtttagttaatattgtattggtttcagtgtattagttgtgacatatataatgttaagatattaacaataagaataaacatggggccaggcacagtggttcaggcctgtaatcccagcacttgggaggctgactcaggcagatcacttgggtccaggagttggagaccagcttgggcaatggagtgcaatcctgactctacaaaaaaatacaaaaattatttgggagtggtggtgtagaccacaaccgtagttccagctatttgggaggctgagataggaggatcaattgagcccaggaggttgaagttgcagtgagccgtgattgcaccactgacagagcaagaccctgccaaaaaaaaagaaaaagaaaaaaaaatgatgagaggtatataggaactctgtaccatccttgcaacttctctgcaaatttaaaactttttttttttttttacagtttggtattttttattattattatactttaagttttagggtacatgtgcacaatgtgcaggttagttacatatatatacatgtgccatgctggtgcgctgcacccactaactcatcatctagcattaggtatatctcccaatgctatcgctcccccccctgctttaaaactattttaaaatgaaaagtttatcaaatttacaagaagaaaaacattaaaaagtgggcaaaggacatgaacagacacttttcaaaagatgtcatacatggagccaacaagcgtatgaaaaaaaagctcaatatcactgatcattagagaaatgctatgaaaccacaatgagataccatctcacaccagtcagaatgactgttattaaaaagtcaaaaaacaacagatgctggcgaggttgcagagaaaagagaatgcttatacactgttgctgggagtgtaaattagttcaaccattgtggaaagcagtgtggcaattcctcaaagagctaaaaacagaactactattcgacccagccatcccatgactgagtatatgctcaggggaatataaatcattctaccgtaaagacacacgcacatgaatgttcactgcagcactatttacaatagcaaagacatggaatcaacctaaatgaccatcatgacagactggataaagaaaatgtggtccatatacaccatggaatgctatgcagccataaaaagaatgagatcatgtcttttgcaagaacatggatggaggtggaggccattatccctagcaaaccaacacaggaacagaaaaccgaataccgcatgttctcacttaagtgggagctagatgatgagaactcatggacacaaaatgcggaacaacaggcactgaggcctacttgattggtggagagtgggaagagggagaggatcaggaaaaataactattgagtactaggcttagtaccggggtgacaaaataatctgtacaacaaacccccgtgaaatgagtttacctatagaacaaacctgtatgtgtacccctgaacctaaaacaaaagtttaaaaaataaacaaaattaaaagtttatttaaagtttaaaaaagattctggccaggcttggtggcttacgcctgtaatcccagcactttgggaggcagaggcaggtggatcatctgaggtcaggagtttgagaccagactggtgaacctggtgaaaccctgtctctactaaaactacaaaaaattagctgggcatggtggcaggtgcctataatcccacctacttgggaggctgaggcaggagagtcacttgaacccgggaggcggaggctgcagtgagccaagatcacgccattgcactccagcctgagcaacaagagcgaaactccgtctcaaaaaaagaaaaaataaagattcgatagaaacagcagaggaactttagacatagataattattatcccttgtatcatcttatgaagaaatatttgtggggtcaatattagatcctttgccaccttttttctcctcagccttaagctctctgaaaaataatcggttatgagctaagccaaatgagctcagcataaacccaaagctgtgaaactgaatctttaccatggtaccactgcaagaattggtggtttgttttttaaaatgatctctagactgtcaaatgattttgaataggacaaaagagaaatacatattgtcccaattcagcttcattttgaccaccttcttttttatcttctattttgatatcataaaattgcttttgaattagatctttcagtctatccctgcattgtcccacttcagtgtcaactctgtgagtcaaagattacgtctggattgttcactaatataccctaaagcttaatgaatatttgttgaatgaatgaatgatgaacagaaagaaaaagtttttttatatgcagatgacactatttgtgccaaaaacggggaggaatttacggtatgtaatcatcatcaaaaagcttaagatgagttgttttaaaaccagattgcccagtttagcaaatgttcttatttttaacccaatgtagtatgtaaattcaattaaaagaactagaaaaccattttgccattaactggaagactaattttattgatttaagctaaaatgtttatcatcgctgcaataaaattgtcatgacaactatgagtgattgaggacaactggttgaacaattttttagactaaaagtacatggtctcactttacagcattgaacttttgagcttcaatcatttgcccacagactgtaaaagagaactgttttttttgaggaaaactgtaatactgcctctaggtaccacttcggctcctctgcaggaaatgaattctaggtggatagctgtcaggtcatttttttttttttagaccaaaagcagtttaatgataaagaacacagatgttcaatatggagatgagaaaggacaggaaagttcttggcaagattaactcaactttttactcctgtcacataaatgtgactcctctcaaatgaatcatcacttttcgattagagctaaacagtaataaagtgtcaatatgaaaatatgttgaaatttaaaaactcatatcagactaattatttgtcatataaattccacaaatcaaaagcttaatggacataaaatcactcatgtttacacgctgtctggtcatttttatgagaacattaattagccctaccctccaaccagttgattttctgagcttagggatccacccttaattggcaagataagaagttttcaatctaggaaattattagccctacaatcttatattatctgctactcatgcaaaattggttatatgaaataatattgccgaacgctatgaggtcctttaatattgaaaattcctaacctggggtttatgcagccccctgaaattacatgcaaaatgtaattttaagagtgtttatatataaaacccctaataaatggtctatacatcatcagaatttgaaagtggtcaataatgcaaagaacgtccctcctttaattcagcttattcttggatcaagtcaaaccatcaggcagttcgttacttgttcagtattattttagccgattttaaaactttttatatttgagtttgagtgtactggaatcagactgtaaaggagagaatctgtcattgtaaggatacttgaaaccagtgttgtaaaccatggtagccactgtgaaaacctatgggtgagattttcattgattctttgtcctggaaaaggctggacctctgttgaacatatggtttggtttttcttataagcatgtgaatcttgaaactgttcatgtgtccctcttcactaggagaagtgggaaacagaccaaatttataggcaccctttatcaaaggtataggcttttacgacatgcattcaaaaagtattaatctaaaccgtaactccattgtattacttccctgtcttcatgtcccaatgttccaatttcctccactacttcatgttttccttttcttcggtatatttctttaaagcttcacatcctttttgaaataagatgtgagatataaataggcaatataaaaaataactcagctaacacaaaaattctatcaaattgtactttactgaaatgaagtttctgtctttgtttattgttcctttttcaaaacaaagacaataaaaatgagaacataaaaaggttttagtccttaatgcatagaaaaatactttaatatagaagatggcttggtaatgaaatgtacatttcagaaaccacaaaatatactacattaaatattactttttaggataatactgccattagttttggcacagtttaatagtcaatattaatatataagataccttataaaattggttacaattttattccattgactattgtatctaaaaaatatatcacatttgccttttaactgatgttttctttaaaacaaagacactttaaaaagacaccttctaagtaaaaaattgagaaattatctgaaaatattggaataattcaatagcaataaagcaattacaacaaaaaacaacgtttatcagtattaaataatttgtataactatgacaagaaatatttgacctcataaatacaagttttcaggtcgctgtcatcttgcttgaggtattttacatgttttctcttaaatgtaatactctcattttgtaaaatctagtcctgtaagatttaaaagaagaaattgttaatattcattccaatatgactcttaaatttcctgcttttatacaaccctattgaaaaaattaatttcaaaagcctaaatacatgtctgatgtttaaaatttcttcaacaaatgtaatatgaataattacagggttaaatggctttcttatgaactattcatgggcaaacaaggataattttaattatctaccaaagtgtattatattccaagatcatttaaaattgtaagtcagagcttgtgtggtttgtaaataatgtaaaatgagtaaaaatgagaatcaaaacctatcattttagggaaaaaaactaaatatggtaaatttgctaccttgttggataacttgaaaaaaatcagaagaattaaatagtgacttttaaagaaaagtaaactgctattctcttaaatacacatttaaattacctcctgttattttctgtggaaaattatatttggggggcatcacctgtcttctgcccattccatgagatcttgaaagcaagcagtctacatacatgtcccagaaatcctgagctatgtttaagaagacattataatgtccaggccgctgagatttttgcaagaacaacatgaaattccaaaaagcatccacattgtgctctatcttgagttccttgagatctatcaatgtcaaagagcaagctttccagcactggagatcaatgtctttggtgattcctgggctgatgctggcaagcactcctttttgaaactcaaagtcagcattaaccagattgatcagcatcatgcagcccaaatgtagatagaaccatcttcttgtagcaaaacacatattctatacagaaaaaaaaatgagagaggatatatttaacttaaaaaagttattcaatcacttgatctaaaaaactgtaagtacacatatatttgcttttgatcaagccaaatctgcttactaggtattcattttttctaaattactgattatcacatcttcctttaggatattacagttccggtttgatttccaacgttctgatcaagagtctttgaaatgcaacacatttatgaaaatgcaaaggttcatttcatcacagacctttaaaagtggcagaaaccctaaagagcttatgctccaaccttctccctttactgattagatcattagtgatacggttccgcaagtcttcagactcctgactgcctatccaagactcctacctaccacaacacatttcaactaagtggatcaaaatacagtcctttctacatgtaacataggaagtattttgttgttgttaattgagatattattaacccaaatggtactagatctcacaaacaccgtttaagtctcaaagttactgctatttccattttcatgtattgaaaaatacttgttacgcactaatatccggtgtattcttggcttccctctgtttaggagctggttggagaagatgaacgtagacatacatgaagtggcacgaaaacaaaggtgatataaggtaggatgagatagtgcagggcccattacattcagcaaaatcttgacatttttctaatgcctctttgcatgcctccttgccaactgattgttgggtaaaatcggcccaaagcacataagaggaagttaaagactaagttggcattgaattgccacacacctgctattcaaggctgctgttggaaatgtcccttttacaacattgacagccaacggggagggatagggagaggagaacagatccagaacacaggactcacctttccccccgtacacagccgtctgccacctccctaaaaaagttgggctgaagagagaaatcatacgaatcaaatctaaacaggacattcaagtcatttcacatcgtcgaaaattgtgcaaattccccagactgagctgaaagctggcagtttatgatacatgatgtatcagagggaatttcttccccctcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctagaggctgagtgagggggcagatcgtgggtggccgcgctctcgaggcccctccctgacctcgcccaacttcccagcctccagacctcgggggcctctgcgccctgcggccctgctttggccgctgctctcgcctctcctgccctcctccgactttcttgctatgccaaaggctcagggtcttcttcgctctctccttcttactttgttccttcttttttcttagctgagaagatccatctcggcattagtcagtccacatacccaagttatcttctccctccgcccacccatgctccacaccgtattctcctatccagagaaaaattctcttaaggctgtgaactctcttaaaatgctaaacctccttgaacggttctaatctctagctaaacacagtttattattaacgctaacacatacacacgcgcaaacatacccttgcttctacactgggggaaatgtttcctttatcccttcatggatgaagacccgagcaagtaccttgaatttcacatatgtatgttgtccatcaatctcagccccaacacatcacttggactatatatgagtttaagtctacctgctctgcctatagcccagcagcgatgatcagatggggctagggaaatcaaagccagctgccttatccccatttcccctcaggcaggccacccttctcacaggttcttgagctgggatggtgagatcatggggtgagatgagtgccaaaccaaacagcccagttccccagtcattgtccctgctaaagctcacttctcccagcacccaccattattcaaagctccaccctgttctcatcctgttggtggagctaacgtagtcaatcattagttctgccctggcaatgcctttttatgccccttctatctgcaggaccacctcctgcacaaaacagaactgagaaaaggggaagacttgtttactcggattaggtaggatatacacgaatccatctcacaccagatattcttctgctgtagacttccaagtgtttcagtccaccattaatcatggactctcacaattagcagagatgcagagtgacctaatccaacatcccagctgaaacgtgaacaaaccaccctcccaaggaatttgtccacccaccaaagctgttttccaatgtgacttaaccttgggcacatgtccccacccccaaaggaagcaaccccttccatctttgggttaatgttggcttccttctaaaatgaattggctcaatttctctgttgagtaaccacatagttcctgtccgtcttttttgaaagatatactttatttttcataaaacatttttatctgtttacaagtattcaaaacctattgaaaagttgtaaaatacagaaaaatgtaaggagacaggtaatagttgtcattaaaatgcatttttaaagaatattctaatattagaattagagtaatgtactaaataggagtacatatttgggtatgattattataacacacacacaggaatggtattctgaatagagaacttatataaatcaataatagaaaaataagggtaattgacagaagagtagaccttaatattcagtaaacatgagaaaaaatactgaaatattctaaatttagatagacttaataacaaagccatttcaaggaaatgatatattgtcttccccaaatgaagcttaacaaaaattaatttggtaaaatacaatctcagcaattttttgagaaaatgaacacttcatatgcttttgatgagactatcagctggtataatcaccaaggaagaaaactggcattatctgtttaatctgaaagtgatctagaaattttactcttggtgtctacccccaagtcagtgagagaagatattctttatgtgagtgatttttctgaagggtctacttgctacattcaaatagaatctggcaaaatgatgacaaacataatttttaaatcatcattgggtgatcaagaaagtgaaatctccagggaaaaggcggatggaggcaaagcataaagaatcagaatatggaaaagaagaaagaagagaaagagagaaggaagagaggaaagtgagatgtagatagtaagtttaggctttattaaaactggtatctacagtaaaaagtgagatatagatattgaatttagactttgcaaagttgttaaatatgtatggtaaaatttctcaggcaattcctaaatgacggaaatagagaacaaaactcttgaaccagggagaaaaacagattgacaaataaaaaattaattgagaaagcaagaagagagaaaaaagcacagcaaaagtgacaagtagaaagtaaatttataagattcaagtcaacaatcataataatagtctgaacttcttgattaaaggaaggaagatgtggttggattttaaattctgctatgtgcttttacaaaagatacacacacccaaaatgaggacagagaaacttgaaaagaatggaaacaaatataccatgcacatgttaattgtattttaaactgacagctttattaatacaaaaaagcacgatgaaggagaaaggggaacactacataatgataaaagactcaattcaggaagaagataaaaatattctaaatttagatatacctaataacgaagctacagaatacataaaacaaaaactgacagaagtagagggaaattttcacaaactcactatcatagtgggagagttccacaagcctttaggttaagatgataaataatactaaatgtgtagatgatttgaaccgtcaagttataaggaaccatgaaacttgcagttaaagaacacattcctcccattagaaaataaagcaagtctcgggtgcagcacaccaacatggcacatgtatacatatgtaacaaacctgcatgttgtgcacatgtaccctaaaacttaaagtataataataataaaataaaagaaaaaataaagtctcatgaaatttaaagcaagtctcaacaaatttcaaaaactagtatcactcaaacttcgttgcctgaccacaacacagaaagtttaaaagtctaaaaagtgttttaagaaatataaaaacaagaacgtagtttttcatgttttgaaatttaaacaataaatgtacttatttatgcaataactttaaacaatcgattttaaaataaaatacaatggaaattataaaatatttcaaactgtgtgattaaaaaacattgcatatcaaaacttgtgagaagccagtaagaggatcctttaaaggaaattaacagctttaaacacttgtgccaaaagaagagaggctgaaaatctgatagagtgataaatgcaaccaaatttaacagctggtaaaatagcagaaaaaaggctctcaaaagttaagagattttacaaaaacacacattagtgaactaaggcaaaaagagttgattctttgaataaaataaagcaacctctgatgaggctgatcaagaaagaaaatgaaaggtagaaaatgatatatatctatagatagcaaataaagattaaaactagatacacgaatactaacaaccaacatataccatatatttgaaattttaaattaaattaataaattcctagaaaaaatatctataaaacttggccaggcgcagtggctcacgcctataatcctagcactttgggaggctgaggcaggtggatcacctgaggtccaaagttcgagaccagcctggtgaacatggcgaaaacccatctctactaaaaatacaaaaattagccaggcatggtggcgcgtgcctgtaatcccaactgcccagaaggctgcggcaggagaatcggtggaaaccaggagacggaggctgcagtgagccgagatcgcaccactgcactctagcctgggcgacaaagaaagactatggaaaataaaaagaaaaaagaaaaaaatctataacagtcatgtaagaataactacaaagccagaatagtaaatgctgtttaaagaccttgaataagtagtttaaaatcttcccactgggaaaaaaaaaatcaagcccatatgattttgcagggcaactttcaaggatcaagtacttcctgaaaattagaaaagaaggaaatctcccagactcattctaacaaaatgagacaaggacgatctgaaaaagagtaaagtcacaggccatcttactaatgattacagataaaaataaattctaaacaaaatattgacataccaaattcagtaggacttagaaaaaacccagcagtatcaagcttggattatcctagggatgcacgggtagtttaacacaggggggcccaggccgtagattggtaccagtctgtggtctgttaaggacccagccgtacagcagaaggtgagctgtgggccagcaagcattatcacctgagctttgcctcctgtcagatcagcagcagcattattctcataggagcgtgaaccttagtgtgaactgcacatgcaagggatataggttgctgctccttatgagaatctaacgcctgatgatctgaagtgaaaaagtttcatcccaaaacatccctccctgccctccccacccaccccatctgtggaaaacttgtcctccacaaaactggtccccagtgccaaaaaggttagggactattggtttaacatattaaaatcaatgactatatttaccatgtacacaaattaaatgggaggctgggcacggtggctcatgcctgtaatcctagcactttgggaggccaaggagggcaaattgcttgagttcacgagttcgagaccagcctgggcaacatggcaaaaacctgtctctacaaaaaaatacaaaaattagccaggcacagtggcacacgcctatagtcccagctacttgagaggctgaagagggagaatcacttgagtccagaaggtagaggttgcagtgagctaagatcacgccattgcactctagcctaggtgacagagtgagactctgtctcaaaaaaaattttttttaaattaaaagaaaataaattgataaaattcaacacccattcatgattaaaaagcaaaaacaactcttagcaaactaagactagacaaaattttcttaacctcataaatgttatccactagaaccctacagcaaacatctttcttatggtaaaatactaaaataattctcttttaatttaggagcgagaaaagatgtgcatcatctctgctaacatttaaaataatacctgcaaagaaagggttagaaaaaagtggggagtggtataaggaaaagaaagagagaaaaagagaaagagagagggaaggaagggaaaggaggggaggggaatgaaggggaggggaggggagggaaagggaggggaggggaggggagggccgggcagggcagggaaggaaagggaaggatcacaactggatagcctagcagagaggcagcaaagctcttggtgagcatggagcttagaaatcaactgcctgggtttaagtcctcccttctgtgttcagatggtaatttgtggctttgagctaatgatttaatctctttgtggttaatttccttgtgagtaaaatggagatgaaaaatgaccctgcttaaaagggctgttgtgataaatatttagtgttctgaatagtgcctagcacagcatgctatgtggaatcatttgcttagaaataataataacataaattatactgacaaattaacaagttttgttaagtggttgaatataagatcaatctacaaaatctactgcatcaactatatacgagcaaaagaccagaacatataaattagaaaagagatgccatttacaatagcagtaagatgtataaggtaactaggaataaatttaacataggtaaatgaattctaagtggagatttttaaaatttttattgaaagacataaaagacaatctaaataaaaataatgctaatatatgatctataaagatatcatctgcccaaagtaatatatgcattttcaatcaaaatcacaacagggttaatgaaaatgtgatgctaaaagttacatggtaaagcaaaggctcaagacagccaaaattctcctaaagaaggccaggcacagtggcttatgcctgtaatcccagcatgtgaggaggccaaagcaagaggattgcttgagcccaggagttccagaccaacctgggcaacatagtaggacttagttgctacaaaaaattttaaaaattagccaggcatggtggtgtatgcctgtagtcccagctacttgagaggctgaggtgggaggatcacttgagtcagggaggttgaggctacagtgagccatgatcataccactgcatgccagcctgggcaacagagtgaaaccctgtctcaaaaaaaaaaaaaaattatcctgaagaagaacagtaaggagcagggtactcactagttattaaacgggaggttattggctcaggaataaagaaattaaacaatggaccagattacagaccctaaaaataaacctatccatttatagaaatgtgtaaaacaacatgggattttctttttttttttaattatactttaagttctaaggtacgtgtgcaggtttgttacatatgtatacatgtgccatgttggtgtgctgcacccattaactcgtcatttacattaggtatatctcctaatgctatccctctcccctccccccaccccacgacaggccctggtgtgtgatgttccccaccctgtgtccaaatgttctcattagaacagtggattttcaataaataaagctgggaaaactggttacccatatggaaaacgaaattagattcctacgttataccatcataaaaatcaatcccaggtatattattaatttaaatatgaaaagcaaagcatttgtactttaaaaagaacatcagaagaatatctttctgatcttggggttgagaaggacttcttacaccagacacaaatagtgctgaccataaaaggataattaatacatttgactgcattaaaattaatgtcctgttaatcacgagacactataaagataaaaaataattatattctgagagaagatatattcagcacttataatcacaaatgaattaggattaagagccaagatagaagacacttccatcgaatcaagaaaaagataaacacaataatagaaatctgggcaataggcataaagaggcatttcatagattaggaaacataaataatgaataaatacacacacatattcattatttaattgcaggcaggaaagtgcaatagggttaatgaaaatgtgactctagggggttatatggtaaagcaaaggcctaagatagctaaaattctcctaaagaaggccagattcagtgactcatgcctgtaatcccaacatttggggaggctaaggcaagaggattatatgagcccaggagttcaagaacaacctgggcaacatagtggggccatgagatgtgcacttgtacccatcaggtcaaacattaagaagtctgacaatatcaagtgttggagactgggtgtggtggcttatgcccgtaatcctagtgctttgggacacaaaggcaggaagatcacttgaggctaggagttcaagactatccttggaaaggcccctactccacaattttttttaactgggttgagtatggtgccatgtgcctgtagttccagctacttgggaggctgaggtgggcagatcacttgagctcaagagtttgaggttccagtgagctatgatcccaccactgcactccagcctgggtgacgtgagactccgacttaaaaaatatcaagtgtcaagtgttggtgaacatatgaagaatgttagtcagggttctccaaagaaacagaaccaataggatctagctaacatatgtatatattatattttatataaagatatatatatatatatatatatatatatatgaagagatgtattataaaaaattggttcatgtgattatggaggctgagaagccccacaatctgccatctgcaagctagagacttaggaaagtcagtggtatagttccagcctgagtccaaaggccttaaaacgaggaaagctgacagtgtaagttcaagtctaggcctaaaagcttgagaacccggagagccaatggtgttaagttctagtgtgagagcagaagactaatgtctcagctcaatcagtcaggaagaatcagtaaattctcccttcctccacctttttgttctattcacgccttgagtgaactggatgatgcctatacaatgaattggctgatggggagggcaatctgctttattcagcctgccaattcaaatgctagtatcatccagcaacacactcacagacacacccagaaataatatttaaacaaatatctgggtaccccatggccagtcaagttgttacatataactaaccatcacatgaggcagtaggactcttgcatagtgctaggaggagcataaattggtacaatcagtctagaacacaaactggcaccatcttctaagtctgaacaagtatgtaacttgcaataagtttttcaatcccaggaatatatcttgaagaaattcttgcaaataggtgacaagaaacataccctaaaacggaatattcatggtagcattgttcacaaaagcaaaaacatggaaaaaatcaaaatgatcactaacataatagataaattaactgtggtatatccaacattgcaagttgttatttgacagtgaaaaggaatagactacagctatatgagttacagattttaaaaaatggattgctgaatatatcatttttatgaagttcaaagacaagcaaaattaaaccatatattctttctttacaaatacatacatttgataaagcagttttaatagtaaggaagtaattcacacaaattcaggagagtggttatgtttagatatatgaggaaacaagatctggaaagaatttatagagtgtctttacagacagtgatttcactagtcttcttacgcctatggtttctaactatatatgttagaatatttagaatatatataacatgtataggatatatctgttagaatatatatttttctattatcaaataatgcataataaaacatttagaacaatgacagaaatgacatatttcaaagatagaaagataaaacataggtcgggtgcggtggctcacacctgtaatcccagcactttgggaggccgaggcagatggatcacaaggtcaagagatcaagaccatcctggccaacaaggtgaaatcccgtctctactaaaaatacaaaaattagctgggcatggtgggtgcacgcctgtagtcccagctactcaggaggctgaggcaggagaatcgcttgaaccgggaggcgggggttgcagtgagcccagattgcgccactacactccagcatggagacagagcgagactctgtctcaaaaaaaaaaaaaaaaaaaaaaaaaagaaagataaaacatggtgatttatcgcattgatatgagatggagcgagaacaaaaaagaacgagtgctttcagcatacctgcttatggagtgtcattgacaaatatgaaagatcgaaaggaagatgattaggggagaatgaatttgatttaggatgtgttgtattagagttgattctggatcttctggaatatctaaaatttatctagaaatataactagtttgagaggtctctgttttgacagaaaattagtgccgcaggtcgagaccagcctggctaacatggtgaaaccccgtctctactaaaaatacaaaaattacccgtgcgtgatggtgtgcacccgtaatcccatctactcaggagtctgaggcacgagaattgcttgaacctgggaggcagaggttgcagtgagctgagattgtgccactgcactccagcctgggcaacaagagtgcgaccctgtctcaaaaaaaaaaaaaaaaaaaaaaaaaaaaaagagaaagaaaagaaaagaaaaaagaaaattagtgaattagtgccaccatgacagtatacattgataaaagaaagttgagatgaatatggggacctatgcccaaatttcggggctcataaactgcaaatggaatcaatgaaggaagacaggaaagaataatcagcctatgtaagctccagggtgatataatgtcatagaaccaaagagaggacatagttgaagaaccagaagactgctgtagggtcaaacactttagagagcggtaggagaattggatttgagacagatttttcatttggcaaaatggaagagaagcggaaaactcagaagcacacaacacatgttaagacagtcatgataaatttatgtaaatgtttagattttacagttggttatttataaagtcaagtgtattacctaacgaatccacctaatttatcatcatagcccaaacaagccatctaactaagcaagtatgttttccaagccacgcatttttttattagaattgtcttcacgagcagcaatatattcaccatcatcccgttcctagaatatttctgttatccccagacttcatctataagtcatatcatagagcatttctccctttatctctttcacctgacccaactctaaagctctttctacacaactgagctttacctctgcaattgggtatctatattcactatattacttgacatccatttttgaatgactataatacgttgtctttcttccatgaaagcatataatgttctcctacaagcttataaaaatgtctctatttcacatgtttttaatgactggtatatagtacaatggacacaataaatatttttagctgatttctatttcatatccatgctattgccccctctgagggagttttgtcagctttccaccagccacaccccttaattctttcagaactccagtgctgcttgagatttcctggtttaatcaggccagtagcctattcatttgcccacatgcttcctactttccaatcacttagtgcagttttgtcacagttgtgttaatcccatttctcctttattgagcgtgcttctccaggaaatattgccatcatcactccccacaaaatctagaaggtcactccacacaccgtcaggacatgttgactgagtaatgctgctgaatacctacaaaaagaataatttttcaattcattaactttttgactcagtataatgaaagacattaatttgaaacatctacaattgcaattgcctctagtaaactttaataacaatgtatttatcaaagtgcgattcaatcaccttggggagaaagaaagcaggaaatgaagttgaaacaagtaagtacccttcagagaaaacaagcacttgttgacagctgactaattgaagagaaagaaggcattcttttttcaggaacacaggagacaaagatgaacaaaagactgtctcagagacaggaaaaaaatagttcaggagggaagtgaaaaagagatcactagtccttacctcttccaaaagggatgattagtagaaaatattttgttattgtttaagaacaagaaatacaaatttatcttaggacataaagacaaacacaaaggcatataaacattgtgtattttaggatcctcgttttccttttttgcataattttttagtggttgttctaagcattgcaatatatatccttaatatttcagactacttagagttaatattgaatcaattcatttaaaatgtagaaatcttgcaaggtatgagttcatttactcaccttttcatcctttttgctatagttgtcaaatgcattacgttataaatcctatgatgcaatgttatcattttcagtgctctttattttttgccgctgaagacctgattttccatctggttgtatttctcttcaacctgaagaacttctttggtatttcttatagtacgtgttcactggctacatatacttttagttttctttatctggaaatgtattttacttcaccatcattcttttagaattattttcactggatatagaatttaatgtagttttgagttttgttttattctttaaagatgttgttccactgtcttctggtctccattatttttctgatgagaagacatcaatcattcaaatcacaattcccttatatgtaatgtgtcatttttctctgacagctttcaaaatatctttagttttctgcaacttgctgacaatgtgccaggtgtgtgcaatgcaattctgacattacctagagtgaggtcaaatttcacaagttaagggtacagtcttccataagagctcccttattttgttataggtagttaggcatgagtggggcacgtgagggctctcccccagccactaggaatgtcaggtgatggttcagcaattatcacattgactctctaaaagtgacaaattggtagccagtgcaagggagaggccatttcctgatgatccacagctactgcactgaagtgtccactgaatatagatgccagagagaaggaacttactgagcatgcacattaagacacaaaatggcagagtatgaccttccaagggcacagcaccagaaaagggaaaaaagcctcagatgggcatgtgtacaactaaacacaccacgcacgctcacttcccaagcacaaggagtgcactgcacatgcaggcagcccactctaagggaagaatcatgggaaaggggccagcctataaagtcctaggatcaaggtaaagcactgcacttgttcttcaagttgcctgattggatctcttccaagtgtactttcctttctttcctgttctaatgccttcttaataaacttccactcctgctctgaaacttgcctaagtctcttttttttctgctttatgcccctccatcaaattctttattctgaggaggcaagaactgatgttgctgcagacctgtacagattcatcgctggtaactcagatactgagaggtgacagcatgctggcagcccttgcagccctcgctggttcttggcgcctcctcggcctcggcacccactctggccgtgcttgaggagcccttcagccccccgccgcactgtgggagccccttcctgggatgggcgaggccggaggcagctccctcagcctgcggggaggtgtggagggagaggcacgggcgggaaccggggctgcgcgccgcgcttgctggccagctagagttctgggtgggcgtgggcttggcgggcccgcactcggagcagccagccggccccgcaggcccggggcagtgagggtaattaggatccgggccagcagctgcggagggtgcgcggggtcccccaccagtgccggccctgtggcgctacactcgatttctcgccgggccttagccgcctccccacggggcagggctcgggacctgcagcctgggcaccctcccccccacctgtgggctcctgcgcagaccgagcctcccgaccagcgccgccccctgctccacggtgcccagtcccatcaaccgcccaagggctgagaagtgcgggcacacggggcaggactggcaggcggctcccgctgggaccctagtgcgggatccactgggtgaagccagctgggcccctgagtctactggggacttggagaacctttatgtctagctaacggattgtaaatacaccgatcagcactctgtgtctagctcaaggtttgtaaatacaccaatcagcactctgtatctagctaatctagtgaggacatggagaacttttgtgtctagctcagggattgtaaatgcaccaatcagcaccctgtcaaaacagaccaatcaggtctctgtaaaacagaccaatcagctctctgtaaaatgaaccaatcagcaggatgtgggtggggccagataagagaataaaagcaggcttccccagccagcaggggcaataggctcaggttctcttccttgctgtggaagttttgttcttttgctctttgcaaaagctcttgctactgctcattctttgggttcatactgcctttatgagcagtaacactgatcacgaaggtctgtagcttcactgctgaagccagcaagaccacaaacccactgggaggaatgaacaactccagacctgctgccttaggagttctaatgctcaccgtggaggtttgcagcttcactcctgaggccagcaagaccacgaacccaccagaaggaagaaactctgaacacatctgaacatcagaaggaacaaactctgaacacgctgcctttaagaactgtaacactcaccacgagggtccaaggcttcattgttgaagtcagtgagaccaagaacccaccaattccggacacaatatcttccaccagtaacaccttcagaaactagttgcaagcccgggattgctaggtccttgttcttctgactgactggctacaaattcaggcattcccattgccccatcagattctgtaatttgctagaaatgacttgcagaactcaggaaagtatttatacttatagttttattataaaggatatagatcaggaccagaaaatgaagagatccacagaatgcagtctgggaaggttccaaacacaaaagcttctgtgtcctaagagcattacttttttgaatcattaatatataattgccagttacagaagctcacctgtgccttggtgccagaatgtttactggcggtttttttcttttctttctttctttcttttttttttttttgacacagggtctcactctgttacccaggctggagtgcagtggcatgatcttggctcactgcagcatctgcctcctgggttctagcgattctcctacctcagcctcccaggtagctgggattacaggcacgcaccaccatgcccagctaatttttgtatttttagtagataaggggtttcaccatgttggtcaggctggtcttgaactcctgatctcaggcgatccacccacctcggcctcccgaagtgctggggttacaggtgtgagccaccacacccagcttggagttttgttatataggcatgattgattgaactgtaacttgaaatatcaggggtttggtccaggtcctgctgcttgctgcacagaaagccagtcactaagacaatcattattgccaaggaagaagactttaatggggtcctgcagtcaaggagataggagatcagtctcaaatccatctccccgaccaactaaaattaggggtttatttagcaggaaagaaacataattacgtgtggaaaagcaggaactcaggtggggtaagaaaccaatcgtgatgaatgagggcttgaactctcattgtctggtgagtttcagttctttcatactttatttatttatttatttttgagacaaggtctcactctgttgcccaggctacagtgcagtggcacaatcaccactcactgcagcctcaccctcctggactcaagcaatcctcccacttcagcctcccgagtagctaggactatcggtgcatgataccatgcccagctaatttttgtagtttttatagagatgaggtttcaccacgttgcccaggctggtgtcaaactcctgggctctagcaatctgccctaccttggcctcctaaagtgctggggttacatgtgagagctactgtccctggcctctttgatactttttgagaggcctgggggtcctttcctgaggaactcacataaaagataggtaagtttcaagctttaagaccataagggtcaatttctatatttatccaaaaaaaccatctagtggtctgttgcatcagtttcagaatcattggtcacatgattgaactgaatccccagccctccccaccacccaccacccaccacccaccaccctaccaagaggtacagcttatatcacatgcaataacatagttggtcattctgatatggtcagcccccagcctgagtcatctcatttgcataaactcaagtgtgatcccaagggcccatcaaggataaaagataattctatcaccccaaaaaattccaaggatttagaggtcatctcccagggacagaggtcaaattctttacaacagtgtggttttctttgtatttatccaacttcttggggtttgctgagcttctttttatttttttaagacagggtttaccctgttgccaggtgggactgcagtggcataatcagagctcactgtagcctcaaaactcctgggctcaagcaatcctcctgccatagactcccaagtagctgggactacaggcgtgcaccactacacctgactcattatttttaattttttgtagaaacagggtttgctttgttgctcaggcttgtcgcaaacccccattgtatcctggtagtaactaacttcttttgtattttacaggttcataggtggaagagacttgccttgtctcagatgagactttagacttggacttctgagttaatgagagaataagactttgggggactgttgggaaggcatgattgtgttccaaaatgtgagaaggacatgagatttgggaggggccgggggcagaatgcgatttggaaggggctaggggcagaataatatggtttggctctgtgtccccaagtaaacctcatattgaattataatcctcagtgctgaaggaggggcttcatgggagatgaccggatcataggagcagacttctcccttactgttcttgttttgttttgttttgttttgtttttgagatgcagtctcgctctctcgcccaggctggagtgcagtgacgtgatctcggctcactgtaagctccgcttcctgagttcatgccattctcctgcctcagcctctcgagtagctgggactacaggcacccaccaccatgcccggctaatttgttttttttttttttttttttttgtctttcagtagagacgggatttcaccgtgttagccgggatggtctcgatctcctgacctcgtgatccacccgcctcggcctcccaaagtgctgggattacaggcgtgagccactgcgcgcgcgcccggccccttaccgttcttggaatagtgagtgagttctcatgagatctggttgattaaggtgtgtagcacttcctcctttgctggctctctctcctgctccaccatgtgaagatttccctccttacctttaccttccaccatgattaagtttcctgagacctccgtagccatgctttctacacagcctatggaactatgagtcaattaaatctcttttgttcataacttacccagcctcaggtagttccttacagcaatgtgagaatggactaatacaggaaggaaattctggggagcacagctgcagctgaattggaacagtacaaaattgccacagtcctgatctttattttgttttttttttttttttttttttttgagacggagtctcgctgtccccccagctggagtccagtggcgtgatctcggctcactgcaagctccgcctcccgggttcacgccattctcctgcgttagcctccccagtagctgggacttccagatgcctgccaccacgcccggctaattttttgtatttttagcagagacggggtttcactgtgtgttagccaggatggtctcgatctcctgacctcgtgatccgcccgcctcggcctcctaaagtgctgggattacagccataagccaccgtgcccggcccacagtcctgatctttaccaaacataccatgataaaaaagagaatgattaaccctgacgccaccatggacctatttaaaaagatatgaagtgaggtttcaggtatttaagacctacagaatgtaacaggacaaaataattcaataaactcaattttctggttctgaccacttaacaactccacctgaaattctcagacatcatgactagcactagcatggcaattttcattttttggtggggggctactgtttttaataaaatgctgggctgatggctttgactcagtggtaactcctgtgtgactttgtaaataaaatgggcaagattactcaattttatgtcctaattctgctatagccttttatatttacctcatagtaatattctctaagtaatctttgtttgctttcttgttgcaacactttaatatcttagaaggaaggaatataaaattgatgtaattattggtttttctgctgtgtgaactgtaagttaatttccatacattgttttaatgtcactttcttttaacaaaagagttgagcttcaagtcagtgacaagtaaatacagaacataaaattttaaaaaataacaaaaaaatgttcatcagctaataaaacacattttttctttgttaaaagataaaactacatttcatctatgaaagaattttctgtcaaatcttacatggcaagattgacaacagtaatatttttttctaagatgaaaaacattttcaaatgagagatgaactccttaataaagatgtaatcagtcttgtcagggagaggatttacacagtaagtaaagagaagttcaaatttgaaattaatggcacacaagagagcagttctcatagtccaggatcagtcctcagacatttacttgaaggattattatttcctttacattttggaagaaaaaagtatagaagaggtaggaataaatatcagttattataatagaaaagttataaagagaaaaagaattcatactaacatcttctccagctcacctatactaaattattagctaaaaagagaaatgacaagagtttcagatcatgctgagaagcaagaaagaatagaaaataatgtgtcacattcaatttcagcctgtaatttcatatttcccctaaaaggaaatatctcaggatactgaattacaagttctagctaacagatcgagatgaagcagatgctttataccaagtaaggtgccagacacaaactcaaatttttaaaggaaataatcacaaaattcttagacctcttacgttttccactcccaatgagaatggaagagagggtgcctgatctctttcttcatgctcatttggatgggctggggcctccaccaagtgtactgatactgcttattatgttattcctgaagcggtagggcataataactgcattctgattcgtgtccagggaaatcaagagatggagaaattggcccaccaaccactttggtggtaaaagaggagagtttcctttgtgattggcccgcgctcctaaatttgcccaagtaaaatctacatgagtgtttcccacgacttggaggtggattgcatatgagggtgagttcaccttggattcagtccaatagtgctgctgaaagaaatcaagggggccccattcacaaggatgaaatctaggtgtatgccagattgctggaggtagtaagggtggagagattctaaagccatcactcaaatagagacccatccactagggaaccagaagtgagagacttcactgatgagactcaagtgcccacaaaagcactatgagagagttaccctaaatatctgccagttccaggaactcaaatctggcccaccaaagacaagttaaagtaagcatttccatattacctttctcttcttccctccaatgctccaaatctagagtgccctgaagctatggcaagctggcacctaaaatcagcactagctgaagaaaagaaaagacataactttaaattgagaatttcaaatattatacagaaaccaacactctaatttctgaatctaggaagtgttttgggccttaagaggtctttaggactgctcattatctaaatgtgagctgaaaatcttggaactcaaatttaatgatgggtaaaagcttccaccactgaaaagatttaagacataatgagagaacaaaaaaaaaagttgtattaggatttatgcttagggcttcttcaatgtaaaagtaatataaaaatcaccttcacataaaccttctaccaactccatcctatcaggcttcctagagtaaacaacttgttctttactctctctaaataaggacttagcctctcctttgttcatcagaaaccttattaagatttttcttagacctcggtggtgatcgggaggtgatgcttaggtataagcatatgtataggaatatatgcttggtggcttttttccccccaacatttgttacatactgaggttttggtatatattttttcttaccaagaattaaaatttacataaaatcaaaagttacagggattatactatcttttgatatgttcattttttctcctttgttagcatttagggcataccccataactccaattgcctcactagtagacatttcccagtcaaataagatatggcctgaggaaacggcccagtaagtataattttactgaaataagaacagaagcaaagttctaatgggttgatgaatacatgggaaatgaggaaatagatataagaaatgaataccaaaatttctggaagctccacagtaaccaaatgaggaattcggtgctgttgcaagaactagattgaatgaaaaaaaataaagttaaaggccaaatataattattacagacctaatttaaaaaaattatgactcttttaagtgcttatgatgctttaaaaatgttttaaaaatctgtatttttatgttctgtgtaactcgcataaaatgagttctcattaaacttcatttttacttatacaaccatgtcttccaataagtatatgttctataccttctcagagtatactctgttatgtgttgtatgtggaatatacaatgggaacaattgtgctcaattactattctgcccaatgctgtagcttaccatgtatagagtgatagtctataatacatgcataggacaatgactaacatattcttacaatatctcctttgaaggggaatattctgattaatttatgatgtggtagtaataaatacttaaaataacacatgaacacgctaatataagcactgatttcattattttatttatttatttatttaaagacagtctcactctgtcacccagactggagtgcattggcatcatcatggcttactgcagcctcaacctcctgggctcaggtgatcttcccaccacagcctcacaggcagcttagactacaagtgtgtgccatcatgcccagctaatttgttgtgttttttgtagagacagggttttgccatgtcaccaggctggtctcaaactcctggactcaagagaccaacctgccttggcctcccaaagtgctgggattacagctgtgagccactatgcctggcctcttatttttgtttcttattcatattatctaagaattttaatttactgtcagtggttattgctttatgaaatctcagtaacaagaagcaaagaaaatgagatcagtaagtgagaatcctgaatacattacgaacttttctgctcataagtcctcttgtttgaacaaacaggaagcattatcatgaaagtctcttctgataattccactgccattcttacatctatcaatgattgaaataaagtataaaaaatgagactaaccgatgactaataggatagtagaagacccttaaaatagttttattcctctagtacaggtggtcttaaatgggggtcttaaaaaaatgattctaattctcaagatttctagaaatgcttcctaaaaagtaacctttacattatatccttcaaattaaaagcaaagtgccttaacagcgaagtaaaatcatgttccataggaataaatttcctccactcattatgaatacaggtatcagaaagattaaaatttacttctttctgtcattgacacaactactctgcttattcttgcttagttatttcagtacccatgacagtgttccagcacatagctgagtatgtgggacaaattcagaacacagaaattattatattaatgcatgaataaatgaatgaatagttgaagtgtaagttcctaggaagaaaggcaatgagataaatccactttttttccctcacataggccttgtttgaagacaataattacatggcctgaggccctctctttgagaatacttcatttttactcaaagaggtcttacctagtatgtaaacctcatttgtttgatccatttaacttcatcatttgggagatataatggttctcagacttgtaatattttgacggcatgaaacaaataatatttgatttgttacatctgaaggattataaggctaatgagtaagaataactcgatgctccacttcaggtgattcgtatgctataggagttagcaatctagttcttgtctttcgtttgaataaattaacaaatattcctagagtatctactgattacaaggcctgagccagacggaccttgttagggactcttgaacaagcagaactaaaagcatgatagacaaaaggtagaaatctaattaaaagcagttgagatgatgacacaagatcaattgaaataatctgcaaagcccagaatgaagttagacacttttcattttagtctgctgacaaaattaagcaatataacatcacaaaatattagatttgttaattatatatttgtctattttatgcttaagtgtatctacattaaatgttagattaaatgcaatgtggtgttagtattagaccctggagtaaagtcataggtgaaaaaccagtgaaagcaaatagtctgtagtttagttaatattctagcaatattaatttttttagttttgaaaaatggttataaaagatgttaacattcgggcaaactggataaagattacatggaatctcttttggctatttttgtaacttctgtaaattaaaaagtacttcaaaataaaattatttaaaattgtaattagaacaactctatattaaattttttcataaccctcattattgtgtgtgtgtgtgtatatatgtatatatgtatatatgtgtatatatgtatatatgtatatatgtgtatatatgtatatatgtatatatgtgtatatatgcatatatatgtatatatgtgtatatatgtatatatgtatatatgtatatgtatgtatatatgtatgtgtgtatatatatggttttgttttgttttttttttttttttttttgagacagagtctctctctgtcgcccaggctgaagtgtagtggcgctatctcggctcactgcaagctccgcctcccaggttcacgccattctcctgcctcagcctcctgagtagctgggactacaggcgcccactatcacgcccggctaattttttgtatttttagtagagacgaggtttcaccgtgttagccaggatggtctccatctcctgacctcgtgatccacccgcctcggcctcccaaaatgctgggattacaggcgtgagccactgcgcctggcctgttttaaaatatttttaaaaccaaattgtgagtcatgtcgatggcttatttgggactttattcaagactctttagtgccactgactttaatggtttgcccatacatcaaactgagcaaccctaaggaggcattctttcctcttcatggcagaagtagtagtattttccaacaatgacttctgccttaggtctgaatagtgtcctaaacattttgcctcatgttcattttagctgcacattttaaaggggacagtttccagttacacaatgtttcttttactatctggtaatgagagttataataaatacttcaggccctgaccacattttgtcagaggtaaatattatgctttcttttttgtttacagtacacaatgatcctcatcattttgagatatttctatatcaatctcccatttttttttttttagttgctgtgatcatttccccatgtatatgttatgtgaaagaaaagtatttgagattgtgttcactaacaagaaataggcattggaaaataagtacattgggctcaacactattctgacacaataggaaaacctagtaagatagtaatcttaatggcagcaaatgtcattaaattaaaaacatctacacagcaacaacctaatgttcatattaatgagaggtaggaacactgatagtaatcaacatctgttgctggtgttaatattcaacattaaagtaatccacagagggaaaatacaactactgcaggttaaatgacaactacagcttttctgattggtggttgtaagcagaaggtccagtagcagcaaagtaatcaagacggggttttcacatcatgtctttccaaataatcactgtcctaagtgaggagtagaagacactgtcacattgaggtattagtcagttttcacagtgccataaagaactgcgcagactgggtaatttataaaggaaagaggcttaattgattcacagttctacatggctggggaggccttagaaaacttataatcatggcaaaaggggaagcggaaacaagcaccttcttcacatggcaagcaggagagagaagaaagaaggaggaacttccaaacacttataaaaccgtcagctcttgtgggaactccctatcaggagagcggcaggagagaaacagccctgcatgatccaatcacttccctacttccacaatggggattacaaatgaagatgagatttgggtggcgacacagagccatatcgtatcaaagtatgaaaggtttctaggatttattagtttgggttgttaagagttatacggctggcaacgctgtgcagggccgtttacttcagctgcatacattttttcgctgcatgaggggttggggagagctactctcttctggtcctgaaaagtaatcaagagagagagggatttttcacatcgtgtcttaattctcacaaaggcacgcttcaaatgacggataaaaacccgtcttcccgactccaagaagctactttctgacagttgtaaacaagcttctttctcttactgcacaggagagtcctcttacagatctcagatcctgacattattttcaataaaactttgtgcggccgctagttttaaattcatggtctcctggaagctttggctggagactactcagctcgtcactgaactaacggcttttgggggttcttttttcccagttgagtttctgtgtcttttacacgtttggttttatggtccgttggaggttttttcacgctgagggtgaagattcttagtttcctcaattagcataaaagctgctccaaggctgctgagtcttcagttccattccattcaaaatgttaattcctgagacacgcaacctacgccctactgtcctttgtcccacggcttctcgagattatctctgtgttttaatagataaaacgccttctctccccacccgtggggtgcaaagcacagcgcatggggctggtggcgcccgagagcatcacacaacgcatgcgccagtccgcaggtgtgggcggaggagaaatcgcgtcggcggcaggggatgacgtaaaaaggccgcgctgtactgcggcttgtgccgcttccgcaagaaggtttcctggcctgttgcagccatggtgcattgcagttgcgtgttgttcagaaaggtccgtgcgggtcccctcagcctggtccccttagcgctgacagctctggttcttctttgctcccctgtctctccactactgtcttcgtggcggccttttccttgcttggttttcccatagacttctccgcccctcctgtagtggcgctttgtcagtaagcggtgacagtggtgtgtgtacctggcgtggtttggacggttgtttgggggcaggggcagggtttgaagttctttagagacatagtgtgcacgtggtatgaggaactgggatacctgcctgctgtggcccaaatgttgtggtggttttttttcctttaatgtccacagcctgtttttatatatttctccttgagtgcgctgtttaaggtttttctaatggatttttatgaagacacgaaagcgtgtaattgatgtgccttcctgcagaacatttaggtcgatttttgtgtggtgtcggtcttaagaatcgtttccgtaaaaatttacaactgctttgaatttttattttttaaatcttatcctatcagtaatgctttttgaaacgttgcctgcgtcatatttggccattactttatttctaacgaccagagtaaaatactccttttaagtaaggctcctaaacccctgaatctgattaatctagagcaggaaaaaagtgttacatatttaatggaactgtagaaactctcctcgagtatatcagaatggtcaatatttcaactttcttgaaaaaaaaatcccatttgttttttataatagctatcctaaatgactagagatgtggattatgaatttaagaaattactccttaagttattttgattttaatagcctaagaggttaatacgtaagtcctttacctacaagaagttcttgatttagtgaaggaaacaggtaaacactaaatgcagcgtgagatttataaaggtgtaataatagagatataatcaaattgctgggagagccagcaaagtcagagaattgattagaggaatttggaaagacgttagaaaatatgacgtttaggtggatttatgataggaaaaacaaatgacattctaagtagaggaaaagcatgagcagaatggcatgtagaaatggcggtatttcatgtagtacagagcaaagaggaagagaggaagggttgagcaagtgaaaaggatacaggaaggaactaggcatggtaggtgagcctattgttcttgctacttgggaggctgaggtgggaggatcccttaaggccaggagttcaagaccagtctgggcaacatagcaagaccccatctttaaaacagtcggggtggtgtggtgcctgtagtcccagccatttgggaggctgaagtgggagaattgcttgagcccaggagtttgaggctgcagcaatgatagtgctatgatagtgccacggcactcgagcccaggcaccagaaccagaccctgtttcaaaaaaaagaaaataaaagataccagaagggtattttagtagctttggatatacagttgacccttcaagaacatgggggttagagatgcccccgccacagctgaaaatcttcatgtaactttcaactccccccacaaaacaactactaataatctgttggctggaagcctcactgataacataagccgtcagttgacacatataaaatatatatatagtatatactgtattcttaaattaagctagagaaaagaaacagttactaagaaagtcagaaagaagggaaaatatatttactgttcattaaatggaagtgaattgtaaaggtcttcatccttatagtcttcatgttgaatagactgaggaggaagaggaggagttggtcttgctctcttgggtggcagaggcagaaggggtgggggtggaggaggtggaaggggaggcaagagaggcagacacactatgtgtaactttatggaagtacatcataatttctgtcatgcttttgcttttctctttcccccaaaaaaatgtttctatagggtaccaatacctcttccaccatttgctttggtttcagtgcctcttcacagaagggtccatgtcataaaagaagtcaaaagcagtcctgaacaataggagctcttctgccagattatctaatgttcgtttttctggtagtttattctgtgttttcttccttgttatctggcactggatctgaagcactcatcaagctgtcttctgttaattcctctggtttggtggctgttagctcttgagtttcttcaagatccatatcttgaagtcctttacccactttcccgccgtttttggcatattcacagcctctttcatgatttccttgattggctcttttgtaaatcctgtgaaattataacacaacacaacacctggacaaagttttctccagcacgaacttactgtttggggcttatggctttcatggctttttcaataataatggcatcttcaattatgtaaacttcagattttcctgaagttttctctattagtgttcttttccatggttgacaatccttttcgtagaaaatcatgtttaatgagccttaaaggtccttgcgaccccgtgatctagaggctgatttacagacattgtgtttgggggcaaggacaccacttcagtgcctttgatgttgaactcatggggttctgggtagcggggaggtggggcactgtccattagcagaggaactttacaagtcagtctcgtattgggaaggtacttcctgacttcagggagaaagcatccatggaaccaatccagagaaaaggtttttgttctctaggccttcttatccaacaaagactggcagctgatgtttatctttccctttcaagattgaggggttagcagctttatagataaggacagtcctgattacaaacacaactgcatttgcacaatacagtagggttagcctatcccttcctggcttaaatcctggtgctcccttctcttccttactaatgtcttttgtagcatgttttccagaatagggtactttcatcagcattaacaacctgatttgggagatattctttcgtctcagtgattttcttaatggcatctgggaactcatctgctgcctcttagttggcagaacctgcttcacctgttatcttgatatttctaaagccaaagccaaacctatttcttcttttttttttttaaattatactttaagttctagggtacatgtacacagcgtgcaggtttgttacataggtatacatgtgccatgttggtttgctgcacccattaacttgtcatttacattgggtatttctcctaatgttatctctcacccagcccccaaccccatgacaggtcccagtgtgtgatgttccccccgtgtcccaagtgttctcattgttcagttcccacctatgagtgagaacatgtggtgtttggttttctgtccttgtgatagtttggtcagaatgatggtttccagctgcatccatgtcactcatcctttttatggctgcatagtattccatcgtgtatatgtgccacattttcttaatccagtctatcattgatggacatttgggttggttccaagtctttgctgttgtgaatagtgccacaataaacatacgtgtgcatgtgtctttatagtggcatgatttttaatcctttgggtatatatccagtaatgggatggctgggtcaaatggtatttctagttctagattcttgaggaatctagaactgtcttccacagtcaaacctccttctaaaattatcaaatcatcctttgctggcaattaattctttagctttagatccttcacattccttttgcttttaagttgtcatatggtaaccttactttttcttttattgtattagtctatgtttttaaaataggaatcctgcatctacataaaagttgcctttttaatacaagataaaaagttaattcacaaaaagtgcaaggttttcacaccttttggcatagctgctgcagtggcttcatgaatttttgtctttttttacactgattcttattctggattcatttatcttgagatagcaggccatcgcagctacagattttaatctgtggtagatatcaagcaattcatctttttatcgtagtgtcatgactttacttcttgggagcactgccagcatcactagtggcactttgtatgggttccatggtggtgttcaaggtttacagtgtagcgctgaacatgatgaaaaatgcaagagaactgtgagagattactttttactgacttataaaatgtactggcaagatgaactgctcatggggagacgattagcatcacatggccttttaagtggcaacttgggacacttgagatcccgggatagttacaggaggtaactacgaaattattacagtattccacgatgtactacagttaattttatgcagttatgatttaatactgcatttttacatttgcttacatttctcttgactgcaaatgctgccatgtaagatctgtaagtgtgtgtgtaagttttgataaattttaagtttttataatagatgtgtggccaggtgcagtagctcatgcctgtaattccagcactttgggaggccaaggcaagaggattgtttgtggccaggagtttgagaccagcctgggcaacatagcaaaaccccatctctagtttttaaaaattaagatagatatgtgtatattttatggaagtaaatgacaaaatagattagcatctatatattttttgcactcataacacacagcttttcttaattttttcaatatttccaatctatttgctttgtaagttttttcaaattgttgcaaagctcaaaaaatttttctaatatatttattgaaaaatatctgtatataagtggacacacgcagctcaaaccagtgttgttcaagggtcaactgtagtactaagaattttttactttatttcataagcatttttttttttgagacggagtctcgctctgtcgcccaggctagagtgcagtggcttgatctcggcccactgcaagctctgcctcccaggttcatgccattctcctgcctcagcctgcagagtagctgggactacaggcgcccgccaccacgcctggctagtttttttgtatttttagtagagacagggtttctccatgttagccaggatggtctcgatctcctgaactcgtgatccgcccaccttggcctcccagagtgctgggattacaggcatgagccactgcacttggctcataagcatttttttaatgcatggtttttgagtaaaggagaaacatgattagagatcagatcaatttcagaaaaatagttcaggcaacaagttggagaatgcaataaggaaaaaatgcctaaacactgaaaggagctcatgtggtgcaggtactagggcagtggtactggagagaagagagtagggctttgggaaaagaagcaggtgtagtctgaaagacttccatttgtgtagtctcaatgaatatgtaaaccatggttctgttactttagagaacattggaggaacagattttacctggggaagagtttggttttgttatgttaacatttatttttgaggtggctattattcaactgatatgtaagaacaagtttcatattggggaatttcaaatataagttaaatacacattctgctcacatttgctttatactattaaaagctttcatcctggtggaaatgtctgacagattggacatagaaaatatctcacctaggtgatggttattggtacaagcagaaattacccaggggagaaagtctagaatgaaaacagggccaagtcagaaaccctcaggataggtgggacaataattgataactgaaaaaactaaaagggacttaagagagataatcaaatgggaaagggggtcagatcggagatgtggaggtgagctaagaaaatgttatagaattggcatgtgaaaagctattaacgacttttttagaagaagttttagtggaagaaagaactagaaaaaggttctaaggtgatacacttttggtatacaaatattctttctcttttttttttaagtatggaaatttcatcgataagctaagactcttcaccaggggaggatccggtggaatgggttatcctcgtttaggtggagaaggtggaaaaggtggtgatgtctgggttgtagcc

SEQ ID NO: 596 - DNA, 207718 bp, Homo sapiens
acgtgcttcttaaggatgttagtgtaatctaaatgcttctgaaggtttttgttttccaataattgtggaccaggcagcccaaaaagaacagctagaatatctgacatacacacacacacacacacacacacacacgcacacacacgcacatgtgcactttgtaggtattagagaaccaacagtaaagaattactaggtcaagatttgagagaaagaccgaaacaaaagcaggaacatcacattctactaacataaaaaaagttattatgaaggcctgaaacattttgaaatgaagaagacctaaatgagtggaaatgctctgttaaagcatttgaagattacttttttaaaaaaaattaatcttctggttcaaccaaataccatgggaatccccagaggttctaatttgacaaagtgattctaaattttatttggaaattcaaagggccgagaatagccaagacacatttggaaaaaaggtgagaggtcttgctttactgtatttcaagactaagtgtagagcgtctgtaattaaggcaatgtgcttatggcacaaggacagaaaaatgtccaaatggaataagatagagtgtagaaagaggctcatgcatacatggagaattgatgtagaatagtagtggctcagcagaacagtggggaaaaatagtcttatcaacagttggttctgggctgggcatggtggctcatggctgtaatcccagcactttgtgaggcagaggcaggcagataacttgaggtcaggtatttgagaccagcctggccaacatggtgaaacctgctctctactaaaaatacaaaaattagccaggtgtggtgacaggcgcctgtaatcccagccactcgggaggctgaggcaggagaatcccttgaacctgggagggaggggttgcggttagccaagattgtgccactgcactacagcctgggtgacagagcgagactcagtctcaaaaaaaaaaaaagttggttctggacaatcagatattcatattggggaaaaaaagtaacttgaccgttacttcataccgaagccacacacacacacacacacacacacacacacacacacacacacaccccattgccagatggattgtaagtctaaatgtaaaaagaaaaaggataagcttttagaagacaatattggggactatcttcatgtctttgatgtaaagaaagtcttcttaaacaagatagaaagtgcagtaaccttacggaaaaagacatgacacattcgactacattgaaatcatgataaaagcctcttttctaggaaagtttccattaagagagtgaaaaatcaaaacacaaagcaagagaagatatttgtgatgtatataattgacaaaaggcttgcatagaaaatacataaagaactacaaaccaataagaaaagacagataatccaaaagaaaacatggacaaaagacaaacaggtattttacaaaaaataacccagttgcctgtaactatgtataaaagggcccaacttattatttatcagggaaatgcagattaaaactccagtgagctattgctacactcaccaggtggttaaaatttaaaaataattgatgttatcaaatgttggcaaggatacagagcaagaggaactcttattcactgcttgtgggagtgcaagttggtgtaaataatcttggaaaacagtttggcattgtccaatacaattgaatatatgcatagcctatgatccggtgatgcaacttttcagcatgtagaaatagaggcataagggcacctactggccaatagaaatgtgtgcacaaaccaagctgtactattcaacctgaatattaattagtgtggcaaaagtgtaaagaatatgaaaagttaccaccataaaagtcaagtgagtgattattcttgggggtaggagggagttgtgactgggaaggctcgagaatagcttctcataattcaatttagatataatagactgaaaacaaaaattctttatgttaacaaagtgcctttcaaacccttttgagtttggactgaaccaccatcagaaagaaatttctcactgctactcagtaaaaacatatgcacacaccccaaactgaaatatgggtgtaattaaatagcatctacttttactacatggcatgaagtaatattttctattcctttaaaaaaacatgggctgggcgtggtggctcatggctgtaatcccagcactttgggaggcggaggcaggcggaccatgaggtcaggagttaaagaccagcatgaccagcatggtgaaaccccgtctgtactaaaaaatacaaaaattagccaggcttggtggcatgcacctgtaatcccagctaactcaggaggctgaggcaggagaattgcttgaacccaggaggtggaggttgcagtgagctgagattgtgccattgcactccagcctgggtgacagagcaagactccatctcaaaaaaacaaaacaaaacaaaacaaaaaaacacggtaggctgagtggagtggctcatgcctataatcccagaactttgggagtctgaactaggagggttgcttgtgcccaggagtttgagaccagcctggtcaacacagtaagaccttatctctacgaaaaaataaaaataaaaaaattagccaggtgtggtggtgcatgcctgtagtcacagtttcttgggaggctgaggtgggaggatggcctgagctcaggaggcagaggctgcagtgaggcgagatcacaccactgcactttagcctgggtgacagagtgagaccctgtctcaaaaaaaaagcaaagcaaaaacaaaaaccaaaaaccaaaaaccaaaaaaaaaaacaaaaaaacaaaatccattgtagcaactggcagcatgaaaagttctgcatttagaatgcttttgtactcagctttcagatggaaaaactgaggcataattggaataaattaagcctatctgctggatacagtgatggcctagagaaacttacaataggatcttacagagactttctgaactggagtgcttgctttcaggatcatccttcccagcccctcattctgcagatgaataaaccaaggcttagcaccatgtgactcgtgtgaacaaggatagggctgggataaaacatgttcccgattcctcctgcacgtcccaccatcatgtcagggtcatggctgctttggcccagagaagctgacatacacctggctcacaggaagccccctcctattgactggggagactgctaacctggagaatgtggatgcatttctcaggagagggagaggaccgcctgcctgcacaggaggtgagtccaaggcaccggctgagctggcctgatgggtggggcggcagcacctcacctgtaccagggcaccccaggaggctgcacccagtgacgtgggctgaggatggggccggcccctctctctgcataggaagctggcctctcagtgtgaggagtcgtcttgcaggggaagcagcaatctcatccacataggatactgtctacatgtccaggacaaggatgcaggcagctgcctgtgacaagcgccatgaccctgccaggctcactccttggcggctcacagaccctgaaggcttggcagggcttgcctgctgccttctgccaactgcaggccactcaaccacgggatgctttcctgctgcttgttcctcgtcccttgggacacggaggcagccatccgagactcacatcagccccattgtccccagccctggggatgggaaactcttgcaggtaccagagcttacctgaggccatctcagacaaaagtaagcagagagtaaacagcagaaggtaggaagttctcatggcgactggcaggcaacacccaggatttcaggaactggggagacgctggctcctttggaggctgagctgacagaggcttccagaggctggagcgtcactgtatttataagactggtggattgcacaacctcgtcgacggaactgaagggaggtgccacagtcaagggtgaacttctaatcgctaacccctggtgtcatttgccctgagcagtcagcagtcacatggcacattgtctccatctggctgccgctggatttagctttcagcctggagccctggtgccagctcctcctgtttggttttctaggttaggcagttctgatggggtttctggaacaggcagttcacactggagtccctccttctggatcacatggaggagagccacagggaagctctgagcagggggccgctcggctctaagctggtgttggcctctttagtttgattgtcttcctgcaagacaaactcaaacttcaccctcttcccttgcagaaggagagctggttgtaatgaagtttcttcctctggccaaggctaccttctcatctctccccttatgcagaacactctcctcgatggaccaacttttctcttttcccactagacgtgttcctgggacgtttccaaagggcactcctcagaaagtgagcccccagtgtggcccttggagggtgagggtctgggccagcttgggcccaccctgcagagctacaactgccagattggggtgctgttagcgactctccaagtatccctcaggttttccttgattctaaagatttaagaaacattttatttattactgattttcattgtaattctgtgagcagctttcctgatgtctcagtggcttatttgcaagcagcagacgctggctctcgctgaccaaggaagggaagagtttattcggaggatatcagggttggtggggggtggtggcattgctggagaacccagcttgaggctcagtttccaggaatgacatccaccctacactgtcacggtggtccaatgagaaccccatactgcagccacatggcatgagacacccagagtggagtgaccctcagccactctaccgctggcagaatgccattctgcacccaaacatgaacctgccgtatactcccacttcaaccctgccagagaaagacagagagagatccagaaagatggacaaacaaaaacagagacagaggaagagacagagacatgcagagagacagtagagagacacagagaaacagagagatagaaacagacagagagagatggaaatagagagagagagagagatagagagaaatagattcagagagacagaaagaaggagacagaaagatgcagtgggatcctgtagctagctcattgaggcagttcacaaagggtgtttgggagaaaacttggaagaggctgagccatgcctgacctaggagcagtgagattgtggaaagagaaaagaaagaaccgaaacacagctttccttgctggtgctgggtaagacatggctcagcctcttccaagttcctcccaaacaccgtctgtgaactgcctcaatgagctagctacagtattctatcggatctgtttctgtccctttccttctgtcttattgaagccacactatgattctttgaccaggcaatataatcctcatgttagagaagaaaaacactggggttcagagaattgaaacaaattgcccaaggtcaccctgctggtaaatggaaaactggtgtaatggcctggaaagcctcattccctagcctctgtgctgaccgcctcctggggaggcttccaggttattacaccaggtgtgggttcaataagattgtgaaagaaaaatatctcaggcaccttcaagctgggaactgcttattgcgaatctgcctctttttctattcaagtcatctttttgctcccagagatacatgcgtatttcgattaacttttttggaaagacttataataaattcaaaagaatgcaaccggtcagggcgcagtggctcacgtctgtaatcctaacactctgggaggccgaggcgggcagatcgcctgaggttaggagttcgagaccagcctggccaacatggtgaagccccgtccttactaaaaatacaaaaattagctgggtgtggtggcacacacctgtaatcccacctactcaaaaggcggaggccggagaattgcttgaaaccaggacacattggttgtagtgagccgagatcgcaccactgcacttcaacctgggtgacaaaaccgcactccgtctcaaaaatacaataaaaagaatgcaactgtctgtctctcacatacctgtgacctggaagcccccagtggtgggggccttgctttgagctgtctctgcctttctggacagaactattgtacttcttatacattgattgatgtctcatgtctccctaaaatgtataaaagcaagctgtgccttgaccacctggagcacatgttgttaggatttcctgaggctatgtcagaggtacatcctcaaccttggcaaaataaactttttaaattaaatgagacctgtctcaaattttgggggtttacaagataataaagtaaaaaatctcagaatgctgccgggcaccatgtgaggtccgatggtgtctgtagatcctgggagtgaaaggaatctaaaccctggaatcctgattttcaggactgatgttttctgctctgaacctggaaaactttttttctaaattttatttttattttttatttattttatttatttttttattatacttgaagttctagggtacatgtgcacaacgtacaggtttgttacatatttatacatgtgctgtgttggtttgctgcacccattagctcatcatttacattaggtatttctcctaatgctatctgtctcccctccccctaccccacaacaggccccggtgtgtgatgttacccaccctatgtccatgtgttctcattgttcaattcacacctatgagtgagaacatgcggtgtttggttttttgtccttgtgatagtttgctcagaatggtggtttccagcttcatccatgttgctgcaaaggacatgagctcatcctttttcatggctgcatagtagtccatggtgtatatgtgtcacatttttcttaatccagtctatcattgatggacatttgggttggttccaagtctttgcaattgtgaaagtgctgcagtaacatacgtgtgcatgtgtctttatagcagcatgatttatagtcctttgggtatatacccagtaatgggatggctgggtcaaatggcatttctagttctagatccctgaggaatcgccacaccgacttccacaatggttgaactagtttacagtcccaccaacagtgtaaaagtgttcctatttcctcacatcctctccagcacctgctgtttcctgactttttaatgatcgccattctaactggtgggagatggtatctcattgtggttttgatttgcattcctctgatggccagggatgatgagcattttttcatgtgtctcttggctgcatacatgtcttcttttgagaagaaacactttgctttttaaggttacattttcaggatttcaagcatcctgtgagggtgctagaagaaggtcattttagtcccagtgtccagggcatcaccctgttccgctcacgtccatcaacagggtgatgctggagagcagagctcactcctgggcgctcttgaggagtgaggcgtggtagccagctcggaaggcatgggagcccgggcgagatgataaggaggccaggtcctgtgccatgtgcccaggagaaaccacatacaagcagaatgcagcatctactttcacataaatattgcagtgagactggccagagtcctggcttcatcactcacaattgaccaaagtgtggcctttgtgggtgggcgctgactaaggagactgatgggggctgtggtggcagaaagtgcacaagcctttgacagcccagggatgaggctactgacccacctgtgatgaatgacagtctaatggaggaaatgacacccgggatgaggttgtagagcagatgggggccaagtagatgaaagtgtggtgggaggaccacggacatctcaggagagcagggaccaaggcctatataggagatgcatgcgtgtgtgtgtggtgcattaaggcttatgtgtggtttgcatttaggctcatatctttgtgtgcgtgtggtgcacatttaggcttttccgtgtgtgcatttaggcttgtgtgtgtgtctgcctgtatttgggattgtgtgtttgtgtgtgtgcatttagatttgtgtgtgtgcatttaggcgtgtgtgtgtgcatgtacgtgcatttaggcttgtgtgtgcgtgtatttaggcttttgtgtgtttgcattttggcttgtgtgtttgtgtgtgtgtccatttaggcttttgtgtgtgtgcatttagatttgtgtgtgtgtgcattttggcttgtgtgtgtgtacgtgcatttaggcttgcgtgtgtgtgtgtatgtgtgcattttggcttgcgtgtttgtgtgtgtatttacgctgtggtgtgtgcgtgcatttaggcttgtgtgtgtgtggagggtgcacatttaggcttctgagtgtcttattgagcagctttggttttcttcttaggcaatagggagactttggaagaggaattacatgagcctgttgccattatagaactagtctaatatggaggtgtcgaggatgcatggagagggcgtcagcttggacttgggaagacccaggaaggggctgaggagccattagggtctcacacaatatggggaagggggaagaaatgagacaggaacttgagaggaattaagaagctaaagttaaccaccctccactggcagatggaaggagctggatttctggtcctggatggaaggagctggatttctgaccctggatggaaggcgctggatttctgaccctggatggaaggcgctggatttctggccctggatggaaggagctggatttctggtcctggatggaaggagctggatttctgaccctggatggaaggcgctggatttctgaccctggatggaaggcgctggatttctgaccctggatggaaggagctggatttctggccctggatggaaggagctggatttttggccctggcttgactgagtgtggtgtcaggccctgagctgggtgaggggaggaagagccggtatgggaagatgttgagttatgtagacaagtgagtgtaaggggtgccctcattcgccatcacagtggctgatgtgtcctctgcatgctggtctctccctccagtcatcagtgaaggctgacggaggggaggggctgcgtgggatttccacagtctcccctcactggagggtccagggtctggcatagataatcagtcactgttttggaataaatgaataaacagaagagtgttgctatggacggaacacattccctgcttgcataaatatataaaaggatatttaaggaggtaattaggctaaattaggtcataggactggtggcctaatagttagacgaagagaaatcagagctctgggacatggcgagaaggcgtgacgcacaaaccaagaagcgtccctcccgggaaccgaatcagccttcatcttcatcttgagcttccagcctccagaaccatgagaaataaacttgcatttacccagcctgtggcacattgttgtggcagctggttagacttatacaagtgttgtctgtattcttggtgaactcttcatttcttctaggacaacaaaactccggggactccattcctggcagcaccccaacctcctgttaccctcacccctatgggggcttcctcttcagggaggaacttcaggtttttaagacatggatgctttgttttggcttgagactttgcaagtcccataagtggtgagcacaacttggaacactattgcttattcccttatccgcaatagtttgtttgtttttttttttttgacagagtctcactctgttaccgaagttggagtgcaccggtgcaatctcggctcactgcaagctctgcctcctgggttctgggcattcttctgcctcagcctcccgagtagccgggactacaggcaactgccactatgcctggctaattttttgtatttttaatagagatgggatttcaccatgttagccaggatggggttgatctcctgacctcgtgatctgcctgcctcggcctcccaaagtgctgggattacaggtgtgagccaccccgcctggccttttttttttttttcttttttttcaagacagactctcacacagtgtcgcctaggctggagtacagtggcgtggtctcgactcactgcaacctctgcctcccgggttcaagcaattctcatgcctcagccccccccaagaagctgggattccaggcgtgagccactgcacctggccactcgcagtagatcttgattatgatctgctaaaggcacgtccttgactgctgaccttacaggccacgccactggcagctgcccagagcaggagctgtttgtgtcaggtgcttgtcacagctctggagcatgagacctgagtgtgaagaggggagggggtctggggtgggacagaagctgtgtagggcagtacctgccctggggctccacctgcaaggtcaacaggacacagtccttacatggtggggttgagctggtttcagtcccaactcaggagctcctcagagagtcagttccacccacgtaggttggagctagctcctcaatgccactgtgaaggaaaacgaaggacacagcctcaccaagcaccaccccagccaggtgtgacgccactgtgaatgtgtctagtcctcaggaccacgagaggctgtgtttgaagggagctgggccagcccctgagtcagacaggatggattcagcttctgtgcctctgtggagaggcagggccagctgggcctggcactcacctgtcctgctgctagtagcagtggtaaactgtctaacaccagaggattacgtgggtttaacacatttatgcgcacagatgaggagtgttcaattagtgctggttcttaccatgattatttctattctttcccatattatgaggtcatcattaccccatttcctagatcatacacctagactggcagagagtaatgtacaggtaatgagtggtacatccagaactgacccaagccatcagcatagggggttgagtgtcatcctctcttttgcaggcaggacatcccagtgctaaggagagtgacctcagacaccagagacacagcaagtgcagcagagctgacggctctgggaacactggtcttcaaagtcttccccgttgttggttttgttgtctttatttacaaataaagtaaatatttcttatttatagataacattttatttataaaaataatatacgtgttgcaaaaagttaaaacaatactgatgtgtagcagcagaaaaggaaagttgtcttgaatcctatttctcatggataaacagattgctaacaattgggtttctctcagttaatgacattctcttctacacacataaaggtatctattcatgtacacttcaatacttacagattgtaaaaaggaaacactttgtaatgctgatctgcagcttgcttgttttcctttccacctagtagttgtacgtctttcaatattttagatcaaatccatttttatagtgcatgcattttcagttgatccttgaacaactcggggctgaactgtacagctccatttacacatggattttcttccacctctgccacccctgagacagcaagaccaacctctcctctactcctcctcctcaacccactcaatgtgaagatgatgaggatgcagacctttgtgattatcctcttccacttaatgaagagtaaatatattttatctttcttatgttttctttaataacttttgtctctagcttagtttattgtaagaatacagtatataagacatataacatagaaaaagtatgttaattaatattttgttttattgataaggcttctggttagcagtaggctattagtagttaagtttttggggagttgaaagttatatgtgagtttttgactgtgcctcatgtataacttttcatgtacttattacccagtgtgatctactgatacaatgcaatccctatcaaaatctcaatgatttttttggcagaaatagaaagtccatcttaaaatttatagaaaatgccaaggaactctaaatagccaaaacaatcttgaaaaagaatgaagttggaggactcaaacttcctgactttaaaactcattacaaaggaacaataatcaaaacagcttggtactggcataaagacagacatataaatagtgggatagaatagaaagcccaacagtaaatttttgcatatgtgttcaaatgatttccagcaagggtgccactccactgaaagggagaaaagacaatctttccaataaatggtgctgggaaaattggatacccacatgcaaaagaatgaagttggacccttagctaacagcatatacaaaaattaactcaaaatggatcaaagacctaaacacaaaaactacaactacaaaactcttagaagaaaatataggcgaaatagttcactataatagatttggcaatgatttcttggatatgacaccaaacacacagacaataaaagagcaaatagataaattgatcttcatcaaaatttaaaaaatatttttatgcatcaacatacattataaatggaataaaaatgcaagtcatagaatggtagcaaatatttgcagattttatgtctgacaatatttttatgtccagatatataaagagcttctaaaactcaacaacaaacaacccaacatgatttaaaaatgggcaaaatagacatttgtccaaagaagatatacagatgctcagtagaatactttttaaccacattcctataaatggacattagattgtttctattttttttactactataagagtggtgcagtaatcactgttataataccaaatgtatgtatatacatgtatttacttgttataattactcatctaaattattactcatgtaacaaatatatactaagaacctgtaaatgcttggtccctgctttaaaggaggaggactagtgagcctatttaattattttgatgataaatattatgaagaaaaagcacagggaaccatgaggatgaataacttgacttgggcaactcaccggtgggttttcctgaggtaggtaatatggggtttactgcattaattcttaggcttggaattgttggctgaaaggttaaaggggtttcatctttaaaattttaatacatattgccaatttgtcctccacaaggtttactaatttacaatcacatgcaaaaaaaaaaaaaaaagtatagacttgcacctgtttccaatattaccattcatactggcctgggtttatccattcatttataaattatgaactttcttggatactgactacatgccaggcaccatgccagggtgaattagagacatagttccttgtcttgacaacttcactgtgggctggggagagacagacaataaatacgacaataaatacattactttaaatgacttagttatgtttccacacccagctgaaatgggcccgggagaatcactgtgtttcttgttgtcgatctgggatgaaattagggcagctgggttaaaaacatagttgaaagcagtggttttcaagcaggggtgattttgccactcaggggactttggtgatgtctggagacacttttgctgctgcagcttaggagggagcactatgagcatctggtcactagaggtcaggggtgctgctgaacatcctgcaaggcacagggtggcctcctatgataaagaattatcgagccccaaatgttaattgtgccaaggttgagagaccctggcaaaagaaagaaccagacaaggcagggttcaaatcctaggctagccactgtaaaggcatctcagcggtcgtcaacatgcttgtcttttgcataggggacgagattagatgttgtgattattagatgagaaaaatgaattgaactgtggagcacaggacacagcagaagttgtccatgaatggtgggtcatagtataatgatgacacaccacagtggaagaaggatgggagatggatatttcttaatgtgtagctctgggaccactttagaggaagcatggtaggagcaggaggagctgtggggcttggtgacttagggaaggatggatccgtgcctctcgttgtttctctgctatcttgtttgcgttgcattttcttggtcagttctgtttgtcatttttgaacagtttcttggatcatttaaaaaattgttttgcagctttttttttatcctttgaaatcagtgctgttgtttctcatgcatgttaccagtgtttcccccactttatcattcaacctgattcattatgtttcttctttgttctgcaggatagaattgctcagtgtaataacaatgtttcaatgtcttctattttgaatataatcacaatgtccactcctttgagtaaaaaatgataggtccggtgatggccattggcccaaatggtggccttactgagctacacagctccaaagggagccagcagtagaatcctggctttctgggccacatttgggccaccgtggagatagatgagtgtgtgatgtcagtgtaccttacagaggtgatgcaagtagctcagactcacactgtgaatccacagtgcttggtgctttcaaagggtttcaaaggatttcttgagaagcaaattctatttgcagataatttctatttcagttcctttctgaaatatgaaggcaaaatgttaaaaaagtgacattgatattataactcataattcgcataacaacctttttgttggccgggttggagacgttacacacactttgaagaaacacaaagccagtagtaattctacaattcagaaaaagctttatctggcagcatctttttgttctacatccaaatcccattgtgatatctaatagaaaaagccttagaggtggcaaagaggtggatggatggtcttaatgtccaccctagctccccagcgatcctcctaggatgtgttgcaatgcgtctaatattctttccagaaccgagtgttgaatggtgttccccactgcaatagaaacacacttggaataggatagcatttatagtcatgaccaacctgtaccccgcagggagttgcaagctgtgctctggcagatggaaccgaaaacacacctctgccagggaagctttgagccaagcgaggaaatcaaattcttcctgttgtgcccagaattgtgatttactgcccatccgaatcatagcctcataatatctcagctggaaggacgtagccagtgtctactccagggagtttctgggagtccctgggacttagagttctgccagtaccaacaaggctgcgctcgacaccttagcccacttcctagccatagccatttcttccacaggccaggacttctgaatggcttttgtgtgacagacagtttctggcagttaataaaaggaaaggtagaactaatctagctcaacatcatcagataatttacagatatagaagataattgcagagtgtaaagagatttgttcaaagtgacagcgtgaaagctaaaaaagggacaatcagaggcttccctgagcctctgaagtgaggtgactgtacctgcatctgtcccagcaccgggcccagccaatcccacttggctggggtgggtggtgctgcctgagagtccgggcagtcccttttcacccctgagcctgaccctggtttctcagaatctcagaatctagctattttgaaatatacaatacatcatggtcaactataatcaccctactgggcagtagagcaccagaacgttttcttcctgtttaatggtaactttgtgcccattgaccaacccctccccatcccccctccccctcccctccccatcccccctccccgtcccctccccagtctcaggtaaggctattctcctctctgcttttgtgagatccactttttggtttctgcatatgagtgagatcaggtggtatttgtctctctgtgtctggcttactgatgattacacaaggtgtacatatgtcagtatcacagtgtaactcatacatatgtacaattattatgtgtcaattaaaaataaagcaaagaaaaataaaaacaaacaaaaaaaatctgagcatacatagggctcttcaaggtccttaacttttggggacttctttttgtttcacaccaaaaggaatcatggttgtcctctgccaaatgccagccaggttgtttcatactgttttaaccttgttgaaaacaaaggcaattggaagcatttcagcaactcaagagatcatgtgtttatgtgatttattgtgagtgtggagtaaaagggttactagacgctaaaggaagtaaaaccaattttgtgtgtgcaactatcagctcccatctgaaatccccccagacagcttcctgctgtaaccagctttttcctgtgagtggtttgttcattggctttgcagaaatgagaacagccaatgatgtcaggagtccggatttgccgaagtcatcagcatctggcaaagcctgagctggagccagaaggaggcgccatggcctggtgggaagccccgatgaagagtgggaggtgaagctggagtcagggttttgtggaaccgcctgtgcccgatctgtgagaagctatgggttatcagccacccccggtttcctcccttttaaaagaagagggtgaattttatgtctttttagggaccaattttcaaactaggcagctcatcagaatcacctggtgattcttcacccaaaaaaaaaatcaccctcgaatcagaatttttgataatgaggctctaggatctgtctttttaacaaaccccccaaatggccacaactcacacaatgttactgcttcatgcttttacacatcttgatgtatttctaggatttgtgaatgtatgctttttcaattttagcattttgaagttaaggtgaatcttataattgatgtaaataattaatgtggtcttctctccccttcccccgattctccttgagaagtggataatgaattgtgaatcttatatgcggcggtatttttaagtgaaggaaacacctcctctcatttccaactttacaacaactacgtgaagtaggttgtgcaagaattatttatcccctcttcccagaagaagaaacgggcttgaataggttaggcacattaccctttgatttatttattcaacccacgttaataataagcatcttctgtatgtaggggctgggctagattgggagaaagcagagatgaagacctggctcctgtccccaaggagcttgcaggcttgtgggggcatcagagcaataattcgtgcccgtggctagatcaatattggctctagaagtctcctctgggaggtgaggggaagagcgactggttctcatggggcttaggaaaggcaccgttggagaagtggcatttagagggagcttgaagaatgggtagggcatgctggacactgttatagtgctatcctcggagactgcaaagccaaggaatcaaaccgtagacacacagcaggattctggtggtggaaacacatgttggcatccttgctctctcaatgtgacttggggcaatttgtgaccatctctcctctgaagaacggagggctgttgttggagttaggtgagacgatgttggccaagagcttgcatagtgtcgacacttcagcaacacaggaagtggggtaggacccaggtgtgatgggtaattttctttatcaacctgactgggctgtgttcagaaagctggtaacacactcattctgggtgtgtctgacggtgattgggagagctgttagcatttgaatctgtagtaaagaaaatgtgcactcaccagcatgggcggcattgtgcaatttcttgggggaggaatagaacaaagaggcaaactcgctctcttttcttgagctggaacatccatcctttcctgccctgggacattggaacttctagttcaggcgctttaagactccgatcaggattttctccgtagactgccctggtgctcaggccctcgggtttggactgcacgacatctgcagctttcctgggcctctggcttgcagatggcagatagtgggactgctcagcctccgtcatcacatgagccagtccctcctaataagcatctttctatctatttatgaatgtgcttttggttctttttctctggagaaccctgactaatgcaccaggataggaatgattcggaaggagggaagaggcttagggccctgccctgctgggttctgttgcaagtggagggcaggctgaaggggagctggctttgtgataattcatggggttgaacacttggtaggctcttcggcgtgaagagatcagacccatcctgcactcctgccctcagcccacttttgctcttttgtccactgtcactgagggacttggcggcgtcagagccacagagagggaaggcttggactcaggaaaacagtgagcatgccacctcttctgtcatccaacagtaggcctggaaggacttttatcaatgctgtgcctggcactacacacacacacacacacacacacacacacacacacacacacacaaacacacacggatgagacagagatgggtctcattctcagcacggcatacaagtgttaaataattttgcaggtgttaaatctcttgcaggcgcagcacacggactagtattcatgtgaatccagggtcgtgacatcgtttgggtgtgagggaagtcctttcagagcttggggtgttgaagttgagatttgaaagatgagcagaagctgttcaggcaaaaggagtggtgcagggagagaggggctatgagcactctaggcagaggacatagaccctcagaggccatccatgttaggaaccagcaaagtgcattgcagctggccctgaaaaacggggagaggaggacagcaggctcaggggcttggccaccatgcctggggaaccctgccaaggatggggaacttttcttttcttttttttttttgagacatagtctttctctgttacccaggcttgagtgcagtggcctgatcatggctcactgcagccttgacctcccaagctcaagagatttccaggccccaccttagtctcctgagaagctaggactacaggcaggtgccaccactcctggctaattttttgtttctttttctgtgtgtgggcagatggggttttaccatgttgcccagactggttttgaactcctgggctcaagagatctgcctgcgcagcctcccagaggctgggattacaggcatgagccactatgcctggcaatgtggaacttttctacaaggacaagaggaaaccgttgaacagtttcttttctttttaaatattgtggcaaaatacacataactcaaaatttaccattttaacaatgtttaagtgtgtagtccagtggcattaagtaaactcacgttgttgttcagtcatcaccatccatctccagaacttttttatcttgtaaaactgaaactccatacccattaagcagtaactcccactttcctctcgcccagcccctggtaaacccagctatactttccatctctgtgaatttaactagtgtaggtgccttgtctgaatggaatcgcacggtatttgtccttttgtgtctggcttctttcactgagcacaatgtcctcaaggctcatccatgtagcatgtgtgagaatttcctttcttctaaggctgaatactatttcattgcctgtgtatactacattttgtttatccagtcattcgtttggacacctatcaaaagattttaagagagtaacatggtccgatttacattttggaaacatcagcctcgttgctttgtggaggctgatttggaagaagatgtgagtggctgcagggagcccagttaggaggctgccagatgagtccagtataagaggctgggtggcggtgaggatggtagaaatggaaggtttaagagctattaatacttagaaggaggaatgaaaagtttatttgggtgtaggaagtggaggagaaagaggactcaagagtcatttcaggtggatggggctgttatttacaagggcaagctgcagacaatgagttgggctttgggtttgtggagtttgagaagtgcatgggccattcaggcagggatatatgcttctaagctcgaggctcatttgggaaagtactggcctagagaggcaatcagtgccaaaggggtgcgtgaaactcctctctgcagaatgaaaagcagaaaaggccaaggagacattccttagtaactccaacatctgaggtctagtagagttggattggccaaccaacaacagtacaaggggttgttctgagagcaccaaaccagaggagtgtggtgtcatgagagccaagggaagataagggcttttaggaagaaagtgtttggtgagagagactgaaagagcgctcactggtttcagcaacacagaggtaactggtagcattggtgaaggcaatggcatattgagaagctgcagaagctgagacattcgatggttaccagctgtgtgttcttggtgtagttgttcaatttctctgagccattaattcctaatctgcaaaatgatacacccaataactcatagcacctgtgcatttaggggttggaggtagatagaatatggcttccagagtcaaggcaaggtctatctgtacaaggtgatcttcttgactttgtggttgactccctggactctctgttctatgcaagccggcaacaaaggggttttgcagcgttggtcaatgttgtcttcaacatttgcactcaggacttttaatggatgggggattaggatgagcaagaacaaccaggcttttctgctgcaggaaacatcccaggtgcatttactcactctctggtgttttatttctgagaagccagcagcaagagagaggatgctggggttgggaggcttggactctgggctcaatgctgtgggtgactggccatgcagccttggcaagccactgactcccacctttgaaattcctaacctatgacatggagccttcttcagctagataattctggaatgtacttcctcatttcaggtgtgtctgtattgcaaataagtccctaccaaaaaaagttgttgtattttggacaaaaagacacatctccaagccaggtacttgcatagctcttgtcacagttaattcccaaaacaactctgtgatgtgggtactgctaatcccatttaatacatgatgattgcttggcttcaggggctaatgacttgctcatgtgggagagagtgtttgtatcaggtagcaggaagttatgtttaggcaggggattattaattgaaaccgtaattgatcacttgctcttttgcaaaaggaatctgttgtgtcagccaatgcctggaagaacccagacactcattcctgtcctgagagtaaatctaagatcctcagctgacgcttggagacctctgttctttggctccaatcacattttgctggtttagtgtccacttttctcttgcacttccacttacacctatgctttggttttactgctccctccaagtcctacatcttctgccttgatagctttgggcaggtgactcccttggcctgggacaccctttcttggtgacacagtttggaattctgtcgttgtgtcaaggccagtgaacctttcctgacctcccaatgctgtagcattttcctccttttgaatctgcactgtattttttactttcctcctagtgtctctgccttgaatcagagttatttgcctctttattgcctttatattagaacatgaaggtgatttagtctttgaatttcatacaaaggaaacccatgacaacagttggcacgtaatgaaagctcagtgggtatttgttgatttcagatgcatgcatccttaactggttttggctcacttatgcactcattgattgaacagctaattattagggtctaagataatgaatatgatgttccatcacctttagcttggagaaaacatcccatgaaatggccacacatttcttctgggatgccccccgttagccgtctcggctggggcttcctgtcctggcatgttcgcacagcatgtaagaggtcctgtgggacacacgctctcatatgatcactgcctcagcctgtgagactagtatagcagatccatcttccccaaggtcccattttctggaggtggaaactgatgttcaacagtgtggaccgacttgccttgtgtctcccagctactgggtctgtagatgctgagtcttctggcttctgttcctgtggtatttctgggagtcaaggaaggataggaagaaaaggtaaaggaacaagtagggaggtgaggaaaacacaccagagaacagtgtggagaaggaagaatccgactcctggggctcatggcctggcgtaagagcaggttgcttctggggctgccaccagtttacccatgtgaaggcagactttgctcctaagtcctggatctcactcactgcagggtggcttctgggcagcagaggccaatgagctgggcacagagaccaggtcggaggcaagtcttggcccagatcttcacaaaatcctgccctaactctacctatggacttcaaaattacaactgcgtttaaaagtgtcccaaaccaagcaagctttattgtttaacagtattgagagtagggtaattcaggatgtaatggaacagctgtcttatcaggaaaaagggggtgtactctctcccccaatttctccctcctacctctgtaaaccctcatttcctccttaccgcctaccaaccagcatagctgcttcccagcaaagcccgtggaaggccaggctgggtgctggattctgggtccctacatgcttagtaaatcatcatgcacctgccatgtgagccctggcttagagccaggctttctcatcaaagcaaactgcttgtgttgtgtccataagcggcaagcactgccagacactcccagccatctggaagagcaagctggatgctcccagcaaggcccaaccagaatcttcacggggtgccttcgtggccttggttcctcgtttattaagtatgagtgtggccctcatgagttctaaggtttttaccttcctcctttggaatctacgatccagaatgggatcagctccctccaggagagtttcatgcagcctggaaaccttcctcacctcctggcttgggttatgggactaggctgcaccctacagcatggcagacctgcagactcaggaggctaaaaccccggttacccactgtgaggaactgggtggtgttaggggagttacctaatgctctgtgcctcagtttccccatttgtgaggtggtgacaataaccagtatctactgcaaaatattgttgcaaggattaaatgttgttatgaaatcaggatagtgcctgtcacccagccagcgatggtgggccttactgtttttgctgtttttgtaggcacctggaggctcacactccttgaaggtgggcacttcatctcaatcatctttggattcctactccctgtacttgtgtgggccaccctgggctcccagcaatgtccctgagctggggtcgactgcccttccacctattctaggcctgctgtgtacccctggttgagtatttatcccatgctcagagcactggagctgctgtgaatcataggacttgttggataccaccctgggctaggatatctgtcattctcatcatacaacaaacatgtttatatatcaaatgcaaataccaggtgtagatattttcatttgtgtgatcgtggaatttgctaacattcatatattaaacagtgactccactagccagtgatgcagtgaaatgaaggcactggatggagcagttgcgctgctgcgtcttggagggataggatagcaagtgtgctgctgtggtgagacctccgtttcctcctggagatggcagctgagctaggccttcacctgggatgccaggtgttttggtgtcagggactgagggaatgctcttggtaggggttgctcaatgctttcaaattttcacaggttcccaggtttgtctctagacacacaaccagcagtttggtttctgtcatagagagaaaggacttgtgagccagtggtacccctggctgtactctacagccatgactccaaccctccccgaaaccatctccactgcaccttcccggtggtctgctcaggacactggagagatgacaggctttgaacaaaggctcaggtttccggcttgaaaacagccttgctggaaagcagcagcaccctcactggggcaagaaactccatgggcccaatctttccagttgtggcatcaccatcactcttgacttctgtaagcttttcttaagatctgaccctcacaaacagacaaataaaagcaaacatttatttcttgtgccatatacttttttctggtaatatacatatatatgtatgtatatgtatatatacacacatatatatgtatatatacacatatataacatatatcatatatgtgtatatgtacacatacacatacacacacacatatatgatatatatcacatatgttacatattatattacatgtatgtatatattatatattatatattatatatattatattatatattatatatattatattatatattatatatattatattatatattatatatattatattatatattatatatattatattatatattatatatattatattatatattatatatattatattatatatataatatatattatattatgtattatatgtattatatatgtatatttagaattggccagctttttagatgatctcaattttgttggcaacacccaaagcattgtaatcaggatccagtcaaacatatgccttcttctctccatcaggccgaatcagggagttgaccttggccacatccatgtcatagagcttcttcacagcctgtttgatctggtgcttgttggctttaacatccacaataaacagaagtgtgttgttgtcttctgtcttcttcacggccgactcagtggtcagcggcaactcgatgatagcatagtggtcaagcttgttctccaggagacgctctcccgaggatattttggcgcttgttctcccggtgggggggagctctctcgaggatatctgggctgcttgttctccagggggagctctctcgaggatatctgggtgcttgttcttcggggggcgctgtctcgaggatatttgggctgcctccggagtcgcagtgttatcggaaagtgggtgacgtgcggatcttcttttttttttgtggctgtggacgcctttcaacactaccttcttggccttcaaagccttcactttggcttccgcttcaggaggggcaggagcttccatctttgctttcggcgccatcttgtgaaaaggctacgttgttttttttttttaattatggaaaaatctatataacataaaattcaccattataaccatttttaagtgtgcagttctgtggcactaactatatttgtattgttatgcaaccaccaccactatccatctctagatattttaaaatctctcccagtggaaactctgtacccatgaaacaccaactctccatttccctggtaacccccattctactttccatctgtatgaattcagctactctaggtacctcatatgagtggaatcatacagtatttgtccttttgtgactggacttatttcacctagcgtaatgttttcaaggttcattcatggagtagcacgtgtcagaatttccttcctttctaaggctgaataatgttccattgcctgtggacgacccattctgttcatccattctgcagtccatggacacttgggttgcttccaccctctggccattgcgaataatgttgctgtagacatgaatgtacaaatatctgtttgtatctctgctttcacttgttttgggtatggatatggtttggctgtgtgtccccacccaaatctcatgttgaattgtaatcccctgtgttggggcagaaacctgctgggaggtgattggatcatgggggcggatttcccccatgctgttctcatgatagtgagtgagttctcacaatatccggttgtttaaaaatgcatggcctctcccttcttctgctctctcttgctcctgctctggcatgtgagatgtgcctgcttcccctttgccttctgccatgattgtaagttttctgaggcctccccagccatgcttcccgtacagcctgtggaacagtgagtcaattaaacctctttctttataaattacccagtctcagtctcaggtatttcttcatagcaatgtgagaatggactggatcatatagtaaatctatgtttaatttttaaggaaccaccatgatgttttccatagcagctgcaccattttatattctcacccatagtgtgcaagggttctgatttctctacatcctcatcaataaatgctataacatatagtttgcaggcatcatatttcattcttacaacaacccagcaaagcagaccgtaatgcccaaatatagacaggcagtttggagatattagtgaaatacaaaacaacctttccagggccagctaggaaaagagtgaagtcaggatccagacttggctttggattccaaagcccatgcccttcccagcctatcagactatatctctaatagatgaatgcattcttaattcacctaaaatgttagtataaattattaccttttaaactgggtacctgctcaatagagtattttgggcactgggttgtcaacaaatcatctctgcaccatggtgtgccttggttccgggagagcatattctaatgcataattagtagaaataatggagtctatcatagatttgctctgatctgagatggttagtaacagggcacacggtgcacagattcctttccttttactcatttggcaaacagtcacggagcctatcctctgtgccgggatgtgcatggggctgggattttagggattcaaaggtttggttcctgcctacgagccactgaagccacaggtggcagggacagtaaacaaggtctgcccacagccggatgagataaaagctggtggaggttaagtgaaagccatccctgctctacttttgaaggtaggaaccacagccaggtttcacaaataaaactgatgacagaacccatgtgtctcattgcgctggctgctgagaaattgcgcaaaccgtggcaacaatgagcttttgttttgtgaacccaaagtattagagacgggtctcaatcaatttggaaagtttattttgccaaggttaaagacttgcccgtgacacggcctcaggaggtcctgatgacatgtgcccaaggtggtcaggggacgccttgctttttaaacattttagggagatatgagacaaatcaatatgtgtaagctgtacattggtttggtctgtaaagttgggacaactcaaggcgggggcttccacgtcataggtagataggagcccaaagtttgcgttcttttgagtttttgctcagcctttcagtgaatatacaatatatatgtgagagtgggataggggaatagtcacttatgtcttagtctggctcagtgaatctgcattctccatcaacaaaagggcagaggaagcaatcagatgtgcatttgcctcaggtgagcagagggatgactttctgtcccacacctgggaaggtaagctatcagtttacactgtcagggtaaaattcagcagaactgttctaggggaaaaatcttgaggcccacaaggaatttccttgtgggaaaattgtgagggaggtgtgtagctttttaaatctttgcagctatcttatctaggaataaaatgggaggcaggtttgcctatcgcagttccctgcttgaattttccccttggcttagtgatttggtggtcccgagattgattttcctttcacaggttaaataaatatgccgtgcaatattcttaaatagatgaacaagattattagttgttgaaaatcagagtcttgaaattttttaatgcattcttttttgtttgagaccaagtctcactctgttgcccaggctggagtgcagtggcatgatcttggctcacggcaacttctgccctctggggtcaagcgattctggtgcctcagcctcctgagtagctgggactacaggcatgcgcccccacagctgattaatttttgcatttgtagtagagatggggtttcaccatgttggccaggctggtctcgaactcctgacctcaaatgatcagcctaccttggcctcccaaagtgctgggattacaggcgtgagccactgcgcctggccctttctagtgcatttgaatcagtctaaatatcaatgggttccttattagtttgcccatttattcatggatgttgattgactgcttgctgtgcatctgggagcctcctgtctcccagctggctgtgccctcagcagcaacactcttgtccctcccacgtgtgggcctgagtcagggttcactactgtggggaactcgtgagggatttggacagttttggtgaagtgcaggccaccattcttggagattggtggaggtttcttagccttctcggcaacaggcctcagccatgggtggggaggcttctgtgaccttggtctgcagcctggaggacgacacttcccctgcgcccgccctccctgtttcctggctccacttgcaggggctctgtcctgatgccaatcacatggagtcacaggacaagcaaggttccttccctcctagaacttctgttttactagaataggttaacccagtggaaaagacggacaacagacccataaactctgtgtgtgtgtgtgtgtgtgtgtaaaatatggtgtcaggcaggggaaagtgtgtaaaaaattaatcaggataagtggatgaagaggttagtttaagaggaggcagtctgagaaggcctctctagagagggagccaccaatattgtatacacgcacgcgcacagacacacacagccacacatacacacacacacacgtagacacactcacacatacagacgcacccacacatacagacacacacagacacacacacagacacataagcacacagacacacacacatacagacacagacacacatgcacagacacacatgcagacacacacacacaggcacacacagatacatagacacacacatgcacagacacacatacacacagatacacacagacacacagagacacacagacacacacgcacagacacacacacagacacacagagacacacacatacagacacacacatgcacatgctgacccacgggtgcacatacacacacaggctgagccggctggtatttcctctcttcccctgttttgcccagacacgcaggcatcacggtgtctgctggccacatcctccacccaaacgcaaaagctgggagaggagcctagagggtaggtaacaataaggtcaagggcagttgctgcctcagaggacacatcccagatgaggcacaggctgggaaggagcccaggggcagcagggacccagggggaagagaaaggacagggggaagagaaaggatgggggaagagaaaggacaggctggatgaagcccccccacgattctttctgacccagcatgccctccatccaccatccctcagccccagtcaccagcgtaggcgctccaaggactggtgtgaactgagggcatgagtgcagcctggggcacagagatgactgttctcactgcaagcctatcaagccctcctggcttccactctgtgctgcctgaaatgtctataaatggtgtctgtaagtctgtggcgtgtaaaggctgccttcctcctccctgatgtgcataagggcagagctgtaaggtgaattctagcccagtggcgtatgcgagctggacaggtagagtgcaagtacttgcctccctgagtctctgtctcatcctgggagatagggtgacagtggccttataggactgttgctgtggaggtcaaatgggctaaggcccagtgccttctgtgtggctaggctcatggctgtagcattgcaagaatcccaggctttagtgtctgcgactgtgaattccagcatggctaattattagacaagtaactgggagtatataaccaaagtgcccgggtcacattttctgtagctgcagaacaacacctgttttgcataagaccagatggcaaaatgtgggaaaatgctgcactgaatacaagtttgggttgactggctccaccgggcccaggcgtgtggcagttgtgatggaatccacttcacgtcttcctctgacagggtgtgtgtactcagcccaggagctggggagacctcatgttcatattagtttggtgcaaaagcaattgcggtttcagactgtgaattttaaaaaattataactaggctcaaatacatttttattagtcaaaataggaaccattacaatcaacacatttttgccaacaagaaataagtttgtttattcctgtagtgtaaaaatttgtgtttcaggatttgagtaactgttggaaagcatttttctgcatcctgctggttgcggaagtgtattccctgcaaaaagttgtccagatgcttgaagatgtagttggttggcaagaggttcaggtgaatatggtgcatgaggcaaaacgtcatagcccaattcgttcaagttttggagcatggatcgtgcaacttggggtcgggcattgtcgaggagagaattgggccctttctgttgaccagcgccagctacaggcattgctgtgttcgatgcatctcgcggatttgctgagcatacttctcagatgtaatggtttctcagggattcagaaagctataatggatcagacctgcgcagaccagaccaccaaacagtgactatgacctatttttggtgcgagtttggctttgggaaatgctttggagcttcttctcagtccagccactcagttggtctccaccgcttatcgtataaaatccacttttcatcgcatgtcacaatctgatcaagaaatggattgtcgttgttgtgcagaataagagaagatgacacttcaaaatgatgattttgttttttaaatttgtgtttggctcatgaggcacccacttattgagctttttcacctttccaatttgcttcagatgccgaatgaccgtagaatggtcgacgttgagttgtttggcaacttcttgggtagttgtaagaggatcagcctcgatgattgctctgaactggtcgtggtcaatttcccgtggccggccactacgcttctcatctgaacccccactgtactgtgtgttcattagcagttcctggaccaaatgcgttgttgatgttgcaagttgtctctgctgctttatgacgcattttgaactcaaataagaaaattgctcaaatttgctttttgtctaacatcatttccatagtccaaaataaatataaaataaatagcaagtaacaagccgttagccaaaaaaagtgagaaatgtgcattgaaatgtataatataaccacatttatttaggaagctattccaatgtcaattagcaaatttccacaatacaaaaactgcaattatgtttgcaccaactaatagaaagctttctatgcagatacatggaaaagtgggagctcctaaacagcagggaccaggccatatttcttatagttcttgcactctggccacttttcgcatagtagctgctcagtaaataagcacagaatgagtgtggctgtagttccatgttcagcttaacggtacaactaaagtaattcttgacccacagctgggttgagctatgcatgccgctggagcccactcactgtgtggtcctgttcgattccagtcatccacccacccatgagcacagaagagaggggtcctgtagaagtctaataccccttcttctcaggcctctgttatcacaacatcaccaattccctgcaaaccctcccagagcttgcaaaatgccaaatcccaaaggtgccatgaaaggatccatggcgccctggatccctggcagaatcttttccacggcaggatcttttaagggagtggtggagagggtgaacatttgacttcagttatctttttcagtgaagaagccactaaaagtgattctaccatgggagggacaccagtggaggagagaagtggggagcaccaggggccactaggattctgggtgctttgactgtattttctcatttaatttcagaaccccaaatctgaatagcaccatgtcaaaataactaaagagataaatttcatgagagctagaaataatattgtcatgacggttattatttaaatatttttggtacaatttgggattttttttctaaattctcatggcacatctgagaggtctcacagagcaccagtgtttcaaggaataggaagacatgaccaagagtgcaactcgtggatggctgagttcttgcttctgcctctggaacaatgtttggtcaggtcaaaacaatttcttaaggtgcttacaaatcttgacagcaaaaacatccattttttaaaaattttttaaaaagaatggaaatctgagaagtaatcaaattcaaagaaaaaatgttattttgacgctcacaaactgttggcagttcggcaatactataacatgtacacacccttattattatttttgaaaaatgagataattaaaagtattttatgtatgtttgttttatgttataaacttgaaatatttttaaattgcttataaacatacataaaatacatattaaatataatggttgtagttaaacacaggtttctgtggccactatatctatattatatggaaacttcaacttcatctctccctaccaaaaagacttctgggaacttgaaatgtagtttaaaaaccactttgtttttcttttctttttcttttttttgttagacggagtcttgctctgtcaccaggccagagtgcagccgcatgatctcggctcactgcaacctctgcctccccagttcaagtgattctcctgcctcagcctcccaaggagctgagactacaggcgcctgccaccacttgggctctgctaatttttgtatttttagtagagatggggtttcaccatgttggccaggatggtgttgatctcttgacctcatgaaccacccgcctcagcctcctgaagtgctgggattacaggcacacgccactatgcccaggtaattttttttgtatttttagtagagatggggtttcaccatgttggccagactggtctcgaactcctgacctcaggtgatctgcccccctcgtcctcccaaagtgctgggattataagcgtgagctactgtgcctggcctaaaagccactttcttagccaacctctttaacaaaactaatttgcaagaaacagaatctggaaacttagcgtttggttattattcattgtaccactcaaccaaagctttacaaattttgactttggcatatgacttcaaaatttttagaaagacacactctagctagaattcccaactatctcctctgtctatccttccatttgagcaaacattttatgcagctctctgtggtggactccaactttcagagactcagaaacacggctgcctgtgcaatgctgatatcatagagcaatagaagcagcgccatgaaagaggtcctctcctctacctgatcattttgcagaggaggcccagagagggggagggacggcattaattcattcctttattcattcatttggcatttattgagcaagtgtgctgcaagtatgccattagggtgtggaattacaaccataaataaaatactgtttcgaccatttcagaacatagtttagttgaggaaaaagacacaccaacaaccaaagcatgatgagttatcataggagcacctttccttcaggaaacagctgttggtcgtttgttgtatgccaggttctgtgctaggctcggagaatataggggataagtcagagaggtccctggtcctgatggaatttaaacacacatcaggaagtagatttgaacaagatcatgagaaatgttgagtggctggttgtggcagctcatgcctctaatcccagcactttggaaggccaaggcaggaggattgcttgagcccaggagttcgagaccagcctgggcagcatagcaagaccctgtctcaaaaagaaaagttaacaaataaataaaaaggaaatagcgttcagcaaaaatgttgcaggtcctcaccacgttcttcacaggcacacgtcggggagagaagagagggcatcagaggttgcagacttaccaacagccgtggtggagcccgttggctccctggaactctcgggactgcatggtgtggctcagcataggtggcctgcgaggatcttggtaggcagtccacagagagaggccttgtcctccgtagtgatcactatttcagggatggactagaggttaggtcaaggaacaactaaatgtcatagagagtgatgctccctgctcagagaagtggctctcttagaaaggggacatctcggtggcagggactggcacaccctgatctgccaccgagctgactcaggtgtgcagggccggccctctctaagctgcataatggggaggaaatgggcccccacgtctctgcatttgcctttccttcaatactgaaggccatgtgcatagggctgtgtgattatttcagcagcgcttggctgggtaaaggtggcagaataaacggaacagacaggatgatccagacctaggtccgcctagacgcatgcatgtggcacaacgtgtgacggagccacttcacagctgcctttttgataagccatttacaggacttcaggatgcttcttgaggacaatgggatgtcatcgaaggtattgagaacgatgtgaagaaatcgttttcatttttctttttttttctagagacaaggtcttgctctgttgcccatactggtatgcagtggcacagtcatagctcactgcagtctagacctctctagttggagcaatactcctacctcagcctcctgagcaggtgggcctccaggcttgtgccaccacacccagccatttttttcttttttttgagacagaatcttgctgtgtcacccaggctgcagtgcagtggtgcaatcacagcacactccagtcttgacctcccacctcagcccctagagtagctgggactatatccagctgtttgtttatttttttgttgagatgaggtctcactctgttgcgcaggctggtcttgaactcttgaactcaagtgatcctcccaccttagcctcccaaagtgctgggattataggcatgagacactgcacctggtctaattccttttcattttaaaaagatgtggaggaagtagattggaacgagggcaaggaagatccaatgagacaagctgagtggctgttgtaatgatctaggttgctggagatttttaaaaatgtattttgttcactgttttattcccagaacctagaagagtgcttgtttccaaatagacacccagtaatagttaatcaacaaaattcagttgctggtttgagggtcagtggaacgtgggtcccttttactgacacgtggaattgctgatcaaatctcctcttagcattattatttccagtgactctggagagggagggcccttttccaggctttagggccaactgacagagaaaaatgaaaacccaggtaccacaaggctgaaaggtgaagacggagtcatctcaaattcttcccaaccagctcatcaagatctgctggttgatataaatgtgttacctggaaggatgacttcatgtgtttgttttctgttttgaagaaaggaagtgtatttggcaagggaacttcttcctttgttcagctctgggaatccttaaagtcaacagatttccagcaggttatactcaaacaaggttgtgtctcatggcaaacaaggccttagaaacagacaggcccagttttgaacaccagctcaaccattctcaagacatgcgatcatgggcaattaacctatttaatatccatgactcagctttttccatctataaaatgaaataatcctggtgcctatatcatagaattgttctgaaaaataaatgagataatatgtgtagtgcattaattaaaacatggaagcaataagcacttgctggatgtcaggggtcattacttccactacagttaaagtggaaaatggaaagaggcctgctggagccagatgtcccctggcggacgctctggtctggggacaggcgacacacctgagtggcctattgccttgtgctgatggcttagcctggtatgtctgctgatcacgagccaggaggagtgggaactgagccatagccacgttggaggaaaatccaggagcaaactccatgagagagtcatgaaatctggcagtggaagggctgccgcctggaagctagtgcttggtatatctgcatgagaaattaagggatcaggatgggaatgtctttacgttaagccttttctgcttgaggtgactgcatatgacaggggacccagagtgacagcataagctgtggtctccctgcagacttacatgtgtcgtggagtctgcgtaggtggcagagagcttgagttgctccacggccaaagaacccatgctcagttaagagaatgtgaagaccacacgcttgggccaaccatgctgggccggtgttggatttgcaggcaggttctgaacacagagtgtcagccgctacttagattgttctttttcacatggggtcgccagtctgaatgcctccctgatgggatccgtgctaaaaccctaggcaggggaagtgtaagttcccaaatgaaaagggtgagtcactgaagtagggtcagagggaggaggcagctcctggggtaaaacctgcatcagaggtaaaagggaagagcctcttagcagggagccggctggccttgctgcctgggcagatgcatcttttactttcttatatgtttatcagtccaggaaaatgtaagcccagcgcattcagggggcttaacgcctttgttttcctgctgtgtccccagcttggagaaacaggcctagcacagcagagatgctcaagacatatttgttgaagaaatgaatgaatgaatgaatggatgcagattcacttacgcagcaatcccctgtcaggtgagaaggtagagagtgctgctctaatcacttctctctttacctctctgccttaccaaattcctcctatcttatgaggtttagtaaaaatatcaccattaccagctgttttattttcccctaaaatggctttttatctgttgttgacatgtacctcggccctggatggtttatggttttgccttattttgcctttgttcggtttggtatgaatttgatatgagattgtaagttttttgagggagaggccatgccttagaatcacagacctctccagtcacagcgtcccgaggaaaggaactgaggctcagagaagcaaagccacacaaacactacacagccctttgtgtgttaaagtggctccaccatttctttctggggagacttgtgaccttgtccataaatgcattcttagcactcctccaaatggtagtgtgctggccttctgtggagggatgtggcctcctaagatgcctcaactttctccagaggatgacagcctttcacaaaagcacgtcatttccagttgaactgtggtaaaaagaaaccaggcggcatttcaatgagaacatagagcgtctgtatcccaggcatctgctgggatgttcctgtcaatgccctccccacagcacttaccacagttgcagcaggagacacgttctgtgtagaggatgcttcgttcttttggtgctttaaaaattacgcctgggttcagagcccagggtgcccacctttacacgatggaaccaccaggagagattaactgagggtctgacaccttcttaggtctgattagagacatttaccgtctaatctccctgaagcctccctggaggcttcatctgtacaattagaaccttggtctctacaacgcattatcttaatccagacactcttttctttgattccaggtctttagataataactctttcaaccaattgccaatcagaaaatctttcaatcagcctgtgacctggaagcccccagttcgagctgtcccccctttctggtccaaaccaatatacatcttacatgtattgatgaatgtctgcctgtaacttctgttcccttaaaatgtataagataaagatgtaacccaaccacttctggcacatgttctaaggatctcctggggctgtgtcgggggccttggccactcatatctggctcagaataaacctctttaaatatttttttaaaatcccccgattaagccagattgacaggggaacctacagggagacattaagacattcgttttttgttttgttttgctttgttttgttttgttttgttttgttttgttttgttgagacagggtcttgctgtgtcagccaggctggactgcagtggcacgatcatggctcactgtaacctcaatctcctgggctcaagccattcttctacctcagcctcctgagtagtgagagtacaggtgtgtgttaccacacttagctaatttttgttttttttttttttttggagagacaggtttcaccatgctgcctgggctggtcttgagctcctgagctcaagcaatctgcccgccttggcctcccaaagtgctgggattacaggcatgagccaccacatgtgctgacaacatgagttttcttctttgatatatgtatatgtttttaatgaactgaactgtgagtctacattgagtgacatgatgacaaccagccttcgaaactcgctgtgtggacattggtgaggacatcgtacccagcattacacattgaacaagtgggcttagagaaaatgaaggaagtttccattcaggaaggagctaaaccaaaccccagttgtaggggacactattgttctaactgaatagttaatttctttggagcaggccaacatgaaagttataggaatgaaatgtccatgtgaggttctcagcaaaacataagtaggaaaagcaactattttcttttggcgtcatgtgccaacctgccctgtgaatgcttggagggaggacagacttttgctctggagcattttctatcctcgtgtgtagccgacatccttaatcaatcccagcatgactgatttcctgatttctccacagccaaggtgaatgggataaaatgacttggaccacgtttgcatgcgatggaagcctggccaccagccttcctttaggagtagcaacctagcttgtcctagggtgcaataatctcaagacctggggtctagacaggaagaattcctccaaggaatcaaatgggcctcaagttaatgatttgggctttgcctcaaccagaggctggactacagagcagatctggtttttcaaaccatctcttatgttcataggattcgatttcaaagaattgagatagtatctcaattcttccttgtaacaacacccagagataagaactaccttaaattttacagataaagataatgagactgagaaagttttaagtgactttttctacactaagtagctgagtgtggatctgcgcatgggccactgaacatcagccactgaatgtgggtcacttgcccaagcctactggccctgaggcaaaggccagagaaaggaagccttggaagagatagtgtaataggagctgtggagtggggatctgcacactgggccatgctgcttgcagatgtgagcttgttgtgatttccctactcttgggatgccgccttcctttccccaggatgttctgtacgcgtgcatcctccttccctgctcactgtggtgcctcccaatcggtcaccccacttctgtcctttctcctctttaaccctttcgccactcagcaaccaaagtgatttttctttaaaaaattattttagtttggattcagagggtacacgtgcatgtttgttacatgggaatattgtgtgctggtggggattgggcttctactgttcccattatccaaaaggtgcacattgtacctgatagatacattttcaaccctcactccctcgcttcccagtctcccctgctcttcagagcccccagtgtcttctatttctatcaaggtgagttttctgagatgtaaatcagagattacgccatttccttgctcattactccctcgtgacatttcgtggtacacagacaaggagcacgtcctctcccttgcactcaccttctcctctgcaggtggttgttgcccgcagctccctgcgcccggctcctccttgccactcagacctcatcaacacctttcctgatcatctgggatgaacgcatcgcccccatgctactttactttctggagctctcatcctcctccctctttgtttccttggccagctttgtttttcttggcagcatgggtggctacctaacattggatgctgtgtttaattgcttatagtagacacttgtttaattgttcactcttcacccataaaggcagagactcctttgtcggttggttgctgctctctctcaccaaaatgtaagctccctgagggcaggggccctgactttcttggccattcctgaattccacatggctaaggcaattgctgatacatgatagacctcaaaaaaatgtttgttttttttcaatcaatgagaaaaaaaggcagcgttttgaattgcaatggagagaatagggaaataaaagcttcaacccagacctcatccctggacagagaaaatcccatgtactgcatatatggacaccaagatgggaacacataccccacccttcagtgcattagtccctcattctgtttccaaacctcacccctccctcggccccacatccctcagaatgtagctcagtgtcacttctacggcccaccctgatcaacttgttcatatccctttaagcacctacctggcaatttggtaactgtagatttctctgtcaccccaaccctggaaggcaggggtgggcttctccatcccagggtcccttgcatcgtccctgcacatcacaggggcttggggaacacctgataaatgatgaggagagtggatgagtgactagcaaagcctggagtcaacttttgatgccctgaagtcaataaaatgacacaggatgaaaaggtcaaaaagtttcttcaacggctcctgcaggaagcatttgaggagaggaaatgatattactcaaacagcattgactgtattttctactgtattttctatattcttgatgctgtggtgtttggtgccttgatcctgtagggactgcccatcaggatcagtgaggaaaaaaagacagtgttttgaattgcagttgagagaatagggaaatacaggcttcaactcaggccctgcccctgaacagagaacattcccatctacatagagggacaccaagatgaggacacatgtcctgtccttcagtgtatcgtccccctcattctgctagagctagcaagcagctccctgtgagcacactcaccgaaccagagcccataccctaactaccttctctatcaaacttgcgcataccaagtaatatttccccggcctgccctaagtcaccctagagccatgtaccaaaaaatcaggggtcacccctacagctcagagcctgtcaaaattatcccaagtatccaattctaagcgtggggacctaggagacctgccctgcttcatccattccttgctgtgagaacccaaggaaggctctgggccatgctctcccctcttcctgctgctgcctcctgacgcatcgtggtgattccctcatggcctggtgtggcggccacaccccctgcttctgggaatctgtgagcttcagcttcttccttcataatatcacttcatgcgtgtgtgagtttaccatgactaattaaaacaaactcaagcatttttagaacacagatcctgttccgatgcttttttgcatcccccaaaaaataaatccaatgaggtcatgcattcgatatacctaagagacagtgatcaacttgctagacatctttctatgcaaataaagcataaaaatgatgtacaaatctttacttagccaaaaaaatgtttctggtggattttatgcaagaagatggaaaaagaaaatgatgatcatggttcaaaatgttctagtttcttagggttcaaagtacagggaaaaaaagaaagagaaaaaaagtatttaaaacagaaagaaaaaaatttaaaaaaagaaacaaaaagaaaataacaaaatgttcttgctagcttcttggggttcaaagtagaagacaaaaagagagagaaaaacatagttaaaacaaaaagaaaaaaattaaaaaaagaaacaaaaagaaaataacaaaattttcttgctacaaaaggaaaaaagacagtcaaggggcctgacaatatccagggaagagagagacacaatctgctcctactctgcagtcctgtgtgtgtttgtccatgtgagtcctcatagcagaccagtcagagaaaaaagtcatcttggcatcactttctagagttaatcatttcatttttcttaagttaattaaactatttttttcttaatgggagagcgtcatagttttcccctttcattctttgagaggtaaccatgtcctccctgaagtggcagaaacctctgttgactgctcctatctgaaaggaaatacagtccctctccccttcaggagaatttatgctttttccactaaagatgcggatattacttacattcctacagtgctttaaaattttgatgatctttcaagtccattttgtcatctaattcctccaataagcagtgatataggcagagtagagaatgtttttacccattttacagatggagctcgaagatgaggtaaaagactgaggcttggagataaggccactttttccccgttaacttgaccaagatcagctgcctagaaagtggtagagaggagacaagaaacacaaggcagcagggttcagcccctcatcagtagctagtttcaacatgtaatagtttcattttggctgggcgcggtggctcacgcctgtaattcggcactttgggaggccgaggcgggcagattgcttgaggtcaggagttcgagaccaaactggccaacatggtgaaacctcgtctctactaaaattacaaaaaattatccgggcatggtggcacatgcctgtagtcctagctactcagaaggctggagcaggagaattgcttgaacctgggaggcggaggttgcagtgagctgaggtcgtgccattgttctccagcctgggcaagacagcgagactccctctcaaaaaaaataattttatttgaattatctttctgtgaaagaaataggttctggctcccgcacttcctgtgcactgatcttatttgatggaacaaaatttgaatgtgctacctatatcataggctgttcagggataccaagaaagatagataaatagacagatagattacgaatatagatagatagacatagagctagagatagagatatcttccacctatctgctcactatgccagggtatccttgaagcatttgttaactcgacacagccacagcatagaagaaacttgggtcttgaatgactgcatggagcagagtctgctcttgcataggagccccaataccctgtattctggaccctgctgcatccactcgggctgaagaattcaagaaaaagccacctatctgttatagcccttccctccagagagatcagtgtattagtaatcgccttatttattttgactttgatagtattttttgttataaaacaactcttgatgttattaatgtgagatagtccgaagattgtttcttctcactgtataatgaaagcaactggggcagaaataaccaaaatcaaaaagtgcattaaaaacagatggctgcaggtgtcctattatctttcatttgtgttaattaaatttagtgttggcagataatataaagagatactcagttcaatctgacttttggagaaattacaatttttattagtacagttatttccaaatattgcaaatatgagaacaaataacccccaactcatagtgattcaatgcaatagaggtttatttatgactcatggaataggctgcaggatggggggcattggggcactcatgtgggggcagcctttgctccttgcagtcattcaagacccaggtttcttgtatgctgtggctcttttaagttcaataaatgctttgagaataccctggcatagtgagcaaacaggaggaggatatctgtatctctatctctgtctctatcagacctgtatctaaaatctctgtctctctctctctctcactctctctatctttgtatcactgaacagcctatgacataggtagtacattgaaattttgtttcgtcgaataagattgatgcacaggaaatccaggaaccagaatctattacttttattgaaacataattgaaatgaaaccactacttgttgaaactggctgctgatgaggggttaaagatgaaatctaaaaatacagtgtcattttattttgtataaaagttaaagaatattctgagtttgctgtaggtttttacttcttcttttatttctgcagataactctgaggttattttgtttcgatgtgttgttgaaacaaagcatagaaattattcagatacatagtatttcctgccagtagctttgtcatcaatctgactgagacacatcaccaaggaaaagcaaactttaaatatgaaataggcagtcttcattcaaaatatttataggcatttaatatggataaccactgtttcacgtataacttttgcttaattataattgagaaagaacagtaagttacgaagaggacggtgattctctctgtttcatgcctcccagcacactagcattaaacaacaggcacagagatttttttttctctgtaccatgttttgttctggttatatttattggcatgtaattttgtgtttatggaaacaaataataaaaatagaactaattatatatatgccttaaaaaatgtacagcttggcacaagaaaaaatggaaagaaagagaaaagggtctttcactagagaatatttgggagggaagatggagtgggtgctgccaggtggatgtgtggcggaacctttttgccagcttgtttcccttgggccttgggccactttgttttctctgaaagtgctttctctttagcagggactttggtagcatgagcggaacccctaggtgttcatggaaacctggctgtccaggggcttggggacaccatgggacacgctgccaccctctagtggtagaatagagacgcacttcaccaccagggggtctcctctctgtcattgttttccagcctcaaaaagtcacatcctagccctgcgctcatggtggctcaggcctgtaatctcagcactttgggaggccgaggcggttggatcacttgaggtcaggagtttgagaccagcctgaacaatgtggtgaaaccccatctctattaaaaacagaaaaactagccaggcgtggtggcaggcacctgtaatcccagctactccagaggctgaggcaggagaattgcttgaacctgggagacggagattgcagtgaactgagatcacgccactgtactgcagccttggcaatggagtgagatgctgtctcaaaaaacaaacaaacaaacaacaacaacaaaacctcacatcttttttggataacatgaaaaccctatacttaaacccccttccctgacccagagattcttagcggtgtctgtttgagaatcactgaatttgttgcacaattttgacagctgagatttggtgtaatcattgttgaggcttgtaatacaaaaagcaaaatttctttttgtctctttcacttgtcaaatacagataatactgtaaccctgaatatgcgtacgtctattcaatagttaccctcaccctagtgttccctcagaggggcacacagaatcctggttgctaagcattgctttggtgcatgctgaagatcccagtaacttcaagctctctttattttgaattgtatgtctactaaggggagtgacctgggttccagtgaaatggtttccactgcacctgctcctttcacttcctcccctgctctgtcctccccttgctcacctctctttcaatttctccttagcctgccttgcctttagcaggagaagaatggtgagaatagagagaatctagtcctgagcatggtcgacctgggttctgggcaggttacctgtgccatgcccttattctacccgttggcctgtgcagggaggtgagcactgaggaaagacaggtgtgttcactctgcccaggtgagctccgggatgggactccctaggagggatcgtggggagggacgtccaggctaccattcagggctggccatctgggcttcagggacatcctgacgtctttgccttgtcctgtggtctccacagagacagtgttggggctcccctgagttgctgtaattccacaagtggggagctcccctcacatctctctgcttcctcggccaaccctcctctccagctgccagggccctgtctacctgacacttggaccttgctgcatatttctcagcttccgtccacctctcccatctggctgtctttgtgtgtgtgtgtgtgtggctttgtcagttacggcggggtttctgggccacgtggtccgtgctgtttgagccatcctgagctagaggctgtaccatgtctctaggggaaggggtgggtatgaggcctggagaactttcagggctgtcttgcgtggaggactgtctacaaggtttaggagccgggataaaggtagtccctgcaaagcccggacagccacagcccacctcgggggccatcgagtgctacctgggaggtctcctccccatcatttgctcaggctacgtgttagtcaggttctccagagaagcagaaccaattccttaactgtgtggtgtggtgagccacaggccagcaggctggagacccggggaggagctgcaggccagtcccgaggccacctgctgccagaactccctcttgctctggggaggtcagtctttgttccattcatgtcccctcctcattatggaagaccatctgctttaccaatttaaatatttatctcatagtccaccaacttaaatatttatctcatctgaaaacaaccttacataaacatccagagtactgtttgtccaactgtccaggaaccatggcccaggcataacatcaaccatcaaaaggcatttctcgggtttgcgtgttctctggcgtctgacccccaaagccacattctccttgtcctcaaggatgggtttctggcccttggcagctttgagacagatttgaggtatttgaggttccttggaagcgccagtcatgccctggtattctgtgtcccgggggccccgatgctgagcatggacatcaggctggttcacagtcggtgactgcagcaccctcaccagcctcgcataaagcaggaatgtttagccctgtcttaagggtttgcttggggaaggaaatgatggtgagcaaggtaggacttttcacatggggagtcattgtgcttacattgtggattacgatgatcccatccgttttcagagagtgttttctctatttgcttattgccagggtctggtcctggggaaagaagcaattgggggctctggtgagaaggcacaggggctcccccagaagcaaggacagagagagcacggctgtgcttgctcaggtgtgctcagcaggctgcgacgtctgcagcctggggctcctgcgcctgtctctttgatgtgagctctacctctccttcaccatccaggctgtcctggggcaaactccaggtggtcacttttagctgtgtctctgggcagacaagtctagacaagacaccactttcttctccactcctgtttcctgagtgtacctagggaactacaccaggtcctcccccaggcacctgctccattagtgactggtggccatcttcacactcccggtgagcaaggaagtggcaccagctgggatccttcttctcaagccacacccagctgagaaggctgaagtaggcaccgcagcctgtcctgtggacttgaactgctccgctgctgcaggcgtgtcctgccaggtggaacaaaaggaagaacacacttcacatgcacagtgcacactagaatgctatttaattctgaggggaattgggtgacccttgactccctcctccctctgacttgttaattttcattttctagatctcatggactttttcataaagcttacgttttatattttacaatttgtattgaagcataatgtgcagagtgaaaagcaccaatcttgggagttcagccaggtatgttttggcgaatgtgttcacctgtgtgacgccggtccccattgtgacatggagcattcccatccagccccagactacaccttccccttccctgcctcctctcatgatctgctgcactgcattccctacacagcagacagagcaggagtcatgcctttcttctaaggaacatcctccagtgacttcattgcactgagaagcccctcctggcccttgcaggccgctgtgctctgggccctactacagctctgactggtcctgcagcccccaatccctggccttcttcgtggctccgagcacaaaccccgtcttagcacctcagggcctttgcatttgctcccctgcctccatttctggaattctgcccctgagatctgcacgaattgagccctttcatcatctgggtctcaggtcaggaacgctaaccaagactctgcccttgaccaaactttagtcaggctcctctgagccatcttttcaagtaggtcctgtctgtctttggtctgtccagccccatcttagcaaagaatcctgctaggtcacccctcgactttctaggccatccccccacttgctaggccaccccctcacttgctaggccacccccccacttgctaggtcacgtctccccttgccagttcaccccccacttactgggtcacccccatttgctaggtcaccccctcactcactaggtcacccccacttgctaggtcacccccccacttactaggtcacccccacttactaggtcaccctccacttgctaggtcaccccgtcacttgctaggccaccccccttactaggtcaagtcaccccccccgcttgctaggtcaccccccatttgctaggtcaccccctcactcactaggtcacccccacttgctaggtcacccccccacccttcctatctgactgtgttatttattccccacctttgatgtctaagtctctgaccaccgttatgaagaatcctgttaggtcccatagtcaagttttgagacagctgccacaaggttatggaggaggaaatgaagcctccattttcgtgctgggtttgtcaagtccattcaggtagaaagtggcaaagtcaggcttggaaatgggttttgtgactccatgtttctcctcgttcagacctgccttggagaacctttccctccacgtcttctgtctgtgttttagagaactggaaaataggccactttaacatggtctctcctacaaagaggtaagaagacccagcagaagggcagaagaactgggagtctggccagacctctggatgaatgtcagggttgttgttatacccaggactgttgtcaccctcttgtctctggacatagtgacaagggacaaggcaaagagagagggcctgtgttcttgtggacatgtggttggcaaggttctggccagagtcggaagggccaggaccccacgttccttcctcctatgtttgtatcccattcaaaccaagattaaaattctaagccctccagccaactgaatggacgcctcctctcagcccaaggcattctagtgttaacctcaaacactggttcaggccatgatgggacgtggggatcaggaatacctcatgatatcctcctcccattggaattcaggcacagctggccagcattaacattaaaacagagtgcctaaggccacgtgcggtggctcatgcctgtaatcccagcactttgggaggccgaggtgggcggatcacttgaggtcaggagttcgagaccagcctggtcaacatagtgaaaccctgtctctactaaaaatacaaaaattacttggcgtggtggtggatacctgtaatcccagctacttgggaggctgaggcaggagaatcacttgaacccaggaggtagaggtttcagtgagccaagattgtgccactgcactgcagcctgggcaacagagcgagactccatctcagaaagcaaaaaacaaaaaaacaaaaaacccaaatcctctcttctctcaacatcctctctaccacttctctggtctacatagaaaactctttcgaagagctagtgttctgagatacgacttgggtttttgtttttgcatctgaagaatcctgaattatcaaacaccagaaaagcacaaacacaaaagaacttgctgaaaggactttatttgagatgaggaaacaaagttgatggcaatgtataggacacacgacagtttccttctaggtcataaagtaaattatgaatatatttctctctgttctcatccctcagaggcagcagaatctgtggttaatacccatgacagtgcaggtcccataggaatattctgttgaataacaggaccttctgcaatggcaagtgaaagcccttgttgagcctggggacagagagagagagcatcagaaattgagcaccagggtcagcagcgggcagtaaagagaatcttcaggaagttgcatgcttgctgacatgtaatgctggctgcattacagccaatagcatgatcacaccatcaataggaataaatacgcagagcagtgttggtcacacacaggattagagagccattctgatatgctgtacttatctgctccttccctgtcacacacacatctgaatgcacccatatgactgtctccagtttgcaacggttcctataaaagtcagattaaaaaacattcctttagcagctggatgtggtggcttacgcctgtaatcccagcactttgggaggccaaggtgggtttatcacaaggtcaggagttcaagactagcctggccaagatggtgaaaccccgtctctactgaaaaaaaaaaaaatacaaaatttagccaggcttggtgtctggtgcctgtaatcctagtgacttgggaggctgagggagagaattgcgtgaacccaggaggcagaggttgcagtgatctgagatagtgccactgcactccagcctgggtgacagagcgagactccatcaaacaaaacaaaacaaaacaaagcaaaacaaaacattcctttaaaattaggctctcttccttgaagtagagactcctcaatacatttctacatggcaaaaaattagaaaatttcatagacttatcatagaattaaaaaatctttagagaaaagtcatgccttgaatatcactgattcttccttttcagtacaaacataaagtaattgaggcctggggaggtgatcacctaagagaaagagccagctgttggatctaattctagaagtgcttggttttcctctctacactcctagctctgcaatgctggtgtctcttacccaaagctctaagacttgagcttgcatcctctgcaaaggagacggcaaagtcctggtcatttgccccacgctgctcctgggcatcagcctcataagcttttgcctgcagtggatcatcctcagcttggagtggctcagccttggcctggagggccacgaggagaacagcagtgaggatggtgagggttctcatggctagggtcgctggaggagagagagcaggagcagatgtgtggggagtgaggagccagcctggatttataggtctgctgggagaaggctcagggacagatgttgcggtgagacggggagtgcatgtgattggggagcagaagagctacccttgccctccatgtccctttgatgctcctttgttctccaagcttcattgtagtgtgaggctgtttattgagtgtctgttctggtcccagctgatagtgatgataagaacagtgttacattgtcctgttttccatctgctggaatatttacttgttaatattcaaaaaagaaaagaacagtgctttcaatgaataatttcaggaatcaaatgcctcttattttctgaaggtggggctggccactctctggaggtctagaccttgaggccagagctggatcccgctagagtagagagttaattcattgcaggattcagggggcatttctgccctcatgaaggaggctttgagattatggggtgaataggctcttgtggggcacagtgtggagaagataatgaccttatcagcctataagggaaaagaactcagtgggatactaggtaaagagttagtaaaactaaagccaaaagatttatttcaagaaacccatgtgatctgaatgtatcaactaaaatatgtactaggtatttctctccactttgagaaacatcgaaacaattgacatgcccacaatccccctctgaaattttattttatttttaattttagaaaatgttgaattgcccacaaggaccattcaaagggtaaaaggagtaatgagcctccatccttgccccagccctgcagctctgctccaggaaatctccacttaaaaattaaacattggtttgtgctttgttttttctccctaatgctgtaatttgaatactttgtagctcaaaacatatagaactctaccattattttcatagtctcttgtttctggtcttctattcaggtattttatccattttgagttaagttttgtatatgccaaaagagaagggtccagttttattgttttgcatatggaaatagtattcccaccaccatttattgaagagactctcctgtccctattgtgtcttcttcatgccattgtcaaaagttacttgaccatatgtgtttcgatgtgtttctggactctcaattttatttcactggtatgtgtctggttttatgccaataccatattgttttgattaccgtagctttgtaatataatttaaaaccaggaattgtgatgtcttcaactttgtttttttttctcagaattgttttgtctatttgggttctttcaccatttcatacaaattttaggatttttttttttatttctgtaaagaatgccatggggattttgataggaattgtgctgaatcggtatattgttttgtttgggatagacattttaacaatcttaattcttccaattttcagcccaggatatctttccatttatttttacattctttaatttctttcactatttttttttttttcattttcagtgtgtagatccttcacctccttgtttcttcctaggtgttttattttttgatgctattgtacatggaattgttttcttgatttttgtttcagttttgttagggaatctatgggcatttaaaaatgcatttgttctgtatttatttgaattttgccttcatttacccagcaggagatgaccatttaactaacatctaaatttcgaattaaactttccctctccaacccaaactgtaattgtccattgtgacttatagctgtctatgcctctttccccagtagttcatgggacaggcaataattactctatcacctggaaatcctaccctggagctgttactcagataccctgatctagctaacaggacaagatacttctgtaaataagtgatctaatttgtcttgacttaaaggagcattttggaattgtatgctctatctttggaaactaagaagtgttcccagcctattttaattgaaatagaagataatgcagaccaatccccatgggcattggtaaatgtttagacagatggggtgcaggaaggcttatcaggatccatatcgcagcttgtaaagtcaccacaatcaccacgccaacagacggaacgcctggaagtaaacagaacttctagaacagtagaacatcaaagggtgtcagggacaagggaacttcacgtagttcctttccctctctctacttaccttcctgcccctagagtcacatacatgcaaatactgaagcacaagctctattttgaagagcccatttactctaggatccagctttcaatgatcatgcacaaaatcgaggcaggtatatctcccccttgtttagccatcaggctcctgcaagagaagtaacctccctaccgtgacccgcagtcacgaggacctcatctctgttaactgcctttcttgagttaaccccaccccactcccacatggaagccctaataagaaccgagcatcttggagatgccaccgagatgaagttgacttaggccaagggctgtctctgttgtcctcagtggctccagcatacctccaccctgagatgtcctcacacatcagacgctgacctagcagagcccacactatcttccagtaaagaagaacctgcccttacagagaactgggcgcgcagcactgcagtagcaccttaaggacagcaggtggccctcctgcccttaaacaggagttgacccaagagggacttcaaatgggagcgctgtaaagtgctgttcagcaaacacattgctttcttctgcaccccaaagtgtacatattacaacattagttcagggggcacagaatacactgctgctggttccgtgtcagcggtagctgctggccctggaaggctggcctgccccgtctctaacctagtgtcatgatgtcgttcccccttgtgctggctgcggggctgaggacctgagtctgggggcctctgctctttctcctgggtggcaatgctcctgtccctgcctccttcccagtctgtggtggggactcgacagccagggcaggtcaggttctcagtctgtgctgaggtctcacctgggccttgcctctgtctcccccaggtggctcccaaaccccaattagaacagagtgagtctgtatctcgtggtccctttcacctttctttctgggctgcaccagaaccttggcagaaatcagtggtttaagcaaaaaatggtgctacatgtaaaagtctttgcaacactttcacttccacccccacccaccctgcccccagcacagtgtcctggacttgccaccagtgtcaactctgagtgtagacacaactgaaactgttccttcatacacatgcagttcagctttcagacactcaacaagagccttgacaccctcaagctggggtaaatatcctggggaagctacaggtgggggtgcaggtgtgggtgtgagaggagaaaggccttcagcagcagcaaggatattcccacactctctgaggctgtctggtgaccccagcagacacagtgagtgtggaccttgggcagggccctgggacatggttttgacccagtgtggaagggcagttttggaacagagtgtgtgtgttagcgtggggtagagcgggggctgcgtgggggtgagctctgagaactgtccatctcccagcccctgagagtgcaccgccctgtccctcccctcagccttttgtccacctccctgcagggagggtcctggtgctgcctgtgccacacagcaactcccgggcctgcagatccagctgggacaggcaggagctccaagtcccctgccctttgtctgcctttcccagccgcctctcacatgctgtctatgtgtctggtgttgttgcctgcagcaatttttacaaatgactatgaaagaataactctcttgggctgttttaaaatgtggtcccaattcttggactcttctcccacagaaagggaggtttacttctttcctgttggatctaggtcgggtgacatcttcaccaatagaatgcacctgacttagtaccatgccgtttgctgggcccaggtgctaagacactggtatttttcactttcaccgtcttggatggcgctgcagttggaatatttttgtccctctgaaattcatatattgaaatattaaaccaccaggtgatagcattaacaggtggtgcctctggggaggtgagtaggtccggagggcacctcatgaataggattagtgtccttatagaagagatcccaaggagctccttcattccttccatcaggtgaggacacagtgaggaggtgccatctatgaacgaaaaagctggttctcagcagacaccaaatctgctgccaccttgatttggacttctcaacctctagaacactgaaaaatatatctgttgttcataagcaactcagtttatggtatttttttttaaatagtggctcaaacggactaagagggctggtcacttgggggcccagacaccgtgttttgaggaagcctcagcctcgcacaggaagatgaactgagggcacctgcgagggtgagctagagaacacagaacagccagctttctgggaaaaaccaaaactctgatttacagtgtttgtaaatttctgtggttagaatcctcccagctctggaccgtttaaaaaatgtcacacaaaccacctttctcatgagccggcatgatctggccccagcgcatcacaaggtcccatccctcagccctgtgagagctcccagctgagccagcactgcctgccacctgtgcgcgagtgtctcagccctgagctcctcagatcccagcagaacctctcctctgagccaggcccaaattgccaaggtatgagtgaagacctgatggtgctgtttcagtccactatgtttgggatatctttccacacagcagtagatgaacagagggcattgtcacagtcttggcgagaagttggacttgtgcatttctgcgtgtgtaaacttctgcttctccaaaatattggcgaagtaggactgaatcctcttaccttattcccaaagtgtcacaaagagcccatgatggtgggagcatgagattgtggactgtttggagtgaccgaagaaccctctcacccattcctagtttaaattcttcccgctgggagcaggggtggtgtgggagccaggtggggtctcaacctctgccctcagtaacagactcagaagaggccataggactcaggagttggctgaaacaacagggaaagaagtagggattttctctaggagattagctgcgaagggcacagagagatgaccatgaatgacatggctgtcacctggggagagatcccaaagtaagatcaagagaaacaaaggggaaaaaaggtaaagacgacaaagtaactcatgctttgagtccttggaccaagcatttcctaaagccagaattccttggtatgggagtgaaaatgttgactcagggctggacaaggtagctcagcttgtaatcctagcactttgggaggctgaggaggaagaattgcttaaggccaggagtttgagaccagcttgagcaacatagcaagccccctgcctcttaaaaaaaaatggtgactcagcttgacctgatttctaatgttttactccaagactccactaagatgcctgaaaaagatcaaaaataccaaactcggagagcctgaggcaaagacagtgccgtgcacaaggacaggagatgagagcagatgacaagtgtcccaatgcagcttgagggcagatgacaggtgtcccaagagcagcttgggtatcaggctccctggtgattcccatgcacagcccccgggagaacagccttattgatgctgatcagcagggaaggagggacggctacattagaggctggaaggacagcgggtgagtcagggatggggagcttcatagttgatgttcagaaatggaggaattccaggtggtggcaggagctagtgggtggccatgggttggagggctgggacaaagagggagtggggtcactgtcatccaggcggacaaagcactgagaggctgggagggtgaccggccaggtaacattacagtgaaagaccgtttcccgtaatcttaagtttctgagtgagttgagtggctttgagcagcaaaagggaaaaatacataggtttagaaaagagaataggtagttgtctgatgtcttccattctggttctgcttgtaagaagagttcaagttctcaaacagagaaacagaagagaaaaaaatggctgtcttttattaaaaaaaaatcagaaggcttttaagaaatgtcaaggaagtatttattgaacactgttgaaataagagtcaaaacgctgcaatagggtgagccgttgaactcaactgtcctgaagcccaaggcaggaatatgtaggccctgggttaagctagtggaaaagttctggtggttgttggtggggaagttgagcagtgtgattgggcaatctttgtttgctaatttattaggagataggctcctgtcttcccacagagacaaggctgctatccccttgagtaattacatttatagggatgaggcatctgacttactctttattgttctaccactcaagtgattcaaggtagaaaatgtcttgtatgtcatcagtaaacatagagtgcatccacatgaacgtttctgggtctcacttgaggctgagcaacttgccctggttgtttggagaccctcacacctctccctgcattctctgtccccagagtttgcagctgtcatagcccaccctagactgcagtagcagaagccacatgtggtgctcccagtgtgtctatccacacagaggagcagggaggctccttcctcgtctggccctttcctttggattgatggatgcttctcagcacatcaacctgaattctactccatccttctgtgttgcaacagcaattcctcttaattcaatggaggttgacctcctcctgcatagctcttgccctgattctacattctctacctaattttctgctttaatcattcttttattctattgaaagtttaaacatctttatgtttcagtttaagattcaccatgaaatctatccttggcattccatgacagaatggtcttttcctacttccaaaagtcctaatgcttcattaaaccacattttacccatcatagtctcctatattttagtctttttaattagttttaattagtcttttttaaggaatgttgtcacatggactagacacacgggctgctttacctctgtaggcttcagtatttttttcgtaaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggaaggccacctgcctctgattgtgggggttgctggtgtttaagctttagtgccatgggtcccattcaatatctaaggatcgggtttcctggcttggatccagtcaggtggcatttggggttttgcccctctagcacattgcctcaacatgccacagttttccagcctggggttcaattttgtgtcaatataaattttgagtacaattaattaatttagttgaaattaatttattgatcatgtgcaacgtattaggtggtcatctatgcactgtggtaagatgatgaggaaaacatgcagcttccctcccagtgttgggagacaaatgttccagagagtaaatgaaatgcacagatgtgagatagcttacaattctacagttaaaaataaagagaagagggggatagaggtcaccagggggaactagttgcaatttgaaattaagaaatcagcaaagtcctcagtgacaaagggaagttctagcagagaccccaggatctagggcgcaagccaggtggacttctgggaagtgcagaaaccgcgtgatggagtcagccggactcagtggacggttaggagcaatatgcagagttacagcaagaaccgcgtgacttcaagtcagtggcggttacaggaacccaaggaagactgtccccctttcacatcctgaaacccaaaatgtcaccttcaccttcaatacaaggggaagaccttggaccatttctttgtcaatcacagacccactgtgtcttccctgggacctgtattgggttccccagctgtgaagtgtctcagtggggtgcctggacccctgagctgcctcttcagacaggcagagcctcagtctggggctgagacctgctcagaatctgcatgggtagatgtggagaacacctgcttccttctcctgggctctgggcattgtgggtggttggtgttggtggtcacagctgtgtcttggcccatcagattgttttggtcaagaatggggaataatcctactagaatcactgtccctttatttgcaaactgtagtttctctgtcactcttggaagttgtgggggcattctatgaatgaccctccagataagaggagccatggcttgaacagagaaggtatttttccaagcatgtgtagtggattcataaactggaactgctagatccaaaatataagaaatctgtgggccaagctggacttgtccctggagctttgtgatcatgtcctcataggccgttgacaagacatcctcaactattgttaaaggtacagtgggtttctagggtagggacagagaggagagacaggaagagaggtcacatcacaccccagcaagatgtcagcctggccctcagggacacccgggttaggcagtgaccctgttctcttggaggggaggaggaagacaagctcaggaaggtacagaccccacgtgtgctgtgcctgatggggaggctgcagttgaaggtaggacagcaggggacgctgtggcctttccgggaaatgctctgagcatctcagagagcgctcctggttcattccctttccctagacctggtttcttgctcactcactgatgtgcaggatgttgtggttatcagagccgcagcctgcagcaacaacaggaatgtaaggtttctggtgaagctgtattttcccagcagaatcaggttctcagcagctttaaggcaacccaagagagtgcgcgttgcaaagtgtagtggagcatttgtgtgtgtgcgttttctgggtgtgaagacgactttatgggtgtgaaatccaggtcttcatagacgtggctgaagggtgctcttaatgaggacatcccattgtgggctgctgtgttttgtgttccatgcaccccgcctttgctaacaacccatttccctcttaattaaagttgtttcagtggatctcctataaccctatgtcttaaaaggcaaatgtgtgacctggacatgttcaataaaactccaatattttgacgcagaggatggtggtttttcccgagaagtagtgaggttgtgagtagctaaactggaagctgacgttgattcttttgcctagtatatgagagttgtctttgagagtgaatccattcaaaatgaggcagaatgaaaagacagagcagtggatggtgagatcagtggcatcatttgtgccttcgtttcagtttgtgtctgaagccatggctcctccttaaaaattctagattttgaaactttaatttgttccaaaatattcatgtaggattctggcagttgctttctagtgtcttgacacagacacatatcaaattttaaagaggtgtaaacaaagacatcttgttacgagatatatatttaggatcaagaaagatgttaaggacaaagtataggagaaacaaccatttcctgtagctctcaaagcaaattatgagctcatttttctctattctgcaagctcagctgcagaagcatgtgaagctaacaccaccgatgatggcgttcccagcatgacattctcttggacagcagaacgttaatcgacacgcgtgcagcagtatgtgaaactcacaccaccaatgaggcagttcccaacacgaagttctgttcgccggcagaatactaatctgcaagagcagaccatgccccttgttgagcctgggaacacagaggaagcatgagaaattaagcaccaaggtcagcggtgggtggtaaagggaatcttggagaagtcacatgctggctgaccggtgatgctggctgcattagtgccggtagcacaaacaaccttagtcaataggaataaatacacagagcaatgctgctcatacaggatttgagactcattctcttttgctctgatttgtgtgcttttgccccatcagacacacacctgaacatactcttaagcccatctccagtttttaaaatttcctttgttggcagaatgaaatattttccctataatatctacttgtttagatccagaaagaactggtcaatctgtctctccgtatcttaaccctagcgaattttatagacataccttggaatcaagtctttggagaaagaagactacttacatttgtttgtctctctattcagtttggagataagaaaatcgaggcccagagatggtaagtaaagccacctaagtgacatccaccattgagatgtgattccagagcccatctcccatccgtctctctagactcggtagcttttttatgctggcctctctcacctgaaacctgaagagcagagcttttatcccatgcaaaggaaatagatatgtcctggtcttctggcccacgctgctcctggcctggagcctcatcacctcttgcctggagtgggcctgcccggacctggagggctaccaagagaatagcagcgaggagggcgataatcctcatggctggggtgacctggaggagggagagcaggagcagctgtgtggggagggagaagccagcttggatttatagctttgctgggagaaggcacagagataagaaacctttggccttctgagtgagaggaggtgtgcattttgttagagaggatgccgactcctattggccttgacatccctggaatgctcctctgctctcccagctttcttcacaggaagctctatgtttagtgtctgtgctaggttgaagttgatggtgatgatgaggaccctggcattttttcctgttttcaggaaatacctaatatttcctggttaaatctttaatattctaaaaagaatggaaacagtgctttcattcaataatttaagagagcaaatgcctcttatttcctgataatgggccctactattctcttcaggtctaaacactggtgccagacctgtattccggtggagtagagagtaactcattgcaggcttctaggtcattataccctcatgaaggggcgactgaggtaatggggtgagtagtctcctgtaggggccagagtgaagaggacaatgaccttatcagggtacaggtgaaatgagctcagtgagagagataaagagttgtgtaaggttcatgagttgctaggtgcatacacgtggtcctttctctcacagcatgtaaaaaatcagctcaacatggattgaagactcaacatagacttgaaaagacctgaaaccatacaactacgagaagcacatacaaagataaagctttggacattgacgtgagtaatgatttcttggctatgacaccaaaggcacaggcaataaacaaatgggaaaatagacaagcggggctgcattgaacgctaaagcatcttcatagcaaaggaaacaatcaactgagggaaacggcaacccagaaaatgagagaaaatgtttgcaaagcctacgtggtagaaggggtaaatatctgaatacataaggaagtcaaacaactcaatagcaaaaaacaaacaacctgattgaaaaacagacctaggacctgcagaggcttctctcacaataaaataatgttttaagaagctgtgatcgtctttattggacatgtcaagtaggacacgtgtgtttggaaggaaactttttgagtttctctattgacttagctagtagccattacccccagcagccgccagacacccagatagaagttcacagcaggggcttcacccgctgggtccctctggggtggccccacagtgagaggtcagactggggacacagcttcaatattgaaacctcaatgtgaaagtttaagttttgtgttacttacagatcctcaagctaggcagggcgagcagagagggcagacagcagtcctgtgttccaggtcttatgtagcaagagcagccatgcacacagaggagaggacttccttatttaagggtcttttggtatcaggtgtcctaatttttcagggttactttctattgggtactttaaataactgttaacaagggcagttgagaaatttggcagaaagctggagttcaagcaggagtccacggaggtaccgacccctcgtctactttggtcagccctggccaggcccaggcagcaatcaactatggattcctcatgactcctaagacaattgaccccatgatacctatgctggtggctgaggctgaactacctggaccgagggaatatttaaagccaccaggagagcctggcctgcatattgttgtatacaccttgcgaggagactaggatcaaaatgccacccacacacagatgaggatttggaatgtggtctgaactgacctccccaggccctggggtctaaccataaaaacaaatccaagccattcagacaagtaaggttggagaatacctggatgagactgaataccgcctgggcttgtgttgctggatagggcaggttgcaggctcccgagtaaaggatgtgcatatagcatgtggttccctagaggggacagtcacctttttgcttggccttagatagttcaagcctaaatgactgtctaggtcatccaggccaaggactcatcaaatgattgcgtgacacctaatgtctgtcagaagtcccttaggatggtggccaaagctgcagcgagattggtgttagcttgcatcaccttgtgttgtgagctcaaataccctgttcccaaaccaatcccgtaggcttacgagtctccctacacccagagttaggaagatggtcactgggtgggggggatgcataagctttcccttgtgtggtccctcctgggttatttgaaggggagtcccagggagactagtgcacattttaaaatgtaccactctccaccatcctcctccttgtagtgaggtaaacgggatgaggtttctggaaatgagaaaagaatgcagttgttcctgagggaatgaatacctatagtgaggttgctgaacccagtatgcagtccaggcagcccctgccgccatgggagggccgtgcacagcgctggtccagcaggctgggtgctcagggcctcccctgcagctctgcgtgaaggcagcaggcactgggctatggaggactgggggcagcggcgctctcagtcttaaggagggaagaggcatctcaagcctcgctaggggtggtcgctgttccagagcagtgaagtcggctgcccctatgaggaagcagtgagttcctgatctgttgcaggcccagcaatttcacctttggaggaagtgggcactggactcattccagcagaggaagaaattagggctatttggggaactgggccccagatgatggttttaggttctagggcattagtaggtgcctgaagggcccagtggatatggatgtagaggcaaaatgagaaggggtgtgtgtgcacgtggggaaggtctggtggttgtggggatgtccagtgtcctgcagaagtgaaacctggaccagcctcctgcacacagaacacactccaatccataggcattttcctagtaacataggagagagctgttattggcagagctggttagatttgggtgtgatattataacagacaggtcttccaagtccatattttttggcataacttgtagggcagcctcctgatctgatccaagccttgtggtttccttgcagtaggcggtttaactaatgggttacactgaagacaaatggggatcccagcaaaataccattctaaggggtcatctgcagggtcctcaggaaagcatgagctaagaaagcacgggtccaggtactggacgtgagccaactccatgtcccgggggtggtgagatccataccttgcggcaggaaggagagtaaggtgagtctggtttggggatgaccccacagtcaagatgagattccttggtgtctctggttctggtgaggccactgtttcccaggacaaacccttggatcagagcactgtcttctgaggtgatggcctttcgggtaggggtggcctttccagctggtcactcaagaagagagagggtatgggctggtgttgcacaggcctctggcctctgtgggactccatggaagcgtttagtgaaagcttgagtggtgctttccttggtcgggggataggacatttccatccacaactcacatactttggagcacagaagtatccctaagcccatgaacgtgtttgaatgctttctctgcatgtgaggctccaacctttccggccacagactgagtttgtgctgaggcatcattagctggtttgtattcatgcctggtcatggggagggccacctgcctctgattgtgggggttgctggtgtttaagctttagtgccatgggtcccattcaatatctaaggatcgggtttcctggcttggatccaggtcaggtggcatttggggttttgcccctctagcacattgcctcaacatgccacagttttccagcctggggttcaatttctcacagtggctgtcctgttccagcagctctctgggatgccaggccccaggcctaagagcagccgtacaacatttacatacataagatacccagcaaggccaaagatagagagcactgacagcttataactcagggatttcctcaaggtacttttacgtcgatattgattatggggtgggctttcaccaacatttcttcagagcatttttctgcaatcgacacaggacatggtgatggtagttccatgtggtctttgtctgatgtagttggcgtcctctagtttgatggctttttctcctcatttagtgacccagactgtaccctctttgggctgcagagaaacaatccccacttccttcagggaggagtgagtgggagatattagctacctttcaaagcaggaagaactggagcttctgctggaggctgtatgtcaagaggtgaggtctggtgtagcagaagcatcttagggctgctctgtggcagctgcctggaccatcagtccccagaggatcacagctcactatctgtattagtccattttcatgctgctcataaagacctacccgagactgggtgatttatgcaggaaagagatttcatggactcacagttccacatggctggggaggcctcacaatcatggtagaagacaaaaggagcaagtcaagtcttacgtgggtggcagcaggcaaagagagagcttctgcagggaaactccctatataaaaccatcagatcttgtgaaacttattcactaccatgagaacagcatgggaaagacctgcctccatgattcaattacctcccaccaggtccctccaacacataggaattcaagatgacatttgggtgggaacacagccaaaccctatcactgtccatcctcgatcgagtctttagtaaatgtttgatgctgagacagtggacatcttgtgatggtatgagggggtctcattattgcagaaaatgtgggtgatggtatccataagggaaaaagagctcaactcttctgtgatcaccagggtgggtgccatggttggtctggtccaattgtagaagagctggtggccatggtgttgagaattaagatagttaaggctctcaaaggagcttggttcccttgatgaaccacttgtagggggactggagcctttcctaatttgacttagtctgtgctcatgccacaactttaataagcatgactttaggaggccactgtgttgcttgaggaggccagtggctaagtgagggtcccctaacccccatgctgagttgcccagcaccaccctgaagtgggagccctgatctgcatcagtgatatctggtggttcacaagaggtaatagagcaaatgtcacagaaagagagcacctttctctaccaagagccttgggttggaagagtcaatggaagtgcggtggatgtgtgtctgctcctgcacagcagaaggtggtggctgtgatgggagaggcccagtgaagtccatttgccaccagctgaaagggtgatggcccaggaacaagggattgctggccacagttttgcttgcctgaagctatggtgggagacagctgtggtgtgggttgccctctaatgtggctgtagctctcatgatctggggctgtaggactccactctgtcagcacctgaggaatacagaacttgagattctggagtctgtaaaaataagaggatctcacccaagccctgggaggtgcatctgaccgctaacctcctggggacaggacatcaggggctgtcagcaggctcagtctggaggccaaagatggcagtcgtctcactgtggatgcctcacccttcgagtggtggaaagtagcctgggcatgtttgttctgaatgcatgaggcatgaatcacctataggaggactggagtgtcccctaatttgacccaaacaggtccacgccacagaggccattccagaggcattggatccagggcactcacaatatgttgggcacagcccaggaatctgtaaaaactgtccccgagtgggggttatggccacagcaacctcccctgcaaccggcaccaccagctgtatggctgggctcagcataccctcccctcctatgcaggccctgctgtgataaatgtgggaggtggttgccggccagtgggctcccggcctgcagggcagtgctgccttccctgaggtatgtggactccccatgtccaactcttcccatggcctcatcaggtcaccaattgttcgggcaatagggtcgctgctgctatttctctctgcttgtaggcaggagctgaataacagggaaaccatggcctcagcttcctgtcacttgaaaggacttaagtgccaggtttgccttgtcctacaagtgctgttcccattttcccagggagacatgaatggctgagcctctgtcaggaggagtcagacatggggcatggctggagtctggggacacagcagcaccggaacctgtcctgtagtgcctatgtctatacgggcattgtgtgtagtggtagccagctttttaacgggggataatgagctgcagctgccaggaagtttatgcctgcagaagcccatagccaggatggacgtgctttctccagaggctctgggagtcatgattggtggtactgagggcctctatatgaaactcagaacccgggacctgggcatggcctgagagaccacctgctgagccagctgcatgctgtatcctgctgtggccccagttaagacatggagggcttctgggtgacagtgtctgtgggcctctgcagaatggacaagtgaggtgtaggtgcaggcggaatgtcccagtatgcgcagggcctgccacaaagtggctggcaccctaatggtgaagactttggttttaactgcaaggtgaatttggtggcccactgaggaccaggttatctctagaatctttacagcagtgcggggcctgaactttgtgtgggttgtggcccagccatggtcttggaggaagccactaaaatgaccagcatggttttcacttccttcttctaggggcttctgaggaaaatgctatcaatgtaatgccacaaggtacaggggttcacactgaatcacaggaagtcccgggggcacgagttatgggcagtagctggcttactgagacagcctgagtgcaatttggtaaatgtgcactgggtcccttccaaagtcaaagcaaacacagactgcgacccgtctgtgatgggaatgggcagaatgcattggccaagtctcctgctgtgaaatgttgtgccctgggcctttgtatgccctctgttaacttgactgtatctggaatcagggccttaatggtcctggaggacaatctggtggctgctctacttggattccagcgccacagagtggcaagcactgtttccgtcttatattttagtggaggagacaaacaataggcaaagttatgatgggtatgatacactatgcagccagtggttattatacagaataaaaggataacattgaggtgacctggagtgcccaggtgacacggtgttgggggcagggtgctgctcaatagtgtcaccatggcagcctcattgtggagagaacatcagagcagaggccaggaggggctgggtgagtgctgcagaaacctggatgggtccaggaaaagggagagcaggtgtagcagccctgcagcaggagtgtggcctggcccatgtggtggcctcaccagcagcacccggagtggtttcaggaggtcaaagagaacacatgccctgcaggttgctcgagtcagtggtggctgctggtgctgccttttccatccccaacccattgtcctgaggtcattccctcccatgcatggctggaggggtggtaactgtaggctggggggcgctactctgtggcaggggcggactcagcagcccagggcccgtcaggttctcagtctgtgctgaggttgcacctgtgctttacctccttctcgcccacgtgactctcaaactccaacccaaattagaagagagggattcatctcttgtggtctctttcacttttctttctgggctgcaccagaaccttggcagaactctaaggtttaagcaaaaaacaaaaaaagctgttttgtctaaaaatctttgcaacactttcgcttccgtgtccatccatgatctccccagcctgagtttcccattcttttcaccagtatcgactcccaggcacagtagacgtggctgaaactcttctctcatccacatcgtcttgaatttccagggaatatttaaacgagtctggacacttaataagagcctcgacaccatcagcctggacaccgtcagaaccttgacaccacgttctggtgaagctgtgggtgggggtgcaggtgtgggtgtgagaggagagagaactccaggagcagcaaggatattcccacacatgctgagggtgtccaggggccccagcagacccagggtgtgtggaccttgcgcggggttctggtacgtgatttcgtcctggtagggaagggcagtcgtggaacccagtgtgcacgttagcatggggcagggtgggggctgtgtgggggtgagctctgaggaccggccacctcccagctcttcagagtgcaccaccctgcccctcccctcagccctttgtccactgtcctgcagggagggtcctggtgctgcctgtgccacacagcaactcctggacctgtagatccagctgggacaggcaggagctccgagtccctgccctttgtccgtctttcccagcacctatcaggctgtctgtgtgtctggtgttgttgcattttacaatatactatgagagaataagtccattgaacagctttaaaaatatgggccctacatcctgcatccgtggctcttcccaaagaaaggaatgtttatctcctctcctcttgaatctagtctgggtgatattttgacaagtaaaataatcctgacttagtgctatgttctcttctgggatcagatactaattaactggtatctttcacttcttcagtatgggatggtgttgtggcctgaatatttttgtccctatgaaatccatatgtttacatcttaaaccccaaggtgatagcatcaagaggtttgggcttttacccagtgatgagatcaggagggcacggtcctcatgaatgggatttgtgcccttgtagaggcgaccccagagcactacgtcattccttccaccaagtgaggacatgtcactgaacacaggtcccgctgctcgccacgtgcagcagtgataactggacggaggtggggtagaaagagagcgactttattaaccaaaactactaagggggaaatggctggattcacatcaaagcaaccacttcaagtttttggggagaagacaagagtttaaaaagggggacttcacatgggaggcatgcaggggttaagctgggcgtgaggtctttgtgtcttgtttcggtggctaccttgggtctctgtccacctggcccatgggctggtgtcctctccacaatggctgcgctgttgactagaggccttgaggtaatctgtggaatattccaagatatagtagtcaaaatgttaacttagctcatcatgctttctgacactcgaattcaagacccaactaagatgactgaaaaacatcacaactaccaaactcagagaacctgatggaaacacggtgcagtgcacaaggacaggagatgagagcagaggacaggtgtgccgggtgcagcctaggcatcaggctcccaggtaaattatttgatgcacatccccgtgggagaacagccttttttttttttttttgacagagtcttgctctgtcgcccaggctaaagtgcaatggtgtgatctcggctcgctgcaacctctgtctccttggttcaagccattcttgtacctcagcctcccaagtagctgggagtacaggctcctgccaccatgcctggataatttttgcatatatatatatatatatatatatatatatatatatatatatatatatatatatatgtatatttagtagagatgaggttttaccattttggccagtcttgtcttgaactcttgacctcaggtgatccacccgccttggcctcccaaagtgctgggattacaggcatgagccattgtgcccagccgagaacagccttattgatgcttatcagcagtgagggagggacagctacatgagaggctggaagtacagttgatgagatcagggttggggagcttcttggttgatgttcagagctagaggaattccaggtgctggcaggaattagtgggtgtccagtgggtgaaacaaagattattggaaaaaagattgttgagggtcactgtcattcaaaggtaaaaatagtgagagattgggagggtgacctgccaggtaatagcagagtgaactctttttccaggattcttaatgagttatttggctttcagcagcaaagaaaaaaaatacacatattcagaaaagggaacaaatcattttcccatccattacattctgctttttcttgtaagcagagttcagaaaaatcaaacagagaaacagaaaaaatagcctatgtcttttattgtaaaatacaatttcacccatacgtttcagaaatgcaaggaagcatttattgaagactgttgcaaaaaagtcaaaatgttgcaatagggaaaacggttgtcctacactctcctaaagccaaaggcagaagaatgtaagccctgctcggagttagggggatagttctggaggtcgttaggagggaagttgaccggtgtgattgggccatctgtgttggctaatttgtgcttattggagttaggcttttatcctcctacagagacatggctgctctacccttgcataattacatttatagggatgaggcatctgacttactcttttgttgtcctaccatacgagtggctcaaggtagaaaatctcttatacatcatcagtgaacctagactctatctgcatcccggggaacagttctggatctcatccaaggctgagcgagttgctcaggttgtttggagaccctcacatctctccctgcattctctgtccctagagtttgcagctgtcattgctcaccatagactgcagtagcagaagccacatgtggtgctcccagtgtgcctttatccacacagaggagcagggaggctctgtcctcatctgcccctttcccttggattgatggatgcttctaagcaaataggcccgaattctactccatccttctctgttgcaacagtaatttctctcatttcagtggagattgacctcctcttgcatatctcttgccctgatgctattctctccattgaacatgctgctctactcctttgttaagtgtctccaggttttaaatatctttatgcttaaccatacaattttttactgccactgcaagccaaaataatctcttttttcttctaaagtcctaatgcttcattaagccacatattgcccaagatatttttctgtatttctgcctttaatgttttgaatttgattcttaaaggtatgctattacaggaactagaaacaaggacagtcttaactgtgtagttttcaggtttattcgacagttttgtaataacaatgtgattttgtaatgatacgtgatgttagagattattaattagtttattcataatgaatgtattgatcccctatgatgtgttaggcaatcatctatgcactgtggtacgatgagccaaacatgcagtttcccttctagcataagaaggcaaatgttacagagagtcagtgaagtgtacagaaggtgagatggttataattctagagttagcaataaagagaaccagtgggatagaggtcaccagggggaacttgttgcaatttaaaattgagaaattgaggaagaacacagtgacaaagtgaaatttcagctgagaccccagagctggggagcaagccatgcagaatttttggtgaagtgcagatgccctgagatggagtcagcctggcccacatgacagtttaggagcacatacagagttagttcatgaccagaggactttgaatcagcggtagtgaaccagaaaccaaagaagggtgcacagccttcacaccctgaatcctattgggtccatcaccgtcactgtctaaacaacggggagagctgggaccattgtgtctatcagacccactgtgtcctccctgggatctgtattgggttccccagctgtgcagcatctcagtggggtgtgtggacccctgaactgcctcttcagacaggcagagcctcagtctggggctgacagctgcttagaatctgcatggggtggatgtgggcaacacctgctcccttctcctgggctctgggcatttgtggttggtgttggtggtcacagcagtgtctgggccatgagaggtcttagcctggaatggtgaataacccactagagacaccttcctttctttgaagcctgtaatctctgtcccactcaaactccttgcatcatcttaccagtgaccacccgctacgagtagccatggcttgaatatagtttctttttcaaacgtgttttaaattggccaactgcaactaccagatccagagtaaatacgaggggctcatgctggactcctgaaaatggtcatgtcctgaaaggccatttgtaggacatattggacaaggattcaagggtcagtgggaatcaggggagggaaagggaggacagacaggaggaaaggtcatgtcacgccccagcaagatgtcagtctggccctcagggacaccggggttacgcagtgaccctgtcctctcggaggggaggaggaagacaggatcaggaaggcgcagacccctcgtgtgctgtgcctggtggggaggctgcagttggaggcaggacatcagggggcgctgtggccttcccgacaaatgctctgagcatctcagagggctctcctggttcattccctttccccaggcctggtttcttgctcactcactgatgtgcaggatgttttgagtatcagagcctcagtgccctgcaacaacaacagggccgccaagctcctgatgaaatttatttcctctcttctcttttcccctgcgaagctgtattttccaaacagaatcagggtctcagtggctttaaggcaactcaagagagtgcgtgttgcaaagtgcagtggagcatttgtgtgtgtgtgtgttttctgggtgtgaagacaactttgtgggtgtgaaatccaggtcttagtagacgtggctgtagggtgctcttaatgaggatatctcggtgtgggctgctgtgctttctgttccatgcatcccacctttgctaacaacccatttctctcttaatttaagttgtttcagtggatctcctgtaaccctacgtcttaaaaggcaaatgtgtgacctgaagatgttcaataaaactcccattctttagcacagaggatactgattttcctggagaagtaacgattttgtgactgcataaactttaagctgacactgagtgtttgcccagcacacaatggatccgaagaaaatgaggccgagtgaaaagccagaacagtgaacagtgagattggtggtgacactggaccttcatttcaacttaggtttgaagctcaaattcctgcttgaaattcctagaattatgaattatagtttgttcaaaaatttgatttaggtttcacgtacatgtatcccaaatgtgttgacacagacacataccacacgttaaagaggtgtaaacacaaaagtcttgttagaagacatttatttgggatgaggaaaggaaactgaggacagggtataggagtaacagcaattctctgtagctctgaagacaaattatgagctcgtttttctctcttccggaagctcagctgaagcagtatgggtagcgtactccaggagcactgcaagtccctctacggtgttctccaggactgtaggaatctcatctgcaggtgcaggtcaagcccctccttgagcctacagacacagagacagcatccaaaattgagcaccaaggtcagcagtgggtggtaaagggaatcttggagaagtcacatgctgagtgataggtgacgttggctgtattagggccggtagcacaaacagcctcagtcaataggaataaaaacacagtggagtgctggtgtcacaggatttgagactcactctcatttgctttcatttttgtgctccggccccatcacatacacacctgaacacactgttaggcccatcccgagtctttaaaagagattctctatcgacagagaaaaatattctcctaataattaagtctacttgtttagatccagaacgaactagttagtatgtctctctgtattttaaacatagtgaatttcacagacatatcttggaatgaagttttgggagaagaaaatctcttagatttctttggctctctactcaatttatagatgagaaaatcaaggcttagagatgctaagtggagccacctaagtgacatggaccattgagactcgattccagactctgtctcctgtctgtccctctagacactgcagctctgcatgccggcttgtcttacctgaaacctgaagaggagctctttcatcccatgcaaaggaatcaaccacttcctgatcatctgctccaggctgctcctgggctgtagcctcatcagcaattgcctggagtggctccgcccgagcctgcagggccaccaggagaatggcagcaaggagggcaaggctccttatggctggggtcacctggaggagagagagcaggagcggatgtgtggggagggaggagtctgcctagatttatagctgggagaaggctcagagacaaaccttcttgaaccttctcagtgagaggaggtggagattcgttggagagggtgtggatatccattggcttcaatgttcctcctttccttctctgctctcccagctttcattctagcatgcatctctatgttgagtgtcttggctgggttggagctgatggtgatgatgaggaccctgccatgatgatgtgctttcattcagtgaattcagggaataaaggcctcttactttctgaagatgggctctactgttctctggaagtctagacctggacccagtggagtagagaattaattcattgcaggctttgaaggcattaccaccctcatgaaggggtttttgaggttacgcggtgaggaatctgctgtaggggccagggtggagaggacaatgacctcatcaggctacaggtaaaacaagctcagtgacataaagagttgtctaaggctaaaaatgtctatgatttccatctctatttaggtgtgagtgacaaaaattatatatgtgtaatgtatactaccttatgagttgatatatgtatatatttggacctttatcttataccatgtagaaaaatcaagtccaaatgattagaagacctaaacatagacccgaaaccataaaatgatgagaggaacagatgaagataaagctttgacgttgatgtgggtaatgatttcttggctatgacaccaacgacacaggcaataaaggggaaaagacacaagtggagatgcactgaatgctaaaggatctgcacgtcagaaaacaaccaaacaatcaactgagtgaaaaggcaagccagaaaatgagagaaaatatttgcaaaccctacatgatagaaagggtaaatatctgaagacataaggaaatcaaacaactcaatagcaaaaaacaaataatctgattggaaaacagaccaatgacctgaatagacttctctcaaaagaatgttctaaagagctatgatcatgtctactggacatgtcaattaggacacgtgtgtttagaaggaaactgcttgagtttctctgttaacttagctggtagccaatgcccccagcagccaccagaggttcagacagatgttcacagcaggggattcacctgctgggcccctctggggtggcctgggagtcacagttcagattgggggcacagcctcaatgttgaaacctcaatgtgaaagtttaaattttgtgttacttacagatcctcaagctaggcagggtgagcagagagggcagacagcagtcctgtgttccaggtcttatgtagcaagagcatctgtgcacatcccagagaggacttcccctatttaaaggtctttggggatcaggtgtcctaatttccagggttattttctgttgggtacattaaataactctggtgacaaggacagttgaaaaacttggtgtgaagcttgggttcaaacaggcatcgacagagggacccctcacctaccttggtcagccctggccagacccagacagcaaccacctatggattctccatgactcctaagacaattgagcccacaatgcctatgctcgtggctgaggctgaactacctggaccgagggaatatttaaagccaccaggaaaggccagcgtgcatagcgtagtatacactctgtaaggagactaggaaaaaagcaccaacctacacactgaggagggtttaggattttgttctctatcagcctctgcaggccgtggggtctaaccgtaaaaacacatcaaagccattcagccaagcccgtagatgttggtgaacacctgggtgagactgaataccacttcggcttgtcttgctaagcagctcaggttttgctggactctcctgagttaagcaagtacacgtagcacgtggtgccctagaggagatagttatctccttgcttggcagttagatactttaaggctaaagaattttctaggagtaagagttaaagtgttttcagtaatcttaaggtggtatgaggcatctcaggtctctaggtgtgattgctgttctagagcactggggtcgctgtcactctgaggaagcagtgagtttctgatctctagcaggcccaggaatttcaccatttgaggaagtggccgtggtttcatcccagcagaggaacaaattagagctctttgaggaactgggaccaggagatggttttaggttctagggcattagtaggtgccctgtgagggcccagtggatgtgggtatagacagaaaatctgcaggggtgggcgtgtatgtggggaaggtccagtggttgtgggaacatccagtgacctgcagaagtcaaacctggaccagcctcctgcacacagaacactccaatccacaggcattttctcagtaacacatgagagaactattattgggagagctggttagatttgggtgtggagttgttacacacaggtctcagaagcccatattttttgcctaacttgtagggcagctccacgatctggcctagtcctttggttttttgctgttggagatatagctaatggggttactctgaaggcaaatggtgatctcacaaaataccatcgtattgggttatctgcagagtactcaacaaagcctgagctaaggaagcggtatggcaagggtcggggtatgtgccataaaccagcgtcatgtgctgggatagggagtgcagcagtaaggagtaaggagtatcctgtactagtaaggagaggctgctttgctggtgaccccacagtcaaggcaagtttccttggtgtctccaattccagcaaggccattgcctcccttgacgaccccttgggcaggggcgatgttgtctgaagccatggccattcccatggggatggccttcccaggtggccacccacgacgggaagtgggggtctgggcattcgctttactgctgctgttgcacaggctgttagccctgtgggtcttcagggaagcattcagcgaaagcttgagccgtgttttccttagtggtataggacgtttccatccacaactcttatacatcagagcacatgcatatcctggagcctgtgatcattttggaagctgtctttgcatgtgaggttccaatgtgcaagctgcagtctgggtttgtgctgtggcattgttagccggtttgaattcacacctggcattggcagggccacctgctggtttttttttttttttttttttttttagacggagtttcactcttgttgcccaggctggagtgcaatggcgcgatcttgggtcgccgccatctctgcctcctgggttcaagcgattctgctgcttcagcatactgagtagctgagattacaggcatacaccaccatgcccggcttattttgtatttttagtagagattgggtttctccatgttggtcaggctggtcttgaactcctgacctcaggtgatccgccaaccttggcctcccaaagtgctgggaatacaggcgtgagccacctgccggtctttaaaatgttatttgtgattgtgaaggctgctggtgtttaagctcaatgccaatggacccactcaatatctaagaattgagttgcctgccttggacggaggtcaggtggcatttgaggcacagcccccctagcatgggattccagcacttcccagctttccagtgtgggacacaagttctgaccagggcagtcctgttctagcagcttttggactttggatcctgagtctgacagtagctccacaagccatgggaacataagataccaagcaagaccaaccataaagagcactgagattttatcactcagggctttgatattgacatcgattatggtgtgagctttcaccaatgtttcttcagagtctttctccaccattgacacaggctacatttgggaatgatacttccatgtgatcatcagctaatgtagtctatgtccactagtctgaaggcttctgtttgtttagtgactcattctgtgccctttttgggtcttggagcaataatccctactacctccaggaaggggtgagtgggagacattagctaaatttcaaagtagtaagaactggagcttctgctggaagctgcacgtcaagatgggaggtgtggtatagcagaatcactgtggccctgctgggtaccagtgggcctgggctgccagtccttagggactcacagcttactatccatccacaatctgttttccagtaaatgtatgatgttgagacaatggacctcttatcacagtatgaggagttatcattattggagcaaatgtgaatgatgttatctgtaagggaaaatgaaccttactcttctgtgattaccaaagtgttcaccatggtgggcctggcctaattataatgaggcactggtggccacagggtagagagttaagaaagttaggactctcagaaggggcttggtccccttggggtttcatgccacaacttcaataagaatgactttaggaggccactgtgctgcttggggaggctggtggcttgggggcaatgggccaagtgagagtcccctaaaccctcatgctgtgatgcccattcctatgtcaccaccactgccttgaagtgggagcctaggtcttgatcaatgatattgggtggtttccgagagggaaatgtcacagagcaaatgtcacagcaagagagcacctgctacaccaagggtcttgggttggaagagttgatggaagtgcagggttgtgtgtctgcttctgcacgcaaaggtgctggctgtgtggtaggggcccagtgaagtcaatgtgctgaaaggttgatggcccaggaacaagggagtgccggccacagcctgtgttaaccacggcacggcatctgcagttgagcatcccttgcttggttggagatctggtgagaggcaccagtggcctagggtaccctctaaagtggccacagcctccagtgtctaaagttcgggggcgccactttggtttgagggccaggatgccattctctccactgcagatgctgctctacaccttcttctaatctattcacattttcaatatctcatgtttcaccatgaaattaaccactgaaaattcacattttcaatatctcatgtttcaccatgaaatcctttattgccactctaagacaaaatgatctctgtctttctcctgaagtcctaatgcttcatgaagccacattttacccaggatattgttctacatttcagacttcagtgtttttgatttgtttcttaaaggtttgctatcacaggcactagacacatggactgccttacctcagtaggtttcagttttttcctatatagtttagtgatgataatagaattctatataattacatgatattggttataattaatttatccataatgaatttgttgatcccctactatgtattaggcagttatctacgcactgtggtataacgataagcaaaacatgctgctcaccttctattgtagggagagaaatgttacagatggtaagtgaaacgtacagaaggtgagatagttacaattccacagttaggaataaagagaacaagagggatggaggccactaggggaacttgttgcaatttaaaattgagaaatcgagaaagacctcagtgacaaggtgaaattttagctgagacttcaggtctgggcaaccagctggtgcccttcggggtgcagtgcagatgccccgagatggagtcagctcggcccccatggcagtttggaacaatatggaaagtaacttatgatcgcatgattttgaatcagtggcagttcttagaaactaaggaaggctcctgcacttcaaacggtgaatcccaatatgtttccgtcactgtctcaacaagaggaagagctcagaccatttctctgtcacacacagacttactgtgtcttccctgggacctgtattgagttccccagctgtgcggtgtctcagaggggtgcctggactcctgagctgcctcttcagataggcagagcctcagtctggagccacgatctgctcagaatctgcatggggtgtgcgtaaaaacacctgcattcttctcctgggctctgggcatttgtcgttagtgttggtggtcacggcagtgtctgggccatgagacgatttagtcagaaatggtgaataacccacttgagacaccttcctttctttgaagcctgtaatttttctatcccagtcaaactccttaggacctcttaacagtgaccacctgctaagagtaggcatggtttgaatatagttttttttttttttcccaaacatgtgttttgaaatcactgactgcaactacacgatccagagtaaatatgaggggctcacactggactccccctctgggccggggggtcatgtcctgaaaggacatctgcaggacctattggacaaggattctagggtctgtgggaatcaggggagcgaaagagagaacagacaggtggaagggtcacgtctcatcccagcaagatgtcagcctggcctcaggtacaccagggttaggcagtgaccctgtcctcttgaagggaggaggaagacaggctcaggaaggtagaccccacgtgtgctgtgcctggtggggaggctgcagctggaggcaggacagcagggggcgctgtggccttcccgacaaatgctctgagcatctcagagggctctcctggttcattcccttttccccagacctggtttcttgctcactcactgaagtgcaggatgctttgggaattagaacctcagcgccctgcagcaccagcagggactcaggttacttggagaactctcgtccctctcttcatttttcctgatgccttagaagcagtattttccaggcagaaccagattttctgcagctttaaggtaacccaagagagtgcctgtcacccagtgcagtggagcaattgtgtgtgcgcattttctatgtgtgcagacaactttgtgtgtatgaaatctagattctggtggatatggctggaaaatactcttaatgaggacatcccagaggggtgcctctgtgctttctgttctactcatcacgtctttgtaacagccagttccactttaattgaattctttttttcccatggagctgattccatgtcaggtctaaaaagcagatgtacgatccagaactgctcagggaaactcaaacacttctggaaagaacgtgctggcttttcctgaggagtagcagtgttatggctgtataagcttgaagctgacaatgatggtttatggaacacgtaagcattatctttgcatgaatccaatcaaaatgaggcagagtgaaaaggcagagcagtagatggggagatgagcagcatcatttgagctttcctaacaatgtgtgtctgaagcctttgttcatctccaatattcctagaattggaactggcttttgtttaacatgtagaatttagtgttctggtacttgcatcccatggtcttgactaagacacatatcaaacattaaagaggtgcaaacacaaaacttgctacaaggactttacgagagatgaggaaaggaagctggagaccaagtacagtagtaatgaaagttatcttctatgtctgaaagctagttatgaacttactttcttctgttccacaagctcagaggaagcagaatttgtagtgaatctcaccggaggtgcaggttccatagttgcgttcttgaagatgataatctcttattctgcaagagcatctcaagagggttcttgggcctggggatacagagagcatcaggcattaggactggggtcagatgtgggtggtagacagaatccccgtgcagttacctgctgggctgattgcgttaatcacagtggccacatcagagcagcagcaagatcagctgaatcagtaggaatcaatgtacacagcagtgctgctcacaggcaggattagagacgcattctcatttgctcacctttttgtagtcctgctccatcaccaaggcatctgatcacactcataggcctcttgctagtttctaaaactcttctaatagacaaagtgaaacatgtttcttcaagagtgggctctcatcaatgatgcagggaagatggcccagtatgtttctgcagagcataaaataagtgtgcttctcagaattgtcatagactcaaaaatcttcggagaaaagtcatccctggagtatcatctggttctttccttttagtctacacatgaggaaattgaggcctagggaggtgatcacctaagagaaagagccagctgttgggtctgattctagaggtgcctggttttcctctctagactcctagctctgcaatgctggcggctctcacctgaagctctaaaacctgagcttgtgtccccagtgaaggagatggtaaagtcctggtcgtctgccccaagctgttcctgggctgcagcctagtcagctcttgcctggagtggctcagacagggcctggaggggcaccaggagaatggcagtgaggagggtgagggtcctcatggctggggtcatctggaggagggatagcaggaggggatgtgtggggagtgaggagcaagcctggatttatagctctactgggagaaggcctgagacagatgctgcagtgacaggaggtggagcttgtgattggttgtggcagggctacccttgccctccaggtcccttttgtgttctggtgttttcccagctttcatcatagcttgaggctttatgtttagtgtctggactggatccaagctgatagtgaggctgagtacccttatttatttttctgtttacaatctacttgaatattttctttttgatattgaaaaatgtaaagaaaccgtgatttcattcattaagttggggaacaaatgcctcttattttctgaagatgggccctgccactgtctggagccccagatctgaacccagtggcatagaaaattaaagcagtggagaattcagggacatttccaccctcatgaagaggttatagggtgtgtagcctcctcctggggctggtgtgaggacaaaaagacttaatcaggctacaggtgaaatgagctcattaggatactaggtcaagaataagtaaaactaaagccaaatggtgggttaattttaagaaacaaatgtcatttggacagatcaggtaaaatttctatcattaacatatctgtactttaagaaatatcgaaacaattgacatgcctatagccctcttctaggatctttgtgattgttttaattataaaatcttaaatcatgcagacggaacaacaggtagaaagggtaataggctcccgtctgttcccccagccctgcagctctgctcttggaaaccaccacttcccaattttacacattcttccacacttgctttttccctctaatgctgtgtcttgtacactttgtatatcaaacacatcgagcttcaacgttacaattattccctatacttttccagcgttcgcacatgccatcactttactatttttatactgggaaaatattgtcaagttgtcataatttgtatatttctaagctttgccatgacaattttaaacagcaatgaatataattttatagacatcagtttgcccataagtgacaatatcttttgaatatgtctttagaagtagaattctgggttaaagaacatgtcttaaatattttgagtttattgttacattgtcctcactaaagattgttcaatacactaaaaacaaaaatcactccaaccatcactgagcccagtggaatttcttttagaaggccctgttttgtgcaaacgtagttccagtttttgcattgttgaaatttgccgtttgatattggaatacattcttaaataaatgtggttatattatagaccattttaatgcacattgctcactttattttttttttgctaatgacttattagtttctgtctattttatatttattttacactatggaaatgatgttagacaaaaagcaaattccagcaattttcttagttgaattcaaaataagtcgtaaggcagtggagacaactctcaacatcaacaatgcctttggtccaggacattgcattttggcccactgcactagccaacttacagtgcagtggtggttctggaagttctgcaaaggagacgagacccttgaagatgaggagcatagtggcctgccattggaagttgacgacaaccaattgagaacaatcattgaagctgatctgcttacaactacataaaaagttgccaaagaattcgacatcaaccattctgcagttgtgcagcatttgaagcaaattggaaaggtgaaaaagctaaataagtgggtgcctcacgagctgacagaaaataaaaaaaacgtcgctttgaagtgtcgtcttctcttattctacgaaacaacaacgaaccatttcttgatcagattgtgatgtgcaacaaaaagtggatttcatatgataaccagcggagaccagctcaatggttggaccaagaagaagttccaaagtacttcccaaagccaaacttgcgccataaaaaggtcatggtcactgtttggtagtctgctgcctgtctgatccactactgattcagctttctgaatccccgagaaaccattacatctgagaaatatgctcagcaaatccatgatatgcatcaaaaactacaaaaactacaatgcctgcagccggcattgctgaacagaaagggcccaattcttatcaatgcaacacccaacagcatgtcacacaactaatgcttcaaaagctgaacaaattgggctacgaagctttacctcatctgccatattcacctgacctctcgccaaccgactaccacttctttcagcatctggacaactttttttgcaaggaaaatgcttccacaaccagcgggatgcagaaaatgttttccaagagttcattgaatccagaagcacggatttttatgccacaggaataaacaaacttatttcttgttggcaaaaatgtgttgattgtaatggtttctattttgattaacaaagctgtgttggagcctagttataatgatttaaaattcatgatccgaaactgcaattacttttgcaccaacctaatttttaccaattgtcattgccttttcttcctgcctatgtttagggcagcaatatgttcctctaggaatacttgacgtcttagactctcttgcagctcagtgacagctctgttctgagcaataaaagataatccctaagaggggtagtctttaaaataatgaaataaatttctgttttcctgttataattttccattattgttttatgtggtcttccttttttcttcttggatcgtggaagcacttggacttgcagaaacagctgtctttttaccatgaagaagacaattcctccatatggatggaggagcagaaagatacaagactgtttggttcttgaggccatggttgagatactgcacccactcctgtttgcccacctctggttgtgtcacgacttaggagaaacatgatctggcctttgaaatccactgtttatttgggtttcctggtctttgtggctgaaagcagctggtacttgcattatagagctttttaaatcttttctaaagtgataagcaaaatttgatatcacagtggagtcttggtttgcatttttcatgtaaattaggctcaagaggatttaatgcccaagaagcacttgtatttattttcactgaagtgcttttttttttttaaaccttcttggcctatttatttttattgactggtagcatctgtttatatagtttgaaattaacactttgtcatgggtattagaaatatttttagagtttgtcattctctatagggtttcttttgatgtgtagttatttttatgtagatttaaaatttatttgttgctttctgagttttgtgtctttcccacttaaccttgtaaaactcagtcttgcatgtgttcgttcatgctctgtgctatgagtcagggttgcctttccatctgctgccaccctccctgaggaggctgtgctgtcccaggtagggctatcaggatccataccaactggacatatgaatggcacatacagaggcccaacaagtgtgtaggaaacatggccgtagatgaagctgctagatcagagaaacatcaaagcgacattgtagcaacaaaggtgctctgtgtggtctgtttcacctcttctgtcccactgtgctgtgcctcagtcttccccaaagtacacacatttcattgtaagcacagaattccatttctgaaggcccttatctctgatcttgcacctgactgacttatacacacaggaagcccatgtctcttccctcctcagagacattcagatcctgcttctgcacaggaggggctggaccccaagatgaattgcagtcttgcggacctgttcttgctacaatctcatgcacctgtagaccctgatgggtgcatccagctggccatatcattatctccagtctgtggagaggtcaacagtactcctagctaccattttctgagagaaataagtctctttactcagtaatgatgatcaatgggaattctgactggtggcgtctggtaataaacttgacttcagctacttaaaggatgtggaccaaaatatcagatcccagatgcttcacatgaaatcccaaaggaggggctttacaaaggcttgagctgaggagagcctgtgatgctcatgtaagactctcagtcagcaaatatcccttgagcatcagcagctgtcaggttctaggctcagaacacaaataacccagcagcttacagaagccagcactgcagaattcagaggatagagagtatagggtatgaatgaagtatatggaatttggcatcggtcttgttgctcaataatttttgactttgattaaggtaaataatctgtctaatgttcattttctccttaatgtatatttctggaaaaaatatttaatggtaattgagagttagtaggattaatgtgagtattagttattataatggatggatatttcttagtaatcaattcatattagctaatattagtatattaaatctttttgtgttttgagaatactgtctggcctataggagttatccaattaatagcacttttatgatgtcagacaatgctgccttcaacccatcataaatgggaagaacatattagtgttctcattttacagaatactatagtttgatccataggattaaagtgttgcctccaaggataaaggtccagcatcgtcaaagctaggttggaatcccaggcccctttttccaaatcccttcatctgcttatggcatgggttcccaacccctgtgctgaggaccagtaccggtccatggcctgttaggaaccggggcacacagaaggaggtgagcgaacattaccgcctgagctctacctcctgtcagattaacggtgacattcgattcttataggaatgtggaccctattgtgaactgtgcactcgagggatctaggctgtgtgctccttatcagaatctaactaatgcctgatgatacgaggtagaatagtttcatccagaaacaatccctcagcccccccacccatggaaaaattgtcttacaactgtcattggtgccaaaaaacgtgtccccagtaagtgcctaactaaagtcaagtgacactgtggagcagtagaggcttcatgtccttcttgaagcaggacaggactggggcaaggagagaggtgagagattaagttccaagtgtggagaacagtgtgtagaggaaatgtatgaagacgttcagtaggacgctgtgtagactgtgctcactgaaggaaggttgtaaacatggggaatggcaagtgagtttagactggaaattgtggatgagaagattcctggagattttctagacacagcttcacatcttaaggatgagggcttaagaatagaagggggtgagtggaaatgaaactgccaagcacacttttctttgtgcttccatgccctgtagggattcagagcctcacaggggaagccctacaatgagacagggatgctatgtcttgggataatcacattgtgaaaacatggcccacctctgacttattctttatcgttcgatcacatgagtggattctttaaaatgcctagtaggtcttcagtgtacatacagagtttgtgttttcaataatcatttcgtggtcttatttgaggctgcgaaaattaccctggttgtctggagaccctcacatctctccctgcattctccgtccctagagtttgctgctttcattggccaccctggactgcagtagcagaagccacatgtggtgccccagttgaggacgatgggatgctccgtcctcatctgcccccttcccttggattgatggatacttctcaccatgtcggccggaattctgctctactcttctctgttgcaaaagcaattcctctaaattcactggaggtctatctgacccttcatacttcttgtcccaatgccattttctttacctagaatactgctctacctcttctttttaatgtattgaatttttcaatatcttgtatgtttcagttaaagatatatcataaactcttgtcttgccactacaggccaaaatggctagttcttcattagaaggtagtgatgcttcacaaagccattttctactcatgatattctcctgttggtttaaatgatttttattgatttttaaagcaatgctgtcacatggactaggcacatgggtgctttatccccataggtgtcaggtttattctacgaagttttgtaataacaatgtaattttgtaataatatgtgatgttagatatgactaattaatgtaatcataatgaatttgctgatcctctactatttattagggagtcgtctgtgtactgtggcccaacaatgagtaaaacttgcagctcaccttctagagtagggaggcaaacattacagaaagcaggtgaaatgtacagaatgtaagatggtgtgaaactctacagtttaaaataagagaagaaggggattgaggtttccagggggaactagttgcaatttaaaattgagaaatcagcaaagccctcagtgacaaagggaagttttagcagagactccaggatctggggtgcaagaaaggtggacttctgggtgaagtgcaaaagccgtgtgagggagtcagcccagcccagcggacagttaggagcagtatgcagagttaaagcaagcaccatgtgacttcaagtcagtggcagttataggaacccaaggaatgttgtctggccattgcattctcaatcttaatgtgtgtccttccttctctaaagaagaggtagagctgggaccatttatgtgtcagtcataggctcatctatagtccctaagatctgtattgagttccccagccatgcagcatctcagtggggtgcctggatccctgagctgccacttcagacaggcagagcctcagtctggggccgagacctgctcagaatctgcatgaggtggacgtggggaatgcctactccttcctcctggggtctgggcatttgtggttggtgttggtggcttccccatccatgcagtgtctcagtggggtgcctggacctctgagctgcctcagcaccctgcaacaacaagaaggctacgattttcccggtgaaatgctttccctccctcatcacttatcccctatgaagctgtattttccaggcagattcagttctcagaagctttaaggcaacacaagagagtgcctgttgcaaagtgcagtggagcatttgtgtgtgtgcattttctgggtgtgaagaagagtttatggatgtgaaatccaggtcttagtagacatggctggagggtgctcttaatgaggacatgccagtgtaagctgctgtgctttctgttccatgcatcccacctttgctaacaacacatttccctcttacagaaagttttttccgtggatctcatgtaaccctatgtcttaaaaggaaaatgtacaatctgacattgttcaatgaaactccaattctttagcacagaggatggtggttttcccggagaagtaatgattttgtgactgcatgaactttaagctgacaccgattgtttgcccagtacacgggagggagctctttgagtggatccagagaaaatgagacagagtgaaaagacagagcagtggatggggagattggtggtgtcatatgggccttcttttcaattagagtctgaagccaaaactcctgcttgaaattcctagaatttggaattttgttttgtttaaaaacttaggattctggtaggtgcatgccaagtgtcttgagacacaaagacacatcaaatgtgaaagagatgtaaagacagaaatcttgcgataaggtatttatttaggatgagaaaatgaaattaaggacaaggtacaggaataacaagaatttcttttactctcaaagtaaataatgagcttatttttcttgattctgcaagctcagcagcagcagatccggtataatctaccaggaagggcacaggacccaaagcgacgttgaaagaaatggcaaattcctcgtctgcaaatgcacctcaagcctctccctgagcctggggacacagggacagcatcagaaatggatcaccaaggtcaacagtgggttgtaaagggaatcttggagaagtcacgtgccagctgatgagtgatgttgtctgcattagggccggtagcatgaacaacctcagtcaataggaataaatacacagagcagtgctggtcacacaggatttgagactcattctcatttgctctcatttttgtgcttctgccccatcacacacacacctgaacacactcttaggcttggctctacttttaaaaaaccattctatagatacagtaaaatattctccttataatgaaatctacttgtttagatccagaaagaagtagtcagactgtctcttcatatcttaaacctactgagtttcacaggcatatcttggaatcaagtctttcctttttatttattttttctaaagtgaaaggattattaagaaagtaaaagagtaaaataatggctgctctccatgcagagcagccttaagtctttaaagacagaaaacctgttagatttattgggctctctcttcaatttatagatgagaataccaaggaccagagatgctaaatgaagccacctaagtgacatggaccattgagactcgattccagactctctctcccgtccaaccctctagactgtgcagctctctgcatgccggcctgtctcacctgaaagtggaagtgcagcgctttcatcccatgtaaaggaaacagacacttcctgatcatctgctccaggctactcctgggctgcagcttcatcagctcttgcccgaagtggctccgcctgagcctgcagggccacaaagagaacggtggcagtgaggagggcaagggtcctcatggctacagagacttggaggagggagagcaggagcagatgtgtggggagagaggagttagcctgggtttataggtctgcagagagaaggctcagagaccagaaactttgaaacttctcagtgagaggaggtgtgcatttcatcggggattgtgtgggatccctttggtctcagtgtccctcttttcctcctttgatctctcagcttttattgtagtgtgaatctctattcacactagaaagtgtgagtagatggatcaggtgtttggagaagatggtgaagatgaggatcctggcatgtttttcctgtttctcacttcattccatatttactttttaataaccaaaagataacagcagtgcttttgttcagtaagttcagggagcaaatgtgtcattttctgcagatggccccactacttcctggaggtctacactctggcagcaggcataaattcctatcaagtgaagagtcatttgttgcaggcatcaagggcgtgaccaccctcatgaagtcatggggttagtagtctcttgtaggagccagtgtgaagaggaccatgaccctatcacgtgataggtgaaatgaacacagtgacatcgaggtaaaaagttcatctacatccaaaagaaatttttccagctctactgagatatgaataagaattaaaaatggtacagatctactgtatactgcgttaggatttgatgttcatatacatgtggttttttatcatatactaggtacacaaatcaactcaaaatgttttgaagacccaaacatagacctgaaaccataaaatgatgagaggaacatatgaagataatgctttgacgttgatgttggtaatgatatctttgctatggcagcaaagacacaggcaatgaaaagaaaaatagacaagtggggctgcattgaacattaaagcatctgaatggcaaaaatcaaaaagacaaacaactgagtgaaaaagtgacccagaacatgagagaaaatatttgcaaaccctaagtggtagaaggggtaaatatccaaatacataagtaagtcaaacaactcaatagcaaataacaaataacctgattgaaaaacaggccaaggagcaggataggctcctctcaaaataaaataatgtttcaaggcgctactattgtctctgttagacacgtcaagtaggacacgcgtatttcgaaggaaatttcctgagtttctctattaacttagctggtagccaatgccccaggcaaccaccagaggttcagagagaaatgcacagcaggggattcacccactaggtccctctggggtggtccaggagtcacaggtcagactgggggcacaggctcaatgttgaaacctcaatgtgagagtttaaggtctgtgttaattacagctcctgaagttaggcagagtgaccagagagggcagacagcagtcctctgtccctggtctcctgtagcaagagcagccgtgcacaaacaggaggggacttccctatttaagggtgatttgggatcaggtatcctaatatcctgggttactttctgttgggtacattaaataactctggtggcaagggcagttgagaaatttggagggacgctgtggtgtagacatgagtccacagagaaccccgcatctaactcggtcagccctggccaggcccaggcagcaaccaatgatagattccatgactcctaagacaatggaccccgagatgcctgtgctgatggctcaggctgaggtaattgcacccagggaatacttaaagcccccaggagagcctggcctgcatatcacaggatacactctgttagggagacaagttacgacagacacccatgcacaggagaggatgaggaatcttgcctgaaccagcctcccaagtacctgtgctctaaccgtaacaacacatcaaagccgattggctgggttgggatgttgcagaccacctggttgagactgaatcccacgtcggcttgtgttaccaggcagggcaggttttgttgggtttgttaaggatgtgcacacagcatgtggttcccgggagcggacaattgcctcgttgcttgggcaatggacagtttaaggctaaacgagtgtctaggaccactggcgccaaggactcctgagtttcctgcttgagatctaatgtcttttggaagtctctcagggaggcggccaaggtggaagcaagatgggtgttagcttacatcacctggtgctgtgttctcaaataccttgctcttaagtcaattctgggcaggcttaagagcctccatacacacggcgtgagtgggaagatcactggtcactcgagatatgcaggattgagctcctgtggtccctcctgtgttatttcaggagaagtcctaggaaaactagagcacattttaaaatgtaccactatccaccctcctcctccttctcatagtgaggtagatgtgataaggtttctggaaatgagaaaagaaagcagtcactcgagaggcagtaaatacctatggtgaggttgctgaacccagtgtacaggccagacagcccctgctgccatgggaaggtcatgcacagcgctggtcccacaggctgggtgctcagggcctcccctgcagctctgtgtgcaggcagcaggcatcggccggtggaggcctgggggcagtggagtgagaactaaagcatctccctcaaccttaaggtagaggaggcatctcaagccttgctaggggcggtcactgtggcagagcagtggggtctcctgtccctctgaggaagcagtgaattcctgatgtgtggcaggcccaggaacttcagctttggaggaagtgagcaccagtctcaccccagcataagaagaaatttgggctctttggggaaactgaggctctggtgacagttttagcttccagggcattagtaggtgcctgtagggtcgcaatgatgaggttatagggactaaatatgaaggggtgtatatgagcgagaggaagatctctgggttctggaaatgtcccatgtcctgcggaagtgaaacctggacctgcttcctgcacacagagcacactccagtccacaggcatttccgcagcactgcatgagcgttatcactggagagctggtgagattcgggcgtggtattcttacacacagttctcccaagtccatagttttccgtagcttgtagggcagctttacaatctcactgaggctctatgggttccttgcaccataaagtaatgggcttattctgaaagcaaatggtgatctcagcaaaattccactctaatgaggtcatttttggggtaatcagcaaagcatgaggtcagggaagcagcaagtcaagggtttgggtactggccatgagccagcaccgtgtactggagatggcaaggtccgtgtttgtagcagtaaggaaaggctggttggtggtgatctcgtggtcaaagtgattttcctctacaagggacttaaacaaataagtaagcaaaaaagaaatgacccctttaaaatgcgtgccagggcatgaacagatacttctcaaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagttggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccggcatgatctgacgtcagtgcctcacagggtctcacccctgagccctgtcagagctgcagctgagccagcaccccctgccacctgttcacaagtgtcttgggcctgaggttttcagatcccagcagcacttctcctctgatgcctgtggagagagccacctcccaattgcaaatgtgtgaatgaagacctgatcatgttgttttaatccattaagtcttgtggtgtcttttcatagagccctagatgaacagagggcaattttcacagtattggtgacaaattggacttgtactttgtgtgtgtgtgtaaatctcagcttctctaaaatattgatgaaataggagagaactttctcaattgaatcccaaagtgtcacaaagagcccattgtggtgggggcatggaattgtggactctttggagtgactgaggaacccggtctcacccattcttagtttgaatttttcctgtggggagctggggtagtgtgggatccaggtggagtctcaacctctcccctcagtgacagactcagaagagggtgcggaactccagagctggctgaaacaacggagagagaagtaggggttttctcccggagatcagctatgaagtcccagggaggatgaccattattcacacgactgtcatctggggagagaccccaagttaagatcaagagaaaaaagcgggaaacaaaatggtaaagacaacaaggtaactcatgcctagagtccttggatcaggcattttatgaagccagaagcctttcttttcttttctttctttctttctttctttctttctttctttctttctttctttctttctttcttttttttcttttcttttcttttttttttttgaggcagagtgtagatctgtcacccacgctggagtgcagtggcgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctgagtaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgttctcatctggccctttcccttggattgatggatgcttctcagcacatcagcctgaattctactccgtccttctctctggcaacatccattcctctgaattcagtggaggtccaccctcatcctgcatagctcttgccctgatagcattctgtccaccaaacatttcattctacctcttcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagttttttcctatggaatttaggaataacaattaataaataattttatattgttatgtgctattagatgcaattagttaatgtaatcagaattaatttagtaaccccctactttatgttacagtcatccatgcactctggtacaacaataagcaaaacatgcagcttcccttctggagtaaggaggcaaatgttacgtttagtaagtgaagtgtacagggagtgagacggttgcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccatttcatagttcagaatactatggaaagttaattcggggaccacatgattccaagtccatggcagtcacaggaagccaaagaaggctcctgggcttcacaccgtgattccctatttgtgtccttcatcacctaaacaagaagaagtctgggatcattacccactctgtcctcccagggttcttggtgggcttccatatccatgcagtgtctcagtgggtacctgggcccctgggctgcctcagccccctgcagcaacaagaacgctaccatgttcctggtgaaatgctttccctcccttgtcccttatcccctctgaagctgtattttccaggcagaatcaggttctcagcagctttagggtaacacaagagggtgcgcgttgcaaagtgcggtggagcatttgtgtgtgtgtgttttctgggtgtgaagacaactttatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgattgtttgcccagcacacgcgagctctttgagagtggatccagagaaaatgaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcactcagaatttgagactcattctcctttgctctcatttttgcattcctgccccatcacacacacacctgaacatatcctcaggcttggctgcagtttttaaaagctcttctgtagatagagtaaaatgttctctttacaactaagtctacttgtttagatccagaaataactagtctgtctcttcatatctgaaacttagtgaatttcacagacgtttcttggaatcaagtctttggagaaataaagtttctcatgtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttataagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgattcactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaggcctctgggacagcctggctgcgtatcacagtatacgccctgcaaagagattgggataggaatgccacctgcacacagaggaggatttggaatgtgtttctaaagcagtgtcccgaggacctggggtctaaccataaaaactaatgaaagccatttggctgagctgggatgttggagaacacccaggtgagactgagtgctacctgggcttctgttgctatgtggaacagacatttttgggttctcctgagtactggatgtacacgcggcatgtggttccccagaggtgactatcacctgtttgcttggccaatgaacagtttaagcttaaacaattgtctaggatcatctgggccaagaactggtctgaggcattagccatcagggtgggagtggcctttccagatggccacccaagaaaggaggtgggagtctgggcattcactttactgctggtgttgcacagcctctcaggccttgtgggccttcagagaagcattcagcaaaagcttgagtggtgctttctgggaggcataggagtttccatccttcactggtacacatcggagaacaggtgtatccctgagcccatgatcatgtctggatgctttctgtgaatgcaatgctccaactcttcaggctgcagtctgggtgtgtgctgcggcgtcatgagcccatttggattgaagcctgtgcatccagagaactacctcctcatccttaaaacacgatctgtggttgtgagggctgctggtgtttaagcattggtgccatgggacccattcaatatctaagggttgagttgcccgccttggacacaggtcaggttgtatctggggtgcagcccctgtaacagggcttacagggaattccccagttttccagtctggggtacaaattctgactagggctgtcctgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccctacttcctgccaggagaagtaagtgggaaatattagctaacctttaaaaccggtaaaaaagggagcttttgccagaagctgcatgtgaaatggagaggtgtggtctaacaaaagcctcgtggtcctgctgggtgccagtgggcctggggggttatcctcagaagatcgtagtttactatccatccacagtccattgttcagtatatgtttgatgttgagatggtggatgtcctgtgatgatatggggaggtctcattattggagaacatgtaaatgatgttatctgtaagggaaaaaagaagctaactcttctgtgatcaccaagataggcaccaaagtgcgtctagcccaattgtgatgaggcagtggtggccatgggattgagagttaaaaaagtgacggcccttggaaggaccttggtgccttgggtgtccatagcacatccagagacattaataaccatgactttaggaggccaccgtgctgcttgaggaggctggtggcttggggacgatggactaaatgagactcccttaacccaccctcatgttgtgatgtcctgaggtgggagcctccatctgaatcaatgataggtgtggttctaaaggagatagtgaagaaatgccacgtaaagagaacacctgctccacgcagggcataaggagctacggtccctggaagactacatgtgcagaagctcatagttaggacaggtgtgctttgtccagaggctctgagacttatgatgggtggtagtgagggcctccccatgaaactcagaacccgggacccgggcatggactagagagatcacctgctggaccagcaacagactgtatcctgctgtggccccagtggatgtgaagggcttctgggtgatggcatttgtgggcctcagcagaatggacaagtggggtatagctgtctccaaagacacgatgtcccagtacatggagggccagctgcaaagtggctaggacactagtggtgaggatttggtttttaactgcaaggggactttgtcagcccactgatgacaaattgatgcccagaatctttacaacagtgctggaggggccatgagtgtgtcctccagaaacgtggccactgtccaggaagagggagagcgggtgcagcagctctgccacagacatatgtcctggcccaggcggtggctttacatgcagcacccagagcgatttggggagctgagggagaacagagaccctccagctggctcagagtcactggtggctcctgtccctggaggggtggccttctctgccccaacccagtcttgtgctctccttccctgccattcttggctgcaggactgggaaccatctgctgggacgttgctctgtgtctccctcatggccatgctcccatccttgcctcctccatagactgcggtcaggactcagcagcccagagccccagcagggtctcagtctgtactgaggtcacacctaggcattgtcgccatccttcggcaggtgattctcaaactccaaactcaaattagaacagagagattcttccctgtggtccttttcacttttctcttttggctgcaccagaaccttggcagaattttgtggtttaaacaaaaaaggtgttatgcctacagattttttacagtactttcacttccatgttgatccatagtccccaaccccagcctgatgttttccactgattgcagccagtgtagacaatcagtgtccacactgtggacactatatgtagatgcagctgaagctgtttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggcctcagcagacacagtgtgtgtggaccttgggcggggccctggggttatggttttgacccggtaggaaagggtagtcatggaacacagcatgcgtgttaccatggggcgcagcgggggctacgcagaggtgagctctgaggaggaccctccacctcccagctcctcagagtgcatcgcgctgtccctcccctcagccctttgtccactgtcctgcagggagggtcctggtgctgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatggccctaaatccctgactcttttcacataaaaatggaggtgaaaatggctcctgttgaatctagattgggcgacatcttgaccagttgaacacacctgacttagcaccgtgctgtttgttgggctaaggtcataagaagttggtatctttcacttcctgagtattggatggtgctgcagcctgaatgtttctgtccctctgaaattcatatgttgaaatccctcctctggtgacagcatgaaaaggtggggctttctgggaagtgatatgttcaggaggatggagtcctcatgagttgcattagtgcccctgaggaagaagccccagagagctccttcattcattccctcaggtgaggaagcagtgagaaggtagcatctatgaaccaaaaagctggtcctcaccacacaccaaatctgttggcaccttgatttggacatctcagcctccagaacactgagaaatgtatttttgttgtttataagtcacttggtgtatgattttctttcccccagcatcccacatatactaagagtgctggtgcctttgaagcccagctacaatgcttggaggaagtctaagcattgcaaaaaaaggaactgaacccacctgcaaggaagagctagagaacccagagcaaccagctttctaggaaaaacaaaactctgatatgcagtgtttgtaaatctctctggttcaaatcctcctagctatgagtgggataaaaagtgtcacacctatcttttctctcatgagctggcatgacctggcctcagtgcatcacagtatctcatccctcagcctgtcagagctcccactgagccagcccagcactccccgctacctgtgcgcaagcgtcttggccctgaggttttcagctcccagcagaacctgtcctctgttgcccatggaggggggctatgtcccaattgcaaatgtgtgaatgacgacctgatcgtgctgttttaattccctaagttttgtggtgtcttttcacacagccctagatgaacagagggcattttcacagtattgctgaggaattggatttgtacatattttgtgtgtgtaaatctcaacttctctgaaatattgataaaataggagggaattttctcaacttcttcccaaagcgtcacaaagagcccatcatggtgggggatgaaactgtggactctatggagtgactgaggaaccctgtctcatccattcttagtttgaatttttcctgtgtggaggaggggtagtggatccaggtggagtctcaatctctccactgagggacagactcagaggagggcatgggactcgggagttgactgaaacaatggagaaatcaataggggttttctcccggatatcaacaacggaggctgtggggagataaccacaattcatgtggctgtcacttggggagcgagcccaagttatcaagagaaaaatgggggtgataaaaggtaaagacaagaaggactcttatgctttgggtccttcaatcagggattttatgaagccagaattctttcataagtatcaggtgtggcagtcaaattgttcactcagtttgttgtggtttcttaaatttgaatgcaaaactcagctaatatgcctgaaaattatataaaaatattacctagctcagagaatctgagttaaagacagtacagttcataagaacaggaaacgagggtagatgacaggtgttcctggtgcagcctggggaacagactcccgggtgattcccaggcacgtttctgtgggagaacagccttatcgatgctgatcagcagggaaggagggatggctaccggagaggctggaagtacagcgggtgagtcagcaacagggaccttcatacttgatattcagagatgcaggaattccaggtggtggcaggagcatggggtggagggctggaacaaaagtgggggtcgctgtcagccaggaggatccagcacagagaggttgggagggtgactgagaggaaatgtgagagtgggctctttcccttaggttcttcatgagttgtttgtttcttagtgaaaaaggaaaaatttcagatactcataaaatggaatgagtacttttcagatccctttccttctggttttgcttgtaagccgagtttagaaaatcagaaaagaaatagccaaagaaaactatttcatttattgtacaagaaaaaattcaccaagacgtcgcagaaatgtgaaggaagcgcttattgaagactggtgaaataggagtcagaacgttgcaatagggagagccgttggcctcaacttccctgaagacaaaggcaggaaaggtgaaaccctgggtgagctaggggaaatgcactggaggttggcacccactctgtcctccttgggatctgcatgggcttccccatccatgcagtgtctcagtggggtgcctggacccctgagctgcctcagcaccctgcagcaacaagaaggctacccttttcctggtgaagtgctttcccggcctcatcccttatcccctctgaagctgtattttccaggcagaatcagattctcagcggctttaaggcaacagaggagagtgcgtcttgcaaagtgtagtggagcatttgtgcttgtgtgttttctgggtgtgaagacaactttatgggtgtgaaatccaggtcttagtagacctggctggagggtgcttttaatgtggacatcccagtgtgggccgctgtgctttctgttccatgcatcccgcctttgctaacaacccatttccctcttgaagttgtttcagtgaatctcctgtaacccaatggtttaaaaggcaaatgtgtgacctggacacgttcaataaaaccccagttctttgggacagatgatgctggtttctcctgaggaggaatgattttgtgactgcgtgaactttaagctgacactgattatttgcccagcacacgggagctctttgagagtggatccagagaaaatgaggcagagtgaaaagacagagcagtggatggggagatgggtggtatgatttgggccttcatttccatttgagtctgaagctcaaacgcctgcttgaaattcctagaatttcaaattttattttgtttaaaaacttaggattctggtaagtgcatcccaagtgtcttgagacacaaagacacatcaaatgtgaaagagatgtaaagagagaaatcttgcaacaaggtatttattttggatgagaaaaggaaatggaggacaaggtacaggagtaacaagaatttcttttaactctcaaagtaaattctgagcttatgtttcttgattctgcaagctcagcggcagcagatccggtggagtgtaccacgaaaggcgcaggacccaaagcgacgttataacaaacggcaaattcctcttccgcaaatgcacctcaagcctctcgctgagtctgaggacacagggaaatcatcataaatggatcagaaggtcagcagtgatggtaaagggaatcttggataagtcatgtgctaggtaatgagtgatgttggctgcattggggccagcagcatgaacagcctcagtcaataggaataaatacacagagcagtgctggtcacacaggatttgagactcattctcatttgagctcatttttgtgcttctgccccgtcacacacacagctgaacacactcttgggcttggctctactttttaaaaactattctacagatacagtaaaatattctccttgtaatgaagtctacttgtgtgaatccagaaagaacgagtcagactgtctcttcatatctaaaacctactgaatttcacagacatatcttgacgtcaagttttatttttcaattttatagattttctaaagtgaaaggattgttaaggaagtaaaggaataaaagaatggttactctccaggcagagcagcctcaagtctttaaagacagaaagatttatttggctctctattcaatttatagatgagaaaaccaaggcccagagatgctaaatgaagcccccgaagtgacatggaccattgagactcgattccacactctgtctcccatccatcccactagaccctgcagttctgcatgccggcctgtctcacctgaaagcggaagagcggcactttcatgccatgtaaaggcatgagccatttcctgatcatctgctccaggctgctcctgggctgcagcttcatcagctcttgcctgaagtggctctgcctgagcctacagggccaccaggagaagcatggcagtgaggagggcaaaggtcctcatggctggggtgacctggaggagggagagcaggagcagacgagtcgggagagaggagttagcctggatatataggtctgcagagagaaggctcggagacaagaaacctggaaccctctcagagaaaggaggtgtgcatttcgttggagactgtgtgggatcccgttggtctcaatgtccctgttttcttcctttgctctcccagctttcactctagtttgaatctctacgtgtagtgtttgtgctgggttggagaggatggtgacgacgaggatcctggcatgtttttcttgtttctcacttcattatatattgactttttactattctaccaaaggataacagcagtgcttttgttcgataagctcaggatacaaatgcctcttttcctgcagatggccccactactctgtacaggtctacactctggcagcaggcgtgaattcctatcaagtgaagagtcatttgttgcaggcatcaagggcgtgaccactctcatgaaggcatggggtgagtagcctcctgtaggggccagtgtgaagaggacaatgaccctatcaggcgataggtgacatgaacacagtgatattaaggcaaaaagttcgtctacagccaaaaatgtgtttctggctctattgagatatgaataagaatttaaaacggtatatatctcctgtataccaccttaggatttgatgttcatgtacatgtggttttttatcatatactatatacacaaatcaactcaaaatgatcgaagacccaaacatagacctgaaaccataaaatgacgagaggaacatatgaagataacgctttgtcattggtgtcgataacgatatctttgctatgacaccaaagacacaggcaataaacgggaaaatagacaaatggggctgcactgacctctaaagcatctgcacgtcaaaaaacaaaccaacaaacaaataatcaactgagtgaaaaagcaacccagaaaatgaaagacaataattgcaaaccctaggtggtagaaggggcaaatatctaaatacataaggaagtcaaacaactcaaaagcaaataacaagtaacctgtttgaaaaacaggccaaggagcaggataggcttctctccaaataaaaggatgttctaaggagctattgttgtctgtattggacgtgtcaagtaggacacgtagatttagaaggaaattccttgaggttctctattaattgagccggtagctaaagctcccagcagccaccagaggttcagagagaaatgcgcagcaagagattcacccacaaggtccctctggggtggcccaggagtcagaggtcagactgggggcacaggttcaatgttgaaacctcaatgtgaaagttttaagtcttgggttacttacagatcctcaaggtaggcagagtgaagagggagggcagacagcagtcctctgtcccgggtctcctgtagcaagagcagccgtgcacaaacaggagaggacttccctatttaagagtcatttgggatcaggtgtcctaataacctgggttactttccattgggtttattaaataactctggtgggaaggacagttgagaaatttgatgggaagctggggttcggacaggagtccatggagggtcccctcatctgcctttgtcaaccttgcccaggcccaggcagcaaccaacgatggattctccatgactcctaacacaatggaccccgagatgcctgtgctggtggctgatgctgagctagttgcagcaagggaatatttaaagcccccaggagagcctggcctgcatatcacaggacacactctgttagagagacaagttcaagtttgacacccatgcacaggagaggatgaggaatcttcccctgaaccagcctgcccagtacctgagctctaaccataacaagacaccaaagccgattggtgggctgggatgttgcagaccacctggttgagactgaatcccacgtgggcttgtgttagcaggcagggcaggttttgctgggttcgttaaggatgtgcacatagtatgtggttccctggagtggacaattgcctcattgcttgggcaatggacagtttaaggccaaacgagtgtctaggaccactggggccaagaactcctgagtttcctgctggagacctaatgtctcttgaaagtctctcagggaggcggccaaggtggcagtgagtttggtgttagcttgcatcacctggtgctctgtgctccaatgccttgctcttaagcccattctgggcaggcttaagagtctccatgcacatagcatgagtgggatgatcagtggtcgcttgaaatatgcaggatcaaactcctgtggttcctcctgtgttatttgaggagaattcctaagaagactagagcacattttaaaatgtaccactatccaccgtcctcctccttctcctagtcaggtagatggggtaaggtttctggagatgagaaaagaatgcagtcgctcgagaggcaataaatacctgtggtgaggttgctgaacccagtgtgcacgccgggcagcccctgccaccatgggaatgtcgtgcacagcgctggtcccacaggctgggtgctcagggccccccctgcagctctgtgtgaaggcagcaggcatcggccggtggaggcctgggggcagtggagtgataactaaagcatctccctcaaccttaaggtagaagaggcatctcaagctttgctagaggcggtcgctgtggcagagcagtggggtctcctgtccctctgaggaagcagtgaattcctgatgtgtggcaggcccaggaacttcagctttggaggaagtgagcaccagtctcaccccagcataagaagaaatttgggctcttcggggaaactgaggctctggtgacagttttagcttccagggcattagtaggtgcctgtagggtcgcaatgatgaggttatagggactaaatatgaaggggtgtatatgagcgagaggaagatctccgggttctggaaatgtcccatgtcctgcggaagtgaaacctggacctgcttcctgcacacagagcacactccagtccacaggcatttccacagcactgcatgagcgttatcactggagagctggtgagattcgggcgtggtattcttacacatagttctcccaagtctatagttttccgtagcttgtagggcagctttacaatctcactgaggctctatgggttccttgcaccataaagtaatgggcttattctgaaagcaaatggtgatctcagcaaaattccactctaatgaggtcatttttggtgtaatcagcaaagcatgaggtcagggaagcagcaagtcaagggtttgggtactggccatgagccagcaccatgtactggagatggcgaggtccgtatttgtagcagtaaggaaaggctggttggtggtgatctcgtggtcaaagtgattttcctctacaagggacttaaacaaataagtaagcaaaaaagaaatgagccctttaaaatgcgtgccagggcatgaacagatacttctcaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagtgggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccagcatgatctgacgtcagtgcctcacagggtctcatccctgagccctgtcagagctgcagctgagccagcaccccctgccacctgttcacaagtgtcttgggcctgaggttttcagatcccagcagcacttctcctctgatgcctgtggagagagccacctcccaattgcaaaagtgtgaatgaagacctgatcatgttgttttaatccattaagtcttgtggtgtcttttcatagagccctagatgaacagagggcaattttcacagtattggtgacaaattggacttgtactttgtgtgtgtaaatctcagcttctctaaaatattgatgaaataggagagaactttctcaattgaatcccaaagtgtcacaaagagcccattgtggtgggggcatggaattgtggactctttggagagactgaggaaccccgtctcacccattcttagtttgaatttttcctgtggggagctggggtagtgtgggatccaggtggagtctcaacctctcccctcagtgacagactcagaggagggtgtggaactccagagctggctgaaacaacggagagagaagtaggggttttctcccggagatcagctatgaagtcccagggaagatgaccattattcacacggctgtcatctggggagagaccccaagttaagatcaagagaaaaaagcgggaaacaaaatggtaaagacaacaaggtaactcatgcctagagtccttggatcaggcattttatgaagccagaagtctttcttttcttttctttctttctttcttttttttcttttctttttttttttttttttttgaggcagagtgtagatctgtcacccacgctggagtgcagtggtgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctaagcaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgtcctcatctgcccctttcccttgagttgatggatgcctctcagcacatcagcatgaattctactccgtccttctctctggcaacatccattcctctgaattcagtggaggtccaccctcatcctgcatagctcttgccctgatagcattctgtccaccaaacatttcattctacctctgcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagttttttcctatggaatttaggaataacaattaataaataattttatattgttatgtgctattagatgcaattagttaatgtaatcagaattaatttagtaaccccctactttatgttacagtcatccatgcactctggtacaacaataagcaaaacatgcagcttcccttctggagtaaggaggcaaatgttacgtttagtaagtgaagtgtacagggagtgagacggttgcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccatttcatagttcagaatactatggaaagttaattcggggaccacatgattccaagtccgtggcagtcacaggaagccaaagaaggctcctgggcttcacaccgtgattccctatttgtgtccttcatcacctaaacaagaagaagtctgggatcattacccactctgtcctcccagggttcttggtgggcttccatatccatgcagtgtctcagtgggtacctgggcccctgggctgcctcagccccctgcagcaacaagaacgctaccatgttcctggtgaaatgctttccctcccttgtcccttatcccctctgaagctgtattttccaggcagaatcaggttctcagcagctttagggtaacacaagagggtgcgcgttgcaaagtgcggtggagcatttgtgtgtgtgtgttttctgggtgtgaagacaactttatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgattgtttgcccagcacacgcgagctctttgagagtggatccagagaaaatgaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgggatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcaggccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcactcagaatttgagactcattctcctttgctctcatttttgcattcctgccccatcacacacacacctgaacatatcctcaggcttggctgcagtttttaaaagctcttctgtagatagagtaaaatgttctctttacaactaagtctacttgtttagatccagaaataactagtctgtctcttcatatctgaaacttagtgaatttcacagacgtttcttggaatcaagtctttggagaaataaagtttctcatgtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttataagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgattcactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggccgaaggggcaaatatctgaatacataaggaattccaacaactcaatagcaaaaatcaaacaacctgattgaaaaacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcgcccgctggttccctctggggtggccccacagtcagaggtcagattggaggcatagcttcaataatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaagcctctgggacagcctggctgcgtatcatagtatacaccctgcaaagagattgggataggaatgccacctacacacagaggaggatttggaatgtgtttctaaagcagtgtcccgaggacctggggtctaaccataaaaagcaatgaaagccatttggctgagctgggatgttggagaacacccaggtgagaatgagtgctacctgggcttctgttgctatgtggaacagacatttttgggttctcctgagtactggatgtacacgcggcatgtggttccccagaggtgactatcacctgtttgcttggccaatgaacagtttaagcttaaacaattgtctaggatcatctgggccaagaactggtctgaggcattagccatcagggtgggagtggcctttccagatggccacccaagaaaggaggtgggagtctgggcattcactttactgctggtgttgcacagcctctcaggccttgtgggccttcagagaagcattcagcaaaagcttgagtggtgctttctgggaggcataggagtttccatccttcactggtacacatcggagaacaggtgtatccctgagcccatgatcatgtctggatgctttctgtgaatgcaatgctccaactcttcaggctgcagtctgggtgtgtgctgcggcgtcatgagcccatttggattgaagcctgtgcatccagagaactacctcctcatccttaaaacacgatctgtggttgtgagggctgctggtgtttaagcattggtgccatgggacccattcaatatctaagggttgagttgcccgccttggacacaggtcaggttgtatctggggtgcagcccctgtaacagggcttacagggaattccccagttttccagtctggggtacaaattctgactagggctgtcctgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccctacttcctgccaggagaagtaagtgggaaatattagctaacctttaaaaccggtaaaaaagggagcttttgccagaagctgcatgtgaaatggagaggtgtggtctaacaaaagcctcgtggtcctgctgggtgccagtgggcctggggggttatcctcagaagatcgtagtttactatccatccacagtccattgttcagtatatgtttgatgttgagatggtggatgtcctgtgatgatatggggaggtctcattattggagaacatgtaaatgatgttatctgtaagggaaaaaagaagctaactcttctgtgatcaccaagataggcaccaaagtgcgtctagcccaattgtgatgaggcagtggtggccatgggattgagagttaaaaaagtgacggcccttggaaggaccttggtgccttgggtgtccatagcacatccagagacattaataaccatgactttaggaggccaccgtgctgcttgaggaggctggtggcttggggacgatggactaaatgagactcccttaacccaccctcgtgttgtgatgtcctgaggtgggagcctccatctgaatcaatgataggtgtggttctaaaggagatagtgaagaaatgccacgtaaagagaacacctgctccacgcagggcataaggagctacggtccctggaagactacatgtgcagaagctcatagttaggacaggtgtgctttgtccagaggctctgagacttatgatgggtggtagtgagggcctccccatgaaactcagaacccgggacccgggcatggactagagagatcacctgctggaccagcaacagactgtatcctgctgtggccccagtggatgtgaagggcttctgggtgatggcatttgtgggcctcagcagaatggacaagtggggtatagctgtctccaaagacacgatgtcccagtacatggagggccagctgcaaagtggctaggacactagtggtgaggatttggtttttaactgcaaggggactttgtcagcccactgatgacaaattgatgcccagaatctttacaacagtgctggaggggccatgagtgtgtcctccagaaacgtggccactgtccaggaagagggagagcgggtgcagcagctctgcccatatgtcctggcccaggcggtggctttacatgcagcacccagagcgatttggggagctgagggagaacagagaccctccagctggctcagagtcactggtggctcctgtccctggaggggtggccttctctgccccaacccagtcttgtgctctccttccctgccattcttggctgcaggactgggaaccatctgctgggacgttgctctgtgtctccctcatggccatgctcccatctttgcctcctccatagactgcggtcaggactcagcagcccagagccccagcagggtctcagtctgtactgaggtcacacctaggcattgtcgccatccttcggcaggtgattctcaaactccaaactcaaattagaacagagagattcttccctgtggtccttttcacttttctcttttggctgcaccagaaccttggcagaattttgtggtttaaacaaaaaaggtgttatgtctacagattttttacagtactttcacttccatgttgatccatagtccccaaccccagcctgatgttttccactgattgcagccagtgtagacaatcagtgtccacactgtggacactatatgtagatgcagctgaagctgtttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggccccagcagacacagtgtgtgtggaccttgggcggggccctggggttatggttttgacccggtaggaaagggtagtcatggaacacagcatgcgtgttaccatggggcgcagcgggggctacgcagaggtgagctctgaggaggaccctccacctcccagctcctcagagtgcatcgcgctgtccctcccctcagccctttgtccactgtcctgcagggagggtcctggtgctgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatggccctaaatccctgactcttttcacataaaaatggaggtgaaaatggctcctgttgaatctagattgggcgacatcttgaccagttgaacacacctgacttagcaccgtgctgtttgttgggctaaggtcataagaagttggtatctttcacttcctgagtattggatggtgctgcagcctgaatgtttttgtccctctgaaattcatatgttgaaatccctcctctggtgacagcatgaaaaggtggggctttctgggaagtgatatgttcaggaggatggagtcctcatgagttgcattagtgcccctgaggaagaagccccagagagctccttcattcattccctcaggtgaggaagcagtgagaaggtagcatctatgaaccaaaaagctggtcctcaccacacaccaaatctgttggcaccttgatttggacatctcagcctccagaacactgagaaatgtatttttgttgtttataagtcacttggtgtatgattttctttcccccagcatcccacatatactaagagtgctggtgcctttgaagcccagctacaatgcttggaggaagtctaagcattgcaaaaaaaggaactgaacccacctgcaaggaagagctagagaacccagagcaaccagctttctaggaaaaacaaaactctgatatgcagtgtttgtaaatctctctggttcaaatcctcctagctatgagtgggataaaaagtgtcacacctatcttttctctcatgagctggcatgacctggcctcagtgcatcacagtatctcatccctcagcctgtcagagctcccactgagccagcccagcactccccgctacctgtgcgcaagcgtcttggccctgaggttttcagctcccagcagaacctgtcctctgttgcccatggagggggctatgtcccaattgcaaatgtgtgaatgacgacctgatcgtgctgttttaattccctaagttttgtggtgtcttttcacacagccctagatgaacagagggcattttcacagtattgctgaggaattggatttgtacatattttgtgtgtgtaaatctcaacttctctgaaatattgataaaataggagggaattttctcaacttcttcccaaagcgtcacaaagagcccatcatggtgggggatgaaactgtggactctatggagtgactgaggaaccctgtctcatccattcttagtttgaatttttcctgtgtggaggaggggtagtggatccaggtggagtctcaatctctccactgagggacagactcagaggagggcatgggactcgggagttgactgaaacaatggagaaatcaataggggttttctcccggatatcaacaacggaggctgtggggagataaccacaattcatgtggctgtcacttggggagcgagcccaagttatcaagagaaaaatgggggtgataaaaggtaaagacaagaaggactcttatgctttgggtccttcaatcagggattttatgaagccagaattctttcataagtatcaggtgtggcagtcaaattgttcactcagtttgttgtggtttcttaaatttgaatgcaaaactcagctaatatgcctgaaaattatataaaaatattacctagctcagagaatctgagttaaagacagtacagttcataagaacaggaaacgagggtagatgacaggtgttcctggtgcagcctggggaacagactcccgggtgattcccaggcacgtttctgtgggagaacagccttatcgatgctgatcagcagggaaggagggatggctaccggagaggctggaagtacagcgggtgagtcagcaacagggaccttcatacttgatattcagagatgcaggaattccaggtggtggcaggagcatggggtggagggctggaacaaaagtgggggtcgctgtcagccaggaggatccagcacagagaggttgggagggtgactgagaggaaatgtgagagtgggctctttcccttaggttcttcatgagttgtttgtttcttagtgaaaaaggaaaaatttcagatactcataaaatggaatgagtacttttcagatccctttccttctggttttgcttgtaagccgagtttagaaaatcagaaaagaaatagccaaagaaaactatttcatttattgtacaagaaaaaattcaccaagacgtcgcagaaatgtgaaggaagcgcttattgaagactggtgaaataggagtcagaacgttgcaatagggagagccgttggcctcaacttccctgaagacaaaggcaggaaaggtgaaaccctgggtgagctaggggaaatgcactggaggttggcacccactctgtcctccttgggatctgcatgggcttcccatccatgcagtgtctcagtggggtgcctggacccctgagctgcctcagcaccctgcagcaacaagaaggctacccttttcctggtgaagtgctttcccggcctcatcccttatcccctctgaagctgtattttccaggcagaatcagattctcagcggctttaaggcaacagaggagagtgcgtcttgcaaagtgtagtggagcatttgtgcttgtgtgttttctgggtgtgaagacaactttatgggtgtgaaatccaggtcttagtagacctggctggagggtgcttttaatgtggacatcccagtgtgggccgctgtgctttctgttccatgcatcccgcctttgctaacaacccatttccctcttgaagttgtttcagtgaatctcctgtaacccaatggtttaaaaggcaaatgtgtgacctggacacgttcaataaaaccccagttctttgggacagatgatgctggtttctcctgaggaggaatgattttgtgactgcgtgaactttaagctgacactgattatttgcccagcacacgggagctctttgagagtggatccagagaaaatgaggcagagtgaaaagacagagcagtggatggggagatgggtggtatgatttgggccttcatttccatttgagtctgaagctcaaacgcctgcttgaaattcctagaatttcaaattttattttgtttaaaaacttaggattctggtaagtgcatcccaagtgtcttgagacacaaagacacatcaaatgtgaaagagatgtaaagagagaaatcttgcaacaaggtatttattttggatgagaaaaggaaatggaggacaaggtacaggagtaacaagaatttcttttaactctcaaagtaaattctgagcttatgtttcttgattctgcaagctcagcggcagcagatccggtggagtgtaccacgaaaggcgcaggacccaaagcgacgttataacaaacggcaaattcctcttccgcaaatgcacctcaagcctctcgctgagtctgaggacacagggaaatcatcataaatggatcagaaggtcagcagtgatggtaaagggaatcttggataagtcatgtgctaggtaatgagtgatgttggctgcattggggccagcagcatgaacagcctcagtcaataggaataaatacacagagcagtgctggtcacacaggatttgagactcattctcatttgagctcatttttgtgcttctgccccgtcacacacacagctgaacacactcttgggcttggctctactttttaaaaactattctacagatacagtaaaatattctccttgtaatgaagtctacttgtgtgaatccagaaagaacgagtcagactgtctcttcatatctaaaacctactgaatttcacagacatatcttgacgtcaagttttatttttcaattttatagattttctaaagtgaaaggattgttaaggaagtaaaggaataaaagaatggttactctccaggcagagcagcctcaagtctttaaagacagaaagatttatttggctctctattcaatttatagatgagaaaaccaaggcccagagatgctaaatgaagcccccgaagtgacatggaccattgagactcgattccacactctgtctcccatccatcccactagaccctgcagttctgcatgccggcctgtctcacctgaaagcggaagagcggcactttcatgccatgtaaaggcatgagccatttcctgatcatctgctccaggctgctcctgggctgcagcttcatcagctcttgcctgaagtggctctgcctgagcctacagggccaccaggagaagcatggcagtgaggagggcaaaggtcctcatggctggggtgacctggaggagggagagcaggagcagacgagtcgggagagaggagttagcctggatatataggtctgcagagagaaggctcggagacaagaaacctggaaccctctcagagaaaggaggtgtgcatttcgttggagactgtgtgggatcccgttggtctcaatgtccctgttttcttcctttgctctcccagctttcactctagtttgaatctctacgtgtagtgtttgtgctgggttggagaggatggtgacgacgaggatcctggcatgtttttcttgtttctcacttcattatatattgactttttactattctaccaaaggataacagcagtgcttttgttcgataagctcaggatacaaatgcctcttttcctgcagatggccccactactctgtacaggtctacactctggcagcaggcgtgaattcctatcaagtgaagagtcatttgttgcaggcatcaagggcgtgaccactctcatgaaggcatggggtgagtagcctcctgtaggggccagtgtgaagaggacaatgaccctatcaggcgataggtgacatgaacacagtgatattaaggcaaaaagttcgtctacagccaaaaatgtgtttctggctctattgagatatgaataagaatttaaaacggtatatatctcctgtataccaccttaggatttgatgttcatgtacatgtggttttttatcatatactatatacacaaatcaactcaaaatgatcgaagacccaaacatagacctgaaaccataaaatgacgagaggaacatatgaagataacgctttgtcattggtgtcgataacgatatctttgctatgacaccaaagacacaggcaataaacgggaaaatagacaaatggggctgcactgacctctaaagcatctgcacgtcaaaaaacaaaccaacaaacaaataatcaactgagtgaaaaagcaacccagaaaatgaaagacaataattgcaaaccctaggtggtagaaggggcaaatatctaaatacataaggaagtcaaacaactcaaaagcaaataacaagtaacctgtttgaaaaacaggccaaggagcaggataggcttctctccaaataaaaggatgttctaaggagctattgttgtctgtattggacgtgtcaagtaggacacgtagatttagaaggaaattccttgaggttctctattaattgagccggtagctaaagctcccagcagccaccagaggttcagagagaaatgcgcagcaagagattcacccacaaggtccctctggggtggcccaggagtcagaggtcagactgggggcacaggttcaatgttgaaacctcaatgtgaaagttttaagtcttgggttacttacagatcctcaaggtaggcagagtgaagagggagggcagacagcagtcctctgtcccgggtctcctgtagcaagagcagccgtgcacaaacaggagaggacttccctatttaagagtcatttgggatcaggtgtcctaataacctgggttactttccattgggtttattaaataactctggtgggaaggacagttgagaaatttgatgggaagttggggttcggacaggagtccatggagggtcccctcatctgcctttgtcaaccttgcccaggcccaggcagcaaccaacgatggattctccatgactcctaacacaatggaccccgagatgcctgtgctggtggctgatgctgagctagttgcagcaagggaatatttaaagcccccaggagagcctggcctgcatatcacaggacacactctgttagagagacaagttcaagtttgacacccatgcacaggagaggatgaggaatcttcccctgaaccagcctgcccagtacctgagctctaaccataacaagacaccaaagccgattggtgggctgggatgttgcagaccacctggttgagactgaatcccacgtgggcttgtgttagcaggcagggcaggttttgctgggttcgttaaggatgtgcacacagtatgtggttccctggagtggacaattgcctcattgcttgggcaatggacagtttaaggccaaacgagtgtctaggaccactggggccaagaactcctgagtttcctgctggagacctaatgtctcttgaaagtctctcagggaggcggccaaggtggcagtgagtttggtgttagcttgcatcacctggtgctctgtgctccaatgccttgctcttaagcccattctgggcaggcttaagagtctccatgcacatagcatgagtgggatgatcagtggtcgcttgaaatatgcaggatcaaactcctgtggttcctcctgtgttatttgaggagaattcctaagaagactagagcacattttaaaatgtaccactatccaccgtcctcctccttctcctagtcaggtagatggggtaaggtttctggagatgagaaaagaatgcagtcgctcgagaggcaataaatacctgtggtgaggttgctgaacccagtgtgcacgccgggcagcccctgccaccatgggaatgtcgtgcacagcgctggtcccacaggctgggtgctcagggccccccctgcagctctgtgtgaaggcagcaggcatcggccggtggaggcctgggggcagtggagtgataactaaagcatctccctcaaccttaaggtagaggaggcatctcaagctttgctagaggcggtcgctgtggcagagcagtggggtctcctgtccctctgaggaagcagtgaattcctgatgtgtggcaggcccaggaacttcagctttggaggaagtgagcaccagtctcaccccagcataagaagaaatttgggctcttcggggaaactgaggctctggtgacagttttagcttccagggcattagtaggtgcctgtagggtcgcaatgatgaggttatagggactaaatatgaaggggtgtatatgagcgagaggaagatctccgggttctggaaatgtcccatgtcctgcggaagtgaaacctggacctgcttcctgcacacagagcacactccagtccacaggcatttccacagcactgcatgagcgttatcactggagagctggtgagattcgggcgtggtattcttacacatagttctcccaagtctatagttttccgtagcttgtagggcagctttacaatctcactgaggctctatgggttccttgcaccataaagtaatgggcttattctgaaagcaaatggtgatctcagcaaaattccactctaatgaggtcatttttggtgtaatcagcaaagcatgaggtcagggaagcagcaagtcaagggtttgggtactggccatgagccagcaccatgtactggagatggcgaggtccgtatttgtagcagtaaggaaaggctggttggtggtgatctcgtggtcaaagtgattttcctctacaagggacttaaacaaataagtaagcaaaaaagaaatgagccctttaaaatgcgtgccagggcatgaacagatacttctcaaaaaaagacatacaagaggccaagaaacatgaaaaaatgctccacattactgatcattagagaaatgcaaaataaaacctcaaagggataccagctcacactagtcagaatggctgttattgaaaagttaaaaaatactgatattggcaagactgcagagaaagagaacgcttatacactgttgaggggaatgttaatgagttcagccatagtggaaagcagtttagagatttcgcaaataacttaaaatagaaccagcattcaaccaaggaatctcactactgggtatatatccaaaggaaaacaaattattctgccaaaaagacacatgtactcgtatgttcatggcagcatcattcatgctaacaaagacatggagtcaacctagatggccatcagtgttggactggatgaagaaaatgtggtacatatacatgatgggatactacattcataaaagagaatgaaattatgtcatctgcagcgagtgggattcagtgagaaggtgccgtctatgaatcacaaaactggtcctcaccagacaccaagtgtgttggcaccttgttttggacttctcagcctcgagaacaccaagacatatatttctgttgtttctaagtcacttggtgtatggtatttttttccagcactccacatacactcagattgcttgtgtctttgaagcccggataccatgcttggaggaagtctaagtgttgcaaatcctgctagctatgagtgggatacaaagtgtcacaccaatctcctccttcatgaaccagcatgatctgacgtcagtgcctcacagggtctcatccctgagccctgtcagagctgcagctgagccagcaccccctgccacctgttcacaagtgtcttgggcctgaggttttcagatcccagcagcacttctcctctgatgcctgtggagagagccacctcccaattgcaaaagtgtgaatgaagacctgatcatgttgttttaatccattaagtcttgtggtgtcttttcatagagccctagatgaacagagggcaattttcacagtattggtgacaaattggacttgtactttgtgtgtgtaaatctcagcttctctaaaatattgatgaaataggagagaactttctcaattgaatcccaaagtgtcacaaagagcccattgtggtgggggcatggaattgtggactctttggagagactgaggaaccccgtctcacccattcttagtttgaatttttcctgtggggagctggggtagtgtgggatccaggtggagtctcaacctctcccctcagtgacagactcagaggagggtgtggaactccagagctggctgaaacaacggagagagaagtaggggttttctcccggagatcagctatgaagtcccagggaagatgaccattattcacacggctgtcatctggggagagaccccaagttaagatcaagagaaaaaagcgggaaacaaaatggtaaagacaacaaggtaactcatgcctagagtccttggatcaggcattttatgaagccagaagtctttcttttcttttctttctttctttcttttttttcttttctttttttttttttttttttgaggcagagtgtagatctgtcacccacgctggagtgcagtggtgcgatcttggctcactgcaacctccacctcccaggttgaagcgattctcctgcctcagcctcctgagtagctgagattacaggcacccaccaccacacccggctaatttttctatttttagtagtagagacagttttcaccgtgttgcgctgtctggtcttgaactcctgacctcatgatccaccctccttggcttcccgaagtgtttggattacaggtgtgacccactgttcaggtggggcattcaaaatgttaattcagcttgttgtggtttcttaaatttgagtgcacaactccgctaatatgcctgaaaaagatacaacaaaaattacccagataagagaagctgaggcaaaatggtgcagtgcataagaataggaaatgagagcggatggcaggtgtcctgggtgcagcctggagaagagactcctggatgattcccatgcacagccctgggggagaacagccttattgatgctgatcagcagagaaggagggacggctatgtgagaggctggaggacaatgggtgtgtcagggacaggaatttcataagtgatgttcagagatggaggaattccaggtggtgcaggagttagggagtagccatggggtggaaggctggaacgaggtggcagtccctgttatccaggaggacacagaattgagatgttgggaggttgacttctaggaaatgttagagtgagctctttcccttagtttcttcatgagttatttgtttttttcgtgaacacggaaaaaatacagatattcctaaaatggaatgagttcttttcagatctctttccttctggttttgcttataagccgagtttagaaaatcagaacagtaacagcaaaagaaacctatttcattttttgtacaagtaaaaattaaccaagaccttttaaaaatgtgaaggaagcacttattgaagactgttgaaatgggagtcagaacgttgcaacagggagagccgttggcctcaactttcctgaagccaaagcgggaaggttaaggcctgggtgagctagcggaaatgcactggaggttggtagtgggagtcttgcagtgtgattgggccatctgcgtttgctagtttgtgcttattggagttaggctcctgcctgcctacagagacagggctgctgtccccttgagtagttacatttaaagggatgaggcatctaacttattccttatttccttgtcctgccgcatgaatggctcatttccggtagaaaagttcttgcatgtcatcactaatcctagagtgtatgtgcatcccagtaaacagtgttgtgcctcatttgaggctaagcaagttgccctggttgtttggagaccctcacacctctccctgaattctccgtccctagagtttgcagcagtcatcgcccaccctagactgcagtagcagaagccacatgtggtgctcccagtgtgcctttatccacacagaggagcagggaggctccgtcctcatctgcccctttcccttgagttgatggatgcctctcagcacatcagcatgaattctactccgtccttctctctggcaacatccattcctctgaattcagtggaggtccaccctcatcctgcatagctcttgccctgatagcattctgtccaccaaacatttcattctacctctgcttttagtcattccatgttttaaacatattgatgttgtacttgaagattcacatggaatctttttgcctgctttagccggaatggcctgcttcttctaaggtcctaaagcttcatgatgccaaatagtacccatgatgttttttcatgtttcagccttgaatacttttatttattttgttttttaaaggtgtgctgtcatagggtctagaaaatggactgctctacctctgttgaatttagctttttcctgtggaatttaggaataacaattaataaatcattttatattgttatgtgctattagatgcaattagttaatgtaatcagaattaatttattaaccccctactttatgttacagtcatccatgcactctggtacaacaataagcaaaacatgcagcttcccttctggagtaaggaggcaaatgttacgtatagtaagtgaagtgtacagggagtgagatggtttcaattctatagttagcaatgaggaaaatcggagaatggaggtcagcagggggatcttgttgcaatttaaggttgagagatcagaaaagacctcagtgaccaagtgaagttttagctgagacctcagatgcttgggagaaagtcaggtggacctctggcagatgccccaagatgcagccatcttgatccagttcatagttcagaatactatggaaagttaattcggggaccacatgattccaagtccatggcagtcacaggaagccaaagaaggttcctgggcttcacaccgtgattccctatttgtgtccttcatcatctaaacaagaagaagtctgggatcattacgcactctgtcctcccagggttcttggtgggcttccatatccatgcagtgtctcagtgggtacctgggcccctgggctgcctcagccccctgcagcaacaagaacgctaccatgttcctggtgaaatgctttccctccctcgtcccttatcccctctgaagctgtattttccaggcagaatcaggttctcagcagctttagggtaacacaagagagtgcgcgttgcaaagtgcggtggagcatttgtgtgtgtgtgttttctgggtgtgaagacaactgtatgattgtgaaatccaggtcttagtagacgtggctggagggtcctcttaatgaggacgtgccaatgtgagatgctgtgctttctgttccatgtatcccgcctttgctaacaacccatttccctctgaatgaaagttttttccgtggatctcatgtaaccctatgtcttaaaaggaaaatgtacaatctgacattgttcaatgaaactccaattctttagcacagaggatggtttttttttcccggagaagtaatgattttgtgactgcatgaaatgtaagctgacaccgactgtttgcccagcacacgcgagctctttgagagtggatccagagaaaataaggcagggtgaaaaggcagagcagtgggtggggaaatcagtggtgtcatatgggccttcttttcaatttggatctgaagcccaaactcctgcttgaaattcctagaatttggaattttatattgttcaaaaatttgattttgcgttttggtacgtgtatcccaagtgtcttgacacagacacatatcacacattaaagaggtggaaacacagaaatcttgtaacaaggcatttatttgagatgaggaaaggaaattgagcagaaggtacaggagtaatagcaattccctgtagctctcaaagcaaattttgagctcatttttctttttctgcaagctcagcagcagaatgcccagagtcttccctggtagatgcaggttccatagcgacgttctcctgcaatgcacgctggtattctgcaatagcagtccatgtttttccttgagcctgggacagggagagcatgagaaattgagtatggagttagcagtgggtaagaaaaagaatctcggggaagtcacatgctagctgacaggtgatgctggctgcattgcagccgttagcacgaacaacctcagtcgataggaataaacacgcagagcagtgcttgtcacacagaatttgagactcattctcctttgctctcatttttgcattcctgccccatcacacacacacctgaacataccctcaggcttggctgcagtttttaaaagctcttctgtagagtaaaatgttctctttacaactaagtctacttgtttagatccagaaataactagtctgtctcttcatatcttaaacttagtgaatttcacagatgtttcttggaatcaagtctttggagaaataaagtttctcaggtttatttggctctctgttcaatttctagatgagaaaatcaatgcccagagattctaagtgaagccacctcagtgacatagactgctgagacccaactctggaacctctctcccgtccttccctctagacttagcagctctgcatgcctgcctctctcacctggatgctttggagccaagctttcgtcccatgcaagggaaacaaccacttctgggatgtccgctgcaatctgctccggggctgcagcaacctcatcagctcttgcctggagtggctcagcctgggcctgcagggccaccaggagaatggcagcaaggatggcgagggtcctcatggctggggtcacctggaggagggagagcaggagcagctgtgtggggagggaggagccagcctggatttatagctctactgggagaaggctcggagacaagaaaccttcctcaatctcagtgagaggaggtgtgcattttacaagagaggcccattggtctcaaggttgctcgaatgctcctgttctcccagtttcatgctagtatacatctgtacctttaatgtctgtgctaggttggagctaataatgacaagaaagaccctgctatgttactcgtgggttcacctgcttaaatattatgatttactttttaacattccaaaaagaatagaaattgcactttgattcaacaggctcagggaacaaatgcttcttattttctgaagatgggtcctgctgttctctggaggtctagattctggtgtcctatatgagttccaatggaatagcgagtaattcacttcaggattcaggtgacttaccatcctcatgaagaggtttttgaggttatggggtgagtagtctcctgtaggaatcagggtggagaggacaatgattttatcaggctaaaggtgaaatcagctcagtgacacagagtggtttaagtaaaaaaaagaaagtttattatttccacctctacttagacttgagtaacaattaacaattgtatatttatagtgtacactacctcatgattttatatatgtatgtatttaaatctttatctcacaccatgtagaaacatcaactcagaatgaattgaaaacctaaatgtaacaactgaaaccataaactactagaagtgtatagaaggataaagcttttgacattgatgtaggtaatgatttcttggctatgacaccaaaggcacaggcaataaaagggaaaatagacaagtgtggcttcatttaacgctaaagcatctgcacagcaaaggaaacaatcaaccgagtgaaaagataacccagaaaatgagagaaaatatttgcaaaacctacatggcagaaggggcaaatatctgaatacataaggaattccaacaactcaatagcaaaaatcaaacaacctgattgaaagacagaccaaggacctaaataggtttctctcaaaagaatgttccaaagacctgtgatagtctctactggacatgtcaaccaggacatgtgtgtttagaaggaaactgcttgagtttctctattaagttagctggaagccatcgtccccagcagtcaccagaggtccggacagacgttcctagcagggattcacccgctgggtccctctggggcggccccacagtcagaggtcagattggaggcatagcttcaatgatgaaaactcagtgtaaagtttaagttttgtagtacttacagatcctctagctaggcagggtgaccagagagggcagacagcagtcctctgtcccaggtcttctatagcaaggagcagccgtgcacaagtggacttcccctatttaaaggtcttttgggatgaggtgtcctaatttccggggttactttctgttgggtccattaaataattgtggtggcaaggacagttgagaaatttggtgggaaggtgaggttaaagtagaactccacagaggaacctctcatctaccttggtcagccctggccaggcccaggcagcaaccaactatggattctcaatggctcctaacacagttgaccctgtgatgcattggctgtggctaagctgaactacctgcaccaagggaatatttaaagcctctgggacaacctggctgcgtatcatagtatacgccctgcaaagagactaggataggaatgccacctgcacacagaggaggatttggaatgtgtttctaaagcagtgtcccgaggacctgaggtctaaccataaaaactaatgaaagccatttggctgagctgggatgttggagaacacccaggtgagactgagtgctacctgggcttctgttgctatgtggaacagacatttttgggttctcctgagtactggatgtacacgcggcatgtggttccccagaggtgactatcacctgtttgcttggccaatgaacagtttaaggttaaacaattgtctaggatcatctgggccaggaactggtctgaggcattagccatcagggtgggagtggcctttccagatggccacccaagaagggaagtgggagtctgggcattcactttactgctggtgttggacagcctctcagcccttgtgggtcttcagagaagcatttagcaaaagcttgagtggtgctttctgggaggcataggagtttccatccttaactggtacccatcggagaacaggcgtatcccttagcccatgatcctgtctggatgctttatgtgaatgcaaggctccaactcttcaggctgctgtctgggtgtgtgctgcggcattgttagcccatttggattgaagcctatgcatccagagaactacctcctcatccttaaaacacgatctgtggttgtgagggctgctggtgtttaagcattggtgccatgggacccattcaatatctaagggttgagttgcccaccttggacacaggtcaggttgtatttggggtacagcccctctaacagggcttacagggaattccccagttttccagtctggggtacaaattctgactagggctgtcttgttccagcagccctctaggctgccaggcctgggttaaacagctaccccacaagccatttgtacataagataccaagcaaggccaatcatagagaacactgacatcttgtcactcagggctttcttcccagtgcttctatattgacactgatgatggggttggctggcacccacttttccttggagcctttctcccccatggccacgtttggtgatggcacttccatatggtctttgcctgacgtagttggtgtctctagtttgaaggcttcttctcctcgttactgcctctgactgcaccctcggtgggttctggagcaataatccttacttcctgccaggaggagtaagtgggaaatattagctaacctttaaaaccggtaaaaaagggagcttttgccagaagctgcatgtgaaatggagaggtgtggtgtagcaaaagcctcgtggtcctgctgggtgccagtgggcctggggggttatcctcagaagatcgtagtttactatccatccacagtccattgttcagtacatgtttgatgttgagatggtggatgtcttgtgatgatatggggaggtctcattattggagaacatgtaaatgatgttatctgtaagggaaaaaagaagctaactcttctgtgatcaccaagataggcaccaaagtgggtctagcccaattgtgatgaggcagtggtggccatggggttgagagttaaaaaagtgacggcccttggaaggaccttggtgccttgggtgtccatagcacatccagagacattaataaccatgactttaggaggccaccgtgctgcttgaggaggctggtgacttggggacgatggactaaatgagtctcccttaacccaccctcgtgttgtgatgtcctgaggtgggagcctccatctgaatcaatgataggtgtggttctaaaggagatagtgaagaaatgccacgtaaagagaacacctgctccacgcagggcataaggagctacggtccctggaagactacacgtgcagaagctcatagttaggacaggtgtgctttgtccagaggctctgagagttgtggtggacggtagtgagggcctccccatgaaactcagaacccgggacccgggcatggtctagaatcacctgctggtccagcaacagactgtatcctgctgtggccccaatggatgtgaagggcttctgggtgatggcatttgtgggcccctgcagaatggacaagtggggtatagctgtctccaaagacaccatgtcccagtacatggagggcctactgcaaagtggctaggacactagtggtgaggatttggtttttaactgcaaggggactttgtcagcccactgacgacaaattgatgcccagaatctttacaacagtgctggaggggccatgagtgtgtcctgcagaaacctggtcactgtccaggaagagggagagcgggtgcagcagacctgcccgtgtgtcctggcccaggcggtggctttacatgcagcacccagagcgatttggggagctgagggagaacagagaccctccagctggctcagagtcacgggtggctcctgtccctggaggggtggccttctctgccccaacccagtcttgtgctctccttccctgccattcttggctgcaggactgggaaccatctgctgggacgttgctctgtgtctccctcatggccatgctcccatccttgcctcctccatagactgcggtcaggactcggcagcccagagccccagaagggtctcagtctgcgctgaggtcacacctaggcattgtcgccatcctcccgcaggtgattctcaaactccaaaactcaaattagaacagagagattcttccctgtggtccttttcacctttctctttgggctgcaccagaaccttggcagaattttgtggtttaaacaaaaaaggtgttatgtctacagattttttacagtactttcacttccatgttgatccatagtccccaaccccagcctgattttttccagtgattgcagccagtgtagacaatcagtgtccacactgtggacactatatgtagatgcagctgaagctgttttttcagacacacgcatttgaattttagggaatattgaagcgagtctagactcaataaaaaccttgacatcattaggctggggtaaacattctggagaagctgtgggtggggttgtaggtgtgagaggagagaagcttccaggagcagcacacatattctcacacatgtttatggtgtctggtggccccagcagacagtgtgtgtggaccttgggcggggccctggggttatggttttgacccagcaggaaagggtagtcatggaacacagcatgcgtgttaccatggggcacagcgggggctacgcagaggtgagctctgaggaggaccctccacctcccagctcctcagagtggatggtggtgtccctcccctcagccctttgtccactgtcctgcagggagggtcctggtggtgcctgtgccacacagtcactcccgggcctgcagatccagctgggacaggtaggagctccaagtccctgccctttgtctgcctttcccagccgcctctcacaagctgtctgtgtgtctggtgttgaggattgcagcaggtttattttacaataaaccataaggaaatagcttccttgagctgttttaaaatatgttccctaaattcttttattattttttatagaaagaaaggtttctgttctctcctgttaggtctaggatgggtaacattttgaccaacagactacatggaactagatgccatgctgttttctgggatcaggcgctagtgaactggtgtctttttctatctctctttggatggtgctgtggtctgagacatttttcctctgaaattcatatgttgaagtcttagaccctaggatgatagcattaaaagaaagggtctttttggaaatgaggaggtcagcatggtggagtcctcatgaatggaatgagtgcccctgtagaagaggtcccagagagctccttcattccttccaccagatgaagacacaataagaagatgttgtatatgaaccaaaaagctggttctcaccagacactgattctgctgccaccttgatttggacttcttagcctccacaggggattccgaatggtggcagaagttagggtgtggccatgcggtggagggttggaacaaagaagatgaagggtcactgttgtcccggaggacagagcgctgagaggtagtgagggtgaccttccaggcaatattagagtaacttagttcacgacattttgaattttttttagcagtccacatgtgcttagagggctggtgcctttggagcccagataccatgcttggaggaagactaagcatcccacagggagaggaactgagcccacctgcaaggatgggctagagaacactgagcaaccagctttctaggaaaaaagaaaactctgatttgcaatgtttgtaaatttctgtggttaaaatgctcccagctatagacagtttaagaattatcacacaaaaactcctccctcatgagctggcctgatctgaccccagcacatcacagggtctcatccttcagctttctcagagtttccagctgagccaacaccacctgccacctgtgcacgagtgtcctggccctgaaattttcagatctcagcagaacctctcctcttatgcccgtggaaggatccaaaccccaattgcaaatgtgtgagtgaagacgtgatcatgctgtttcaatccactactttctgtggtgtcttttcgcacagtcctagatgaacagaaggcacggtcttggtgagaagttgaatgtgtgcattttttgtgtgtgtaaatctcagcctctctataatattgttgaagtaggacagaaccctctcaccttatttccaaagtgtcacaaagagcccatcttaatggcagcgtggaattgtggactctttggagtgactgaagaacccccgtcacccattcttagtttaaattcttcctgttcagagcaggggtggtgtgggagccaggtggagtgtcaacctctccccacagtgacagactcagaggaggccacgggacttgggggttggctggaacaacatgggaagaagtagggattttctccaggagattagctacaaaagtcatagagagatgacgatgattcacatggttgtcacctggggagagagcccaaagtaagttcaagagaaacaaagggaaaaaaaaggtgaagacaacagtgtaactcatgctttgatttcttggatcaagcaattcctgaagctagaattcctcctcaattccaagatataggagtcaaaatgttaacttagcttgttgttggtttctgacatttgaattcaagaccccattaagagatctgaaaaacatcaaaaataccagactcagagaacctgaggcaaagatggtgcagtgcacaaggacaggagatgagagcagatgacaagtgtcccggggcagcttgagaccagatgacaggtgtaccaagggcagctggggcatcaggctccctggtgattcccatgcacagccccggggcagaataaccttgttaatgctgatcagcagggaaggaggggcagctatgtgagaggctggaaggacagcaggtgagtcagggatggggagcttcatagttgatgtgcagaaatggaggaattccaggtgatggcaggagttagtgggtggccgtgggtggagggcttgggcaaagaggagggggttcactgttatccaggatctcaaagcattgagaggtagtgagagtgaccttctggaaaatattagagtgaaaaataacttctcataatcttaagtttcttcgtgagttacggggcttttagcagcaaaagacaaaatatgccaaagttcagaaaagggaacaagtacttttcttatctcttacattcttgttgtaaacagagttcagaatatcatataaacaggcacagaatatcaacagcaacaataacgaggcagtatcctttgtttaaaagaaaaattgcaccagatacttttatgaaatgccaaggaattggtgttgaggaatgtcccaataggtgttaactctttgcaatagggagagcagttgaactcaactctcttgaggccaaacacaggagagtttaagccctagggtgagctggtgaaaaagtactggaggttgctggcaggaaggttgagcagtgtgattgggccatctgtgtttcccaatttgtatttatggaaggtaggctcctatcctcccacagagaaaagggtactttcttcttggaaaatgacatttcaaagggttagcttcatatttgacttattctttattttcttctactgtatgagtggcttatttaaggtagaaatatctcactggcattccataaatgtactgtgtgtgtgcattccagtaataagctttgggttttatttgaggctaagcaagttgctcccattgtttggagaccctcacacctctccctgcattctctgtccttagtgtttgcagctgtcatcgcgcaccctagactgcagtagcagaatcttaatgtggttctaccagtatgcctttatcaacacagaggagcagggatattccatcctcgtctgcccctttcccttaaattgatggatgcctccgagaatatcagctcgaattaccagttcatccttttctctttcaacatcaattcctccaaatccagcagacttagaccctgacctggcatatctctgtccctgataccattatctccagcaaacgttcttctctaaccctccttttaatctattcagttgtaaacatctttatgttccggtttaagatacaccataaaatctgtccttgccactccaagacaaaatgatctcttctttctaaagtcctaatgttacttaaagccacattttaccagtgatattctcctatatttcattcttaaaagattttagtttttgaaaggtctgctgtcacatgaactgacatacagaattttttcttctgtaggtttcagctttttttctatgaagttgagtaataataatgcaattttgtaatagtatgtgatgttggggataattaataactcagaattaatttgttgatccccagctatgtgttaggcagtcatctgggcactgtggtacaacaatgagcaaaacatgcagcttcccttctagcacagagagagaaatgttaccgagaataagtgaaatgtataggatgcgaaatggtttgaaatgctacagttagaaataaagagaacaaggaggatggaggtatccaggggaacttgtggcaatcttaagttgggaaatcaagaaagatttcagtgaccaagggatgttttagctgagaccccaggagctggaggagtgagccaggtggacttctgggtgaagggcagctgccccaaaatgaagtgatcctggcccagtggacagttaggaataatttgcagttagttcaaggaccacatgactccaactccaaggcagtgacaggaacccaaggaaggtggcttgtttttcaccccctgaatcataatatgtgtccttcactgtctacacaagggggaagatctgggagcatttattttgtcagacaccaacccactgtgtcctccttgaggtctgcagtaggttccccagctgtgcattgtctcagtggggtgcctggaaccctgagccgcccctttacacaggcagagcctcagtctgggactgagacctgctcggaatctgcatggattggatgtggacaacacctacttccttctcctgggtgctgggcatttgtggttggtgttggtggtcacagctgtgtctagactcattatattgttttattcaagaatggtgaataatccacttgaaacactatttcttcctttgcaaactatggtctctctgtcactgtaagggttcttggggcattttaccagtaccacccaataagagtagccaaggcttgaacagacatatttttattcaaaaaatgtattgtggaatcacaaactagcactactaaatttaaagtaaaataaagactctggggctcacgctagaatacttcccggggctctggggctcacgctggaatccttcctgggcctttgtggtcatgttctcataggctatttgcaggatatgttgaactagtgttcaaggttcaatgggtgcctagagaaggaaagagaagagatacaggaagggtcacatcacacctcagcaagatgtcagcctggcctcagggacaccggtagcgaccctgtcctcttggaggagaggagaaagacaggctcaggaaggtacatacccaacgtgtgctgtgcctggtggggaggctgcagttggaggcaggacaacagggggcgctgtggtcttccaggtaattgctctgagcatctcagagggcgctcaactcctggttcattccctttccgcagacctggtttcctgctcactggctgatgtgcagcactttctgagtatcagaacctcagcgccctgcagcaccagccgggacgcagattacttcgatagcttttccctcacttctgttttcccggtgcccctttaaaactgtattttcaggtagaatcaggtcctctgcagttttaagggaacacaagagtgttaccagatggaagatcttgactgtgagttgtccagattcttagtgcattgaacaaataattcaacaaaacgtacaaacaaagcaacaaaagaacaaagcaacgaaagacaaaccaaagcaacatgagaatgcagtaacgaaagtacagatttattgacacaccacagagtgggagccagttcaagcaagtggctcaagagccccccacttagtgtttttattaagctcaaagaatttggtgtgctgcctaatcttgcctggaactggctgcacctggtgttcttttccttatgccttaacccttgattatcctatttccctattctcctgtctcaagggtgcatctttcagaatacagttgaggaatctgcgttttgtttgtgtgaagacaactttatgaatatgaaatcaagattttccctggcatgggtggaaaatattgatgatgagtctgtcgcagcgaggtgctcctatgcttttcgttgtactcattacaggatttgttttgttttgtttttttgatggagtttcgctcttgtcacccaggctggagtgcaatggcatgatctcagctcaccgcaacctccatttctcaggttcaagtgattctcctgcctcagccttccaagtagctgggattacaggcatgtgccaccactctcggctaatttttgtatttttaatagaggcgaggtttcaccacgttggccaggctagtctcgaactcctgacctcagatgatccatctgcctcagcctcccaaagtgctgggattgcaggcgtgagccactgcccccggtctggaaccatttctttggtgctgggattacaggtatgagccaccacacctggcccattacagctttcttaactgttcattccaatctcaattaaatttttttcaatagagctgtgacaaccccaggtcttcaaaggcagatgtgtgacctgggtctgttcaatgaaactccaacacttcaggaaagaacatggtggttttttccctaagaagtagcgatgttatgattgtgtaaactgaaagctgataatgactgtttttcctaacacatgggagttacgtttgagtgaatccaatcaaagtgaagcagagtgaaaagacagagaagtagaaggagaaattggcagcataatttgtgcttgtaaatcagtttgtgtctgaagccaatgtttgtccttgatattcttagaatttggagttgtattttgcttaaaaagcttaatttaggattctggtgcttgcatcccaaagagtcttgactaagaggtgcattaaacaccaaacaggtacaaacacaaacttgctacaaagactttattaggaataagggaagaaattgaagacaaggtaaaggagtaataaaagttctcctctagatctcaaagcaaatgatgaacacattttcctctgtgctccatgatcccactattggtgcaggtcccatagcggtgtttggaaaaatgacagcctgatattctgccatagcagaccaagcccgtcgctgagcctgaagacacagagaaagcatcaggcattgggactggggtcagacgcggttggtaaggagaatccccgtgcagttacttactgggctgattgcattcatcatggtggccacaccacagcagcagcaagatcagctcaatcaataggaatcaacgtacacagcagtgctgctcacaggcaggattagagacttattctcatttgctcactttttgtgatgctgcttcttcacacacacatttgagtacacccttaggtcccttcccatttgtgaagctcctctaacaaacaaagtgaaatatgtttctttccaagtgggttctcatcctcgatgccagagagactccccagcgtgtttccacatagcataagattactaaatttcactgacttttcacagaatcaaatacctttggaggagcaatgtccattgaatatcatctgattctgtcttttcagtctacacttgaggaaattgaggcctggagaggtgatcacctaagagaaagaaccagctattgggtctgattctagcggtgcctggttttcctctctagactcctggctctgcagtgctggtggctctcacctgaatctctaaaaccagagcttatgtcccctgtgaaggagatggcaaagtcctggtggtctgccccaagctgctcctgggctgcagcctagtcagctcttgcctggagtggctcaagccagggcctggagtggcaccaggagaatggcagcgaggagggtgagggtcctcatggctggggtcacctggaggatggagagcaggagtggatgtgtggggagtgataagccagcttggatttatagctctgctgggagaaggctcagagacagatgctgcagtgagaggaggtggagcatgtgattggggaagggaagggctgcctttgccatcaagatccctttgatgctcttctgttctccgagcttttatcatagcatgagtctgcttatcgagtgtctgttctgggtccaagccaatagtgatgattaggatcatgctataatttcctgtgtctcatctgctggaacatttacttcttaatattcaaaaaagaaaagaaacactgctcttattccataagttcaggcaataaatgcctcttattttctgaagatgagccctgctattcttggtggtctagaccctgaggcaagacctggaccccagcatagagagtaattcattgcaggattctggggcatttctaccctcatgaaggacgcttttgaggttctggaaggcatagtcttctgccactgctagtgtggagaggacaatggcctcatcaggctatcagtcaaataagctcagtgggatactagttaaagagttggtctgaataaggttaaaaatttttttttatttccaaccgtattgagaggagtgacaattagaaattatatcggttgaaagtacacaacctgataattcaacgtatatctacatttgtacccttatctcacaccaaatgtaaaaatcaactctgaatgaattgaagacctaaatataagtcttgaaatcataaaacttactagaagaacccatagggataaagcttcctaacgttgaactgggagattatttcttggatattacattaaaggtagaggcaactaaagcaaaaataaaccagttggagttcatttaactgtaaaacatctgcatagcaaaggaagtcattaactgagcaaacaggcaacctagcaagagagagaaatatttgtaaacgatacatgtaatgaaagtaaatatctaaatatataaagaacttaatagaaaaaaacgagtattaatgataaatgtgactaaacaactaaaagaaaccattattacataattaaaggaaactgtgatgacaaaatcttttcaagggcagaatataataaagtgaagttacgaagaaacacatgaaattctggaattgagaagtacaataatcgaaatgtaaattttatgaacggctgctcaatagtatacttaaactggcagaaccaagatttaggaaatgtgtgtacagatagataaaagattatatagtccagagaacagagaaaaaagatgaagaaacaagaatacagttagagaaaagtgagatactattaggcatgaaaacactcactgggttgagaggtgaactctcaatctgttaaggcagcagtccccaacttttttggcatcagggacatctatgaaaaacttacaactaacatcatactcggtggttgaaaaaaaaaaaaaaggatgctttcctactgaaattagaaaccagccaaggatatctgaaatcagcacttctactcaacattgtgctagaggttctagggcagtcaggcaagaaggaaaaattaaatgacatccaggttagaaaagaagttgttaaataatctctgtttgcaaagacatgatcttttatatatagaaaatccaaaacaatttattaaaaaactattagaactaataagggagtttagcatggttgaaaaatagaagaccagtgcacaaaaatcaattgtattttttctttcataataaacttttcaaaaatgaagctaaaaactccttttacaagtagtatcaaaaggaacatagctagtcgttgaatttaaaaaatgtgcaaaacttatactccccaaaccacaaaaagttgaagtttttaagaatatctaaataactggaaagagatcttatgctcagggattgtgaggtttaatgtgagatgtcagtgctccccaaactgatctacagattcagctcaatctatttcagaatccctaatgacttctttgtagaagactttctttgtagaaactgactaggtgattctaaaatttatatggaatagcaaggatcccagaatagctaaataatcttgaaaaagaagaaaagattcctgttttcaaagcatcctacaaagaaacggtaatcatgacagggtggtactgctgtaaagatagacatagatcagtggaatagaattgagagttcagaaataaaaacgtgtctatggttattaactcactttctgcagtggtgccaagggcattcaatggaggcaagaaaattcttttcaacaaatggtggggtaaactagatggccacaagcattagaatgagttggaccctacctcacactatatttaaaaggtaattcaaaatgggttagaaatctaaatgtaaaatctaaaagcataaaacttttataaggaaacataggggtaagccttcataacctatgtttggcaatggattcttagatattatatcaaaagcatgagcaacaaaagaaaaaaacaggtaattggatattatcaaaataaaaatcttttgtatttcaagtgacactatcaagaaagcgaaaaggcaactcacagaatgagagaaaatacttacatatcacgtatctcatgaaagacatgtatcccatgtatccagaatatatgcagtcctcttatgataaacacttaaagctaaataaacaaatttataaacgggcaaaggatctccttagacatttctctagggaagatatacagatagtcaataagcacatgaaaaaattcttggcatcattatttattaggaaattcaaatcaaaaccacagtgaaataccacttcatatccaccagggttttttagaatcaaaaaggcagataatagacaaaacctgtcgaggatgtggagaaatttactgctgtggtgtaaaatggggcagtctctggggaaaacagttttattgattctttaataagttaaacatagaattaccctgtgagctaggaattccactcctaggtatatacccaaaagctatgaaagtgtatgtccacacaaacagtcatggggaagggcaagaagccagacataaaagaccatgtattacatgattctgtttatacaaaatatccagaataagcaagtctatggggacagaaaatagcttagtggttgctcagaggtagagggatgggaatatcggaagggaggaatggaaagtccttgggttctttatgaagtgatgaaaattaatttgaatgtggttattgctgcacatgtctgtgaatatactaagcgccactgaattctgcactttaaatgtgtgagttgtacatcatgttaattttatctcgatagagtggctttaaaaaacaaaataacacgaaaaatgatataaccaatttttttttaagttaccaaatgcatttcctttctctatatatggtgcactactggtttggggccaaatataaaataaaatatgttggcatgatggaaattgtgttatattgctacattaatggtggtttattatgtgacctggattagtgtaatctgagagatatttgtcgttacgtttttccaagcaaaccttgtttactcaaatgtggaggcaattattaccacttttcttcactcccaacttttttataagatcgtgtattcaaaaagctgttttgggacaactaaaatgttaaatattttatgctatatgatactattatcatttttgtttgtctgttcgttgtgagacggagtttgcactgctgcccaggctgaagtgcaatggcgcgacctcggctcactgcaacctgtgcctcccaggttcaagcaattctcctgccttagcctccccaagtagctggtattaaaagtgtgcaccaccacgccctgataatgtttgtatttttagtagagatggggtttcaccacattggccaggctggtcttgaattccatacctcaggtgatccgccacccgcctcagcctcccacagtgctgggattacaagtgtgagccaccgtgcccggcctatcatttatttttattgtgtgtgttgttacagttcaatgtaatcgtcaattataaaatgcctctcccatttcacatttcataagagtaaagagtttttttaaaagagactttctagaatagagaatgtgacataattttattctcttttgatattggaaaagtaaggatttttagaagatttctaggcaaggcagagaactcagttgtgctttaattggatttacggcatggggactttttctcagcatcaaggtgaaggtgagaacagtataaaattgatgtgggcttagcatttggcatttgcccagagagataagagagtggggggaaaggaacgaagtcctcattcaacagtgattaagtgatggaacatagaccagggctggatgtgaaagaattaaaagagtttggacaactgattgggaaatagtggtgttcctagagaatggaagtgttgacgacactgagtgacagtatgggaacggctgagtcagaaagattgaggggtggggacgaggcatggtaggatgctggaatctgcatttttaaggtgagagtatctccaagtgataagaagattgatgttatggctgtggattgggtgaacaaaacagagtataagggaggtttctgaaaccaacaggtcaaggatccctgaggttgttgggagccatgtgagagcaatgccatttcccacaccacagcagtgttctcaaagccggagctctgaaccagaagcacctgcatcacctgggaacatggtagcaatacaaactcctggatcccacctcagacctattgaatcagaaactctgtggaatgggtcctagcaacagtgttttactgagacctctgcagacctagtggaggtttactgctcatagaccatcatcactcaggacaaagactctttctcccaggtccttagaaaaacagtggacataaatgctttctgttaaatcccattgctgaagtccgttcagagtgaaagaattctgaaacttttcagccatttccagagatgtgccttttgtgtgtaaatgcatttgttttatatttacttgaacttggcattcatttatccactgtgaggtggccttttaaccaaggcccaggtttccaattaaacctgcctccttcaccccaattttttttgagacagtcttgctctgtcacccaggctggagtgcagtagcacgatctcagctcactgcaacctctacctgctgggttcaagcaattctcctgcctcagcctcccaagtagctgggattacaggtgcacaccaccacactcagctaatttttgtatttttattagagtcagagtttcaccgtgttggccaggctggtctgaaattcctgacctcaactgatcccctcctctcggcctcccaaagtgctgggattacaggtgggagccaccatgcccagcccttcaccccacattctgcttgttcattgtgaattaaaggtgtccacatcactttccctacttgctcaaggggaagacaacaattaccctatcacctggcaatccttcccaggagctattcctaagctaccctgatctatctaagaggacaagattcttctaagggtaagtggtcctgatttcctggtcttgacctaaaggggaattctgtaattgtctgatctacctttgggaaataataagtggccccagcttactctgtggaatagaagataacacagcctagtccacatggtggttggtaaacatatagacagacgggaagcagggactcttattgggatccatatcacgactcatgaaatcatcagaggcaccaagcaaatagatggcacacctggaataagaagaacatcaaagggctttggagacaataagggaacttcaaatggtttgctttcctctcttccctctcctcccagcccccatactcacatatggacaaatgtccaagccctattcagcaaagcccattactcttgggtccagctttcaatgaacaaatgcaaacacaggatgggtatatttctccctcattagccatcaggcttgtgcagcttcgtgagaagaaacgactgtcccctgtgatgaccggtagtcatgaggaccttatctctgctcagcgcccttctctccttcaccccaccccaccccacatcgaagccagagcattttcactgaagttcaatctgtttgtgccaagggctctttcttctttttcctcagtagcttcagtatgtttccaccttgagatgtcctcagttatcagagggcgacttagcagtgcccatgctatattcccagtcaaggagaacctgctctgacagaaagctgggccagcagagccacagtagcaccttaaggacagcaggcggcgctcctgccccttataaagttaccctggaggaactgcataggtacactactgaatagcggtgtccagcaaattcttttttttttttttttttttttttttttggttgttgttgttgagacagagtcctgctctgtcgcccaggctggtgtgcagtggcgcgcgatctcggctcactgcaacctcgcctcccaggttcaagcgattctcttgcttcggtctcccgagtagctgggattacaggcacacaccaccatggcaggctaattttttttgtgtttttagtaaagaccgggtttcactatgctgaccaggctggtctcgaacctcaggtgatccgcccacctctgcctcccaaagtgctgggattataggcatgaaccaccaggcccggcctggaaccatttcttggttggacacagacccactctgtcctccctgggatctgtattgggttccctagctgtgtagtgtctcagtggggtgcctggacccgctgcctagctgaagctgcctcttcagacagacagagcctcggtctggggctgagacctgcttagaatctgcatggggtgaatgtggagaacaccggctcccttctcctgaggtctgggcatttgttggcggtgttggtggtcacagcagtatgtgggcccgttgaattattttagtcaagaatggtaaataactcacttgatattctgtctctttgcaaacagtggtctctctatcagtcttggatttcttaaggcgttttaccagagcccacctgataagagtagccttggctcaaacagacatattcttattccaaatacgtgttgtggaatcacaaactgaaactgctatattccaggtgaaataaggagctggcactcacgctggacgcctctgtggggtcttgtggtcagggactgacaggccatttgcaggacacgttggataattgttcaagggacagttggaatctggggaaggaaacagaggggagacaggaggaagagtcacattacacctcaacaagatgtcagcctggccctacagagacaccaggtttaggcagtgaccatgtcctcttggaaaggaagaaaaagacaagctcaaaaggacacaggccccaagagtgagatatgaagatgagcaacagttggagacagcctgggagggaagccgtgaccatcccggtacatactctgaggacctaagagggtattgctgttgctgttcctcctggaaggtcctgataatgaatctatcacagtgtggtgttcctgggctctttgtttgattcattacagctttcttaacaactcattccaatcttcaaaaaaaacaatttttttttttttgagatagggtctcactcttttgcccaggctggagtgtctcactctgttgcccaggctggagtgtctcactctgttgcccaggctggagtgtctcactctgttgcccaggctggtgtgtctcactgttgcccaggctggagggtctcattctgttgtctaggctggtgtgtctcactgttgccgaggctggagtgtctcattctgttgcctaggctggtgtgtctcactgttgcccaggctggagtgtctcattctgttgcctaggctggtgtgtctcactctgttgcccaggctggagtgtctcactctgttgcccaggctggattgcagtggtgcaatctcagctcgctgcagcctcaacattccaggctctagcaatcctcccacctcagcctccctgatagctgggaccatgggtgtgtgccaccatgcccagctaattttttatatgtttttgtatagatggggtttcaccatgttgcccagtgtggtctcaaactcctgcaacccaccattccaaccttagctaaagttgtttcaatagaactgatataacccccaaacttaaaatgtagatgtgtgatccagtttggttgaataaaactccaacaattttggaaacagcatgatggtttttcctgagaaggaatgattttgtgattgcataaacttttagctgacactgattgtctgcccagcacacaggacttctttgagagtggatccagtgaaaatgaggcagaatgaaaagacagagcagtggatggagagatcaggggcatcatttgacctttcatatacatgtgtctgaagccagaattcttccttgaagttcctagaatttggatctttattttattagatcggcctggcccggtggctcacgcctgcaatcccagcactttgggaggctaaggcgggtcagtcacgagttcgggagatcaagaccatcctggccaacatggtgaaacaccgtctctactaaaaatacaaaaattagccaggcgtggtggtgggcgcctgtagtcccagctactcaggaggctgagacaggagaattgcttgaatctgggaggcagagcttgcaatgagctgagatcccaccactgcactccagcctgggtgacagagggagactccgcctcaaaaaaaaaaaaacccggaaatcatgttaccaagtatttatttgggatgaggacaggaaatcgaggacaaggtataagaataacaattccctttaatgctcaaagaaaattatgaactctttttctctagtctgcaagcttagtagcagcagattgggtagcgttcaccaaggatgaagcaggtcccaccaagatgttctccaaaaatgcagtatagtactctgcaatggcagatcaagccctttgttgagcctggggacccagagagagcatcagaaactgagtacggggtcagcagtgggtggtaaagggaatcttggagaagtcacatgttggctgatgagtgatgttggctgtattacagccggtagcacaaacaatctcagtcaataggaataaatacacagagcagtgctggtcacacaggattcgagactcattctcctttgcttcacttttgtgcattcgtgcccatcacacacacacctgaacacattcttaggctcctctccaggttctaaaacctcctatatagacagggtgaaatattttctatatacttaagcttgtttgtctggctccagaaggaactaggtagcatctccttatatcttaaatatagtgaatttcacagtcatatcttggaatcaagtttttggagaaagaaaaatctcttagatttctttggttctctattccatttagatatgagaaaatccaggaccagagatgttaagtatagccacctaagtgacatctgccactgagatccaattccagagcctgtctcctgtccttctgtctagtctgtagctctgcatgctggcatctctcacctggaacctgaagagagcagctgtcatctcctgaaaagtaaaggaccacatcctggtcatctgctggaggctgcttctgggctggcatctcatgagctcttgccgggagcggctctgcccaggcctgaagggccaccaggagaaaggcagagaggagggtgagggtcctcctaactgtagtcacctggaggagaggagggagagcaggagtggatgtgtgggaacggaggagccaggctgaatttatagctctgctgcgagaaggctcagagatggatgctgcagtgagaggaggtaggcatttcgttggagaggttgcaggtgtccattggcctccacatccttctgagactcctctgctctcccagctttcattctagtgtgaatctctaggtttagtgtctatgctagcttggaattcacggtgatgataaggaccctaccattatttctgtttttacctgtttaaatatttacttttaatattgcaaaaagtaatcgaaacagtgatttaattcagtaatttcagggaataaatcctgcttattttctgaaaatgagagctcttctcttcagagatccagaccctcataacagacctgaattccactgtagtagagaactaattcattgcaggattcaagggcattatcaccctcatgaaggggtttttgaggttaggggatgagcagtctcctataggagctggggtagagaggacagcaacctcatcaggctataggtgaaacaagttcagtgagatagagatagagttgattgaaagataaaaatatgtttattattttcagctcaatgtgtgtaaatagacacattgtatgtgtctaatatatactaccttagaatttgagatatgtatacatgtggtcttttttcttataccacatacaaaaatcaactcaatggattgaagacctaaacataagatctgaaaccataaactactagaagaatatatagggataaagctttttgacattaatctgggcaattatttcttggctatgacatcaaagggacaggcaataaaatggaaaatagacaagcggggctgcgttgaacactaaagcacctgcacagcaaaggaaaccaccaactgagtgaaaaggcaacacagaacatgagagaaaatatttgcaaaccctacgtgttagaatgggtaaatatccgaatatacaaggaagtcaaacaattcaatagcaaaaaacaattaatctgattaatcagtgggccagtgagcccccatgatggctcacacaggcaatctcagcgctttcaaaggccaaagtaggaagatcgcttgagcccaggagttggagaccagcttgagcaacacagtgagactccatctctgcaaaataaataaataataaatgaaaactccatgggccaagaacatgaatagacttttctcaaaataaaataatgttttagcagctatgagtatgatcatctctgttggacacgttaagtaggacatgtgtgtttggaaggaaactgcttgagtttattaactgagctcatagccactgcccccagcaaccaacagtcccagatggcaaaatattccctcactggttccctctgaggtggccccataatcacgggtcagattgggaacacagcttcctgggtggaaccgcagtatgaaagtttaagttttgtattgtattactgacagattgttaagctacgtgaggctaccagagtgggcagaggacagtcccctgtcccaggcctcatgttgccacatcagcagctgtgcacaagcaggaaaggacttcccctatttaagggtcttttgggaacaggtgtcctaattttcagggttactttctattgagtagtttaaatacctgctggtaagagcagttgagaaatttgttgggaagctggcattaaaataggagttcacagagggataccttgtctatggtcagccctggccaggcccaggtagctaccaactatgaattctccatgactcctaagacaattgaccctgtgatgcctacactggtgctgaggctgaactatctggaccaaaagaatattgaaagccactgggacagcctggctgtgtatcatagtatccaccctgtaaggaggctaggctaagaatgccactcacacacagatgaggatttggaatatggcctgaaccagcctcctgggaacctggggtccaactataaaaacaaatcaaagctgtttggacaaacaggtgtgttggagaatgcccgggtgagaggagtaccacctcggcttgtgttgctaagcagggcaggtttgttggactttccggaattaaggatgtacatgcaacatgtggtttcttagagggagcaaccacctcttctcttgaccttagagagttcagactgaacaattttttaggaccgtttgggcctagaaatcctgagatttttaggtgagacctaatgtgtctcagaggtctcacaagggagggggccaaggtggcagcaagacggtgctgtgtgctcaaacaccttgttctaaagccagttcagggcaggcttaatggccaccatacactcagcatgagtgggatgattactctatgcttgggatacacaggaatgagctggtatggtccctcctgggttatttgagggggagtcctagggagaatagtgcacattttaaaatgtaccactctccaccctcctcctcctcctcctcatagtgaggtaaatggcatcagttttctggaaatgggaaaagaatgcagtcactcctgagggaataaatacctacagcgaggttgccaagcccagtgtgcaggccgggcagccactgttgccatgggagggttgtgcacagcgctggtccagcaggccggatacacaggacctcccctgcagctctgtgtgaaggcagcaggcaccgcgctgtggaggacttggggcagtggagtgagagctgaagcgtctccctcagtcttaaggaggcaagaggcatctcaagcctcgctaggggtggtcgctgttgcagagcagtgaagtcggctgcccctatgaggaagcagtgagttcctgatctgtagcagcccagcaatttcaccgttggaggaagtgggcactggactcattccagcagaggaagagattagggccattcagggaactgggccccagatgatggttttaggttctagggcattagtaggtgcctgaagggcccagtggatatggatgtagaggcaaaatgagaaggggtgtgtgtgcacgtggggaaagtctgctggttttgggaaacgtccagtgtcctgcagaagtgaaacctggaccagcctcctgcacacagaacacactccaatccacaggcatttcctcagtaacacatgagcgtgctgttatggggagagctggttaaatttgggtgtgatgttgttacgcacaggtctcccaagtccatagtttttgcataacttgtaaggcagcctcatggtgtgacctaggccctatggtttccttgcactagagggtatagctaatggggttacatgaagacaaatggtgttcccagcaaaataccgctctatgaagtcacctgcagggtacgcaacaaagcatgagctaagagagcagctaagcaggggtccaggtactggatgtgagccagcaccatgtcctggcggtggtgaggtccctaccctgtagcagtaaggagaggctggtttagtggtgacctcaccatcaaggtgagattccttggagtcccctggttctggtgaggctcttgttttccttgacaacccttgggttggggcgctgtggtctgaggctgttgccatccatgacccctaccccagtcgatttttccatgaatttctacaagtgtagacttccagtgtagacgtggttgaaactgttctctcatacacatgcatttgaatttccagagaatattgaagtgagcctgcgctaggttggagctgaccataagagccttgacaccatcaggctggagtatatattctgcggaagctgtgggtggggctgcaggtgtgggtgtgacaggagagagggctcccggagcagcaaggatattcccacacagctgaggctgtctggtggccccagcagacacagggtgtgtggaccttgggcatggccctggaacatcgttttgacctggtagggaagggcagtcttggaacctagcgtgcgtgttagcgtggggcagggcggaggctgcgtgggggtgagctctgaggactgtccacctcccagctcctcagagagcaccaccctgtccctcccctcagccctttgtccacccgcctgtggggagggtcctggtgctgcctgtgccacacagcgactcccacgcctgcagatccagctgggacaggcaggagttccaagtccctggcttttgtctgcctttcccagccacctctcacaagctgtctatctgtctagtattggcgtctgcagaaattttacaaaaaactatgagggaataactccgttgagctgtttaaaatgcgtccctaaatcattgactctcctcacacagaaaaggaggtttacttatcccctattgaatcgagacctggtaacatcttgacaaattgagtgcacctgacttagtgccatgctgtttttctgggatcgggcctgatgaactggtatctttcacttcctctctattggatggtgctgcaacctgaatatttttgtccctctgaaattcatacgttaaaatcttaaaccattagttgatagtataagaggtgggagcttttgggagttaagaaggtcagaagggcacaggctttatgactagcattagtgcccttatagaagatgccccagagagctccctctctggtgagagggctcactagatgagaatacagtgagaagatgccatctatgagtcagaaaagcagctctcatgacaccaaatctcctggcaccttgatttagacttatcagtccatgagaaacacatttctgtttttataagcagcttggtttatggcattattttgctagcagcccagacagactaagagcgctggtgactttggagcccaggcaccatgcttagaggaagcctaagtgttggacagggagaggaaccgagcccatctacaaggactggctagagaatgcaaagcaacccgctttctggggaaaaaaaaaaaaaaaaaaaaacaaaaaacaagaaacaaaaaacaactctgatttgcagtgtttttaagtttctattcttaaaattctcctagctatagatcatttaacaattatttcacaaaaactcctctctcatgagccagcatgatccgaccccagcatatcacacagtcccgtccctcagtcttgccggagctcccacctgagccagcactgcctgcccctgtgcaggagtgtctcagccctgagatcttcagatcccagcagaacctctcctctgatgcccctggagggagccaggccccagttgcaaatgtgtgagtgaagacctgatggtgctgtttcaatcctctgaattttgtggtggctttttacaaagcagcaggtgaacagggagagaagttctcattgtcatggagagaagttggacttgtgcactttttgtatgtaaacttttgcttctctaaaatatcgatggatcttctcactttattttcaaagtgtaacacagagcccattgtggtgggggaatgggattgtggactttttccagtgactgactaatcccctgtcaactgttcttagtttcaattcttccttggggagtggggcgatatgggacccaggtgtggtgccaacctccgccctcagtgacagattcagaggtggccttgggacttgggtgtaggctggaacaatgggaaggaagtagggattttctccaggagatcagctatgaaggtcacagagagacgaccatgattcacatggctgtcacctggggagagagcccaaagtaagatcaagagaaataaatgggaaaaaggtgaagacaacaatgtaacttatgctttgagtccttaaatcaagtatttcctgaagccagaattccccctcaattccaagatataggagtcaaaatgttaactcagcttgtcatggtttgacttttgaattcaagaccctactaagttgtctgaaaaacatcaaaaataccaaactcagagaacctgaggcaaagatggtgcagtgcacaaggacaggagatgagagcagatgacaggtgtactgggggcagtctgggcatcaggctccctggtgattcccatgcacagcccgggggagaacagccttgttgatgctgatcagcagggaaggagggacaggtacatgagaggctggaaggacagcgggtgagtcagggatggggagcttcatagttgatgttcagagctggaggaattccaggtggtggcaggagttactgggtggccatgtggtggagagctgggacaaagaggacggggagtcactgtcatccaggaggacagagcactgaaaggttgggagggtgatctgccaggaaatattagtgtgaactctttcccttagttttttttttaatgagttatttagcttttagtggcaaaggaagaaatacagaacttcaaaaaaggaaacgagcacttttctcatctcttacattctggttttgtttgtaagcagagctcagaacaaacagtgatacagaacaaaacaactctgtacttttcttgtaaaagaaaaatttcaccaagactttcaagaaatgtcaaggaaacgtttattgaagactgttgcaataggagtcacaacgttgtaataggaagagccgttggactcaacttacctcaagccaaaggcaggagaatttaagccttgaggggagctagcaggctagctctggaggtcgttaggagggaagttggctagtgtgattgggccatctgtgtttgctaatttgtgcttgttggaataagtctcctatcctctcacagagacagggctgctgccctcttgtgtaattacatttatatggatgaggcatctgacttattcaatatttattgttccaccacacgagtggttcctggtagaaaatctcttgtatgtcatcagtgaatgtagagtgtttgtgcatccagtgaacagttctgggtcttacttgaggccgagcaagttgtcctggttgtttggagaccctcaaacctctccctgaattctctgtctctagagtttgcagtagtcatagcccaccgtagactgcagtagcagaagccacatgtggtgctcccagtgtgtctttatccacacagaggagcagggaggctccgtcctcatctgcccctttcccttgagttgatggatgcttctcagcacatcagcctgaattctactgcatccttctatctggcaacatccattcctcaattcagtggaggtcgacctgaccctgcatatttcttgccctgatatttttctctccaccgaacattctactgtaccccttcttttaatctacccatgttttaaatacctctgtgtttcaccatgaaatcttttcttgcactcaaaaccaaaatagtctgcttctttcttctaaactcctattgcttcatgaagccacattttcccaaggatatttttctatatatcagccttcaatgtttttaattggcttttttttccatgctgccacagaaacttgatatatagactgctttgtggctgtagttttcattttttcctatgcagtttagtaataataataatctaattttatatcactatgtgatattagatatgattaattaattttatcacaattaatttgatgatctcttactatgtactaggcagtcatctggaccctgtggtacaataatgagcaaaacatgcaacttcccttctagagtacggagggaaatgttacagagagtgagtgaagtgtacagaatgtgagaccgctacaattctacagttagaaataaagagaacaggtgggatggagattgcccaggaaagttgctgcagtttaaaattgagaaatcaggaaagacctcagtgacaaagtgaaattttttagcggagaccccaggtctgggaaatgagccaggtgtacttctgggtgaaatgcagatgcccctgggtggagtcagcctggcccagccgacagtttggaaaaatacggaatgttagttcagggacctcaggactttgaagcagtggcagttactagaagccaaggaagcctcctggccttcacaatccaaagttctgtgtgtgtccttcaccgtctaaacaaggggaaggttgggatcatttgtctgtcagaatgcctttgtcctccctgggatctgtgttgggtttcctggccgtgcagtgtttcagtgtggtgcccggactcctgaactgcctcttcagacaggcagagcctcagtctggggctgagacctcctcagaatctcatggggtggacatgggaaacaccagctcccttctcctgagctctgggtgtttgtgattggtgttggtggtcacagcagtgtctggcccttgagatgttttggtcaagaatggggaaaacccacttgaaatgctgtatctttctttgaagtctgtaatctctctgtcccactcaaactccttgtgtcattttatcagtgaccacctaagagtaactgtggcttcaatataggttttggtatattgtgtttctaatttcatttgtttcaagcaatctttaaatttccttatttttttattgacccattggtcattcaggaacatgttgtttaattccatgtgtctgtacagtttccaaagttcctcttatcattgatttcaaattgtattccactgtggtcagaataatacttgatataattttgacatacatgatataggtttgacttaaaaatttgttgagagttgttttgtggactaacatatgatctgtcctggagaatgttctatgtgctgatgagaagaatatattctgcatcagttagatgaaatattctgtaaatgtcagttaggtccatttgggctagagtgtagtttaactctgatgtttggttttgttaattttctgtttaaatggtcagttctttattgaaagtgagttgttgaagttttctactattattgtatttcagcttatctctttagatccagtaatatttgcatttgaatgctctttgaatttttatatccttttgctaaattgaccactgtatcattacataatgaccctgtttgcctctttttgtaatttttgactcaaattctgttttgtctgatagaaatatggctactgttgctctcttttggtttccatttgcatggaatatcttttttcatcccatcactttcaatctatatgggtctttatagacaaagtaattttcttgtagggagcatatagttggatcttgattttcaatccattcagccaatgtatgtctataaactgaagaatttagtttatacttaatgttattattgataggtaagaacttactattaccattttgttacttgttttctgtttcttttgtaactcatctcttccttttctttcttcttttattactttcctccttagtggttaaatgattttctctgatagcgctttaattctttgcttttaaaaaagtgtatgcatggctgggcacggtggctcacgtctgtaatcccagcactttaggaggccgaggcaggcggatcacgaggtcaggagatcgagaccatcctggctaacacggcgataccccatctctactaaaaatacaaaaaattagccaggggtggtggcgggcacctgtagtcccaactacttgggaggctgaagcaggagaatggcctgaacctgggaggcggagcttgcagtgagctgagatcgtgctactgcactccagcctgggtgacagagtgagactctgtctcaaaaaaaaaaaaaaaaaaatgtgtatgcattacaggtttttgctttagggttattaggaagattatgaaatgttcataagaagttattttcaacaaatgacaacttaactttgatcacaaagaaagtagaagaagctaacaatgacagaaaaacctaaaaaactctatactttaactccctcccccccaacatttagacttttttgatctcagtgtacatctttttatattgcctatctcttaacaaattgttttatttattatttttcatagatttgcctttaagtattcatactagagatatgagagatctacaaaccacaattataatattagagtattctaaaattgtctgtgtacttacttttaccaattggttttataccttcagatgttttctttttgcatgttggcatccttttcttaaagactaaagactttccttttataattttgtattaagacagacaggtctggtaatgaatttcctcagtttttgtttgtcagtcacaacctttatttctactcaatatgtgaaagatagctttgctgggtgcagtattcttggtgggaagattatctctcagcctgtgccccagcactttgagcatatcatccctctccttgttggtctgtaggatttccactgagaagtttgtagccagatgatttggagcctctttatgtttaatttgcttctttctttttgctgcttttagaatcctctctttttcctttgagagtttaatgaccgtatgccttatgatagtcttttttgtgttgaatctgtttgataatgtttaaccttcctatacctagatatttatatctttctctatatttggaaagttttctattattatttatttaagctttgtagcccttgccctctctcagctcccttttgaaggtcaatgacttttagatttgttcttttgaggtattttctatatttaataggtattcttcattctttctgttattgagagtctgacagctttctgctaggcagtttatttctcagttccagggtttctatttgctttttagaaaacgattttgatatacttgctaaatttttctgatacatttctgaattacttttctgtgtcattgcaaagcttgctgaatctcctaaaaactgctgttttgaattattgaacattgccatcttcttagggttggtcactggctcctttgtccattggggctggtcatctttttctgtttgctgttgtttcttatgcaacatcaggtataccgaagactaaaggatgggctgccatgtaccaggcctccatttcttaatctctcaaatctagataattgtctcctacctcatgtgtggtagggaaagcaattggtgtgatgcctaacacaatggggacaatgaatggatattaaccaatattgccatatttccttgatcctaagatggtagctgtcttatattatttttttctttccataactgaatacctaagactgggtaacttacaaagaaaatacatttttttcttacaactctgaaggctgggaaatctgagatttagaggctgcatctggtgagggccttcttgctgataaggaatctctgcagtcctcagttgtgcagggtatcacatggtgaggcgggacacactgagaggaactggcttttacaacagactcacagcagactcactcttgtgacaatctactaacacgttaattcatgaatgggttaatccattcgggggcatagagccctcagaaccccatcatctcttaaagaccccaccttttaatagtgttatattgaggagtaagtctcaacatgaacttttggaggacatactcaaattatagtaataccaattacataattatagaagtttatcaaagtaaatcaaagcaaaaccactatcagattacatttacacataggtgtaagatgcatcaaaagtttcaaaagcaaggctgggtgtagtggctcaaacctgtaatcccagccctttgggaggccaaggcgggtggatcacctgagattgggagttcgataccagcctgggcaacatggtgaaaccctgttactactaaaagtagaaaaaattatctggatgtggttgcatatgcctgtattcccagctacttgggaggccaaggcatgagaatcgcttgaacctgagaggctgaggtggcagctgcctgagatcacaccactgtactccaccctgggtagcagagtgagactctgtcaaaaaaaaaaaaaaaagaaaagaaaagaaaagaaaaaaaaacccaacaacagtttcaagaatttaatctgtgaaaaacgtgatatagaatatgatagaactaggatattattaaagtccttctaaagaactggaacaagattgaaatacagagaagacttagaagattgctcagtaaaactgaaggtctaatgtgatggttaattttatgtgtcaacttggctgttttgcagtggaccagatatttggtcaaacattattctgggtatttatgtaagggtgtcttattggatgtgattaacatttaagttggtggactttcagtgaattaaattgtcttgcataatgtaggtggtcctcatccaaccagctgaaggcttgaatagggaaaaggttgaccttccctgggcaagaaagaattctgccagcagacaggctccagagttgaactgcaactttgactcttccctgggtctccaggttgatggcccatcctgaagattgttgacttgctagctccttagtcacatgaggcatttacttaaaacaaatctctctatacatacacattcttttggttctgtttctctggagatccttgatcaagacatacagtttatgtagacacttcatttgtgtggtcacctgaattttgtgcagcagagaacaggaagatctgcagttagactgattggggttgggacatgagaatgaggatgtgtgggatggaaagatgaggagatatatgaaggacatggttaaaatgagagtgaagtgccttttatcacacctttttgtttaggtccatgctgagccaagaatttccatgaacagaaaaagcttcccgttgcctgaaggaagggtgaagaacatcttctgtctatcttggtttttgcataacttgctgtcctcctgaccagagacttgatgctcactttaatagctttgggcccgaggaaacatttattttgtttcttactgtaagttttactcaggatagtagagagtagggtattctcccccatgaccttggagtcctactccatggaagttattcatattgcttgatcactgtgctaatataagacaagagtcttagcttcaagggaaaactggacattgaagagatctgcctggaaaacctagggttgtttatactgtagcttctcagaatggagcagcagagcctctaacaaactcccacgctgtaactgatgtttacataaagactgatgaagaacaggagatgctattcaagattcttataaaaacagaacccattggcccagcacggtggctcatgcctgtaatcccagcactttgggaggccaaggtggggagatcattcaaggttaggagttcgagaccagcctggccaacatggtgcaactacatctctaataaaaatacaaaaattagctgggtgcagtggcacttgccagtaatcctagctacttgggagggtgaggcagaagaatcacttgaacctgggaggcggaggttgcggtgagccaagatcgtgctactgcactccagactgggtgacagaggaagactccatctcaaacaaaacaaaacaaaacacccaaaaaacaaaaagcagaacacatcaaaaagaaagggcagagaccaaccgactaatcaattttggctgtgagtaaagcagttaaatagaggagcatcacagtgacttttaggcaaccaggtgggacctggaaaatccttccctttcaccctacacaccaacctgacctaagttcacagactttgtagagtgaccttaacttcccaaaagatgtacttgtatagagcatctgaggtctccccactccccattctggttcctgctgtcggagaccctcacctcttgggtggtgcatgagaatgctcgccttcctctatcatgctctcttgctggccctccacttccaggaccaggtgtgacagcaaaagtggaagagagtcctgctaagaaaggttgctgaggcagagaaccagcccctaccacctatctcccagtaaagtggagagctctcaccaaggaccatcagatgaggaaaggcagcaccagcctgcactagcctggtaggttctttaatattggaaggactttggggcacagagaaaaatctcaccactatttacactaagtttaaaccagttcttgagtattaaatattgatacaaaggtgattatttaaattcccttcatctatattgatgtaatacatttagtatgcctaattgtttttaaacacatctaataccttaaagaatagataaacatattcctgaaagacaatcacaaacttattcattcattataccaaaaatgatacagaagggcccatatcatggatttgacatcttttctcatttgttttgagtttactccttcctatgatttttgtgatcttccgagaccccaaatgactaaacgaggttgcaagtctagggccaaatagctgacccttgatcaggaaacagtgctttgcatgtgtctaagatgaatcaaacccagactacttgttatttattatcaggctgagactttttgttgttgttgtaataaaaatgtttggttttttttgtcatgtcatgacactgttcaatccctgtcttttatataaattttaattctagaaacttgtttttctcacaaatacgtcgttcttaagtttttgcatagccctaagtgtatggccaattttcttatcattatgatgtattgacttggttcattggcataattaaaaacatattaacatatattttctcactagcattttattaaaatgagtatagctttattataataaatagagttcatatgcttgaagggatggagagttgagaccaactccttcattaaacattggtctaattaaccttttggggaccagtgagggaccatttgtctcattggttattgggcctcgtcctctatggtcaccagcttctgagctcctcttctatctggttattaattgagatcactgatgcttgtcagtctttcttgttttgggcacagttttaactttttccttagtaaactttattttattctatcttgttgatacagttatatatcaccaaaacagagtgaaataaagcttaatgtaaagtgtatatatttaacacatctgcttaaaatttcaaaaattatgtatagcaatgctttcccactttttaaaattaaaggacaagtaaacatagcccattagatctatctttcctttgagccaacaaccactttttgcctctcattgtaaacttctactttttgagtatcattaggaatgcattgaatttttaagtttcaaactattccaattaacacttatatcctgtcaggaatggtggctcaagcatgtaatcctagcactttggggggctgaggagagcagatcacttaagctcaggggttcgagaccaacctgggcaatatggtgaaaccctgtctctacaaaaaaatacaaaccattagtagggtgtggtggcacatgcctgtagtcccagctactcaagaggctgaggtgggaggatcatttgagcacaggaggtcaaggctgcagtgagccgagattgcaccgctgtactccagcttgggtggctaagttagacactgtctcaaacaacaacaataaaaaacccaattatattcatttttgttattttgttattgctctatgatgctcaaattgtgcatcattggaatgcaaagaccagttaacttaatgtagatcagaattctcaatacaaaggaaccatacaaaccaccatataacaaagcaaaagaaaaaaaaggaaaaagaaaagaaaattaaaaaggtcaaacacactaagtttaatgcttgaactttattttggagagagaaatttagaaagacacaaggtacacagagtaaaatgtttttcttttttcaggaccttgaactgaatcttgcactgctttggtttctatctaggaagctcagcgacagcagagtctgtagaggcggccactgatttcacacaccccggagagggactcacgggtagcacaacggccggttcggcaatagcaggtggctcttgcctgagaacctgtggaaagaagagagggtcaggcacagcgagggaggtgggaaaaaggacaagcacagccagactaactgagatagtctaaataagagacactgtatcagtcatgttaggatggagaaaattcatgtctttgtcgtaagtgacaagaaatcttactagctatgtgttagtcatgcaagatcatagtttttttccccatgtgagtctatccaggatgtatttattacctgctccctggtccaacaatatacctctcaacctcagggttacctactcttcattctgcttcatccacacgcctaatcttgacctccatgtgtgatttccaggtcctaacaaggctccctaaagcacctgaatcagtttctgaaatgccgcattgtgcatgctaatgtcatggaccaaatactttggtgctcaaggagtctttgaagactttccaaattcaaattcttcattctctgtctctcctttttttttttttttttttttttttaacattttacatatttacttgttttaattgacaaacaataattgtgtatatgtatgagacacaatatgatgttttgatctaaggatgtattgtagaaagatttaatcaagcctattagcctacatcaaaacacacctataggttcctctctaggttctaaaagcttttccaatggacaaagtaaaacactctctatataactaagtctgcccatttagatctacaaagaactagtcagtgtagctctttctatcttaaaagtagcaaatttcacagaaatatcttggaactgaaagtcttagaaaaaagaaaatcttttagatttatttggttctcactgattaatttatagatgagaaaatcaaggtccaggaagattaagtaaagtcactcaagtgaggtagacctttccacacttgactccagatcctttctccaatcctttttttctagattttgcagatgtgcaagattgatgtctcctacctgaggttctaagagcagagagtccatttcctgcaaaggagatagcaaggtcctggttgtcttccccagactgcttctgggttgtagcctcatcagctctttcctggagtgactcagcctgggcctgcagggccaccaggagaatggcagcaaggatggcgatggtcctcatggctggggtcacctgcaggagggagagcaggagtggatatgtggggagtgaggagtcagcctggatttatagctctgctgggagaagacctgagacagaagctgcagtgagaggaggtgggcatgtgattgggaggggaaggactgcctttgttctcaagatccctttgatgctcctctttctcccagctttcatcaaagcgtgagtctgtatgcttaatgcctcttcttgatccaaggtgttaatgatgataagggtattactatcctgttctgtttcccatctgcttgagtatttacttttatatattcaaaaaagaaaaacaacagcgctttcattcaagaagtttggggatcaaatgcctcttgttttctgaagatggtccctggtactctctggatgactctctgggggcagacctgggactcagtggagtagagagttaattcattgcaggattcagggatattactaacctcatgtaggaggcttttgagatctcgaggtgagtagtctcccgctggtgccagtatggagaggtcaatgaccttatcaggctataggggaaatgagttcagtaaaatagtaggccaagtttatcagattaaaataaaaattcggatttagttcaaggagttggtgtgatctgaatgcatcacataaaatgtgtagcgggtacttctctccactttggggaatatcaaagtaatttaggtgcgtacagcccctttctgagattttttttttagttttagaaaattgtaaatcatgcacaaggaacaacattcaaaaggtagaagtcatgagctctcatttctacccccaggccttcagttctgacccagcaaaccatcactattaacagttacacatagtattctgcacttcgcttttttcacctgtaacattggcactttgtatatcaaaatacatggaatgctattataattttaatagccttatactatcccagggtttgtatatgccatcacttattttttgtactgataaaatattataaaattattacaatttggttatttttaaacttttgcagtaataagtaaagttacagtgattatcttgtatatatgttctcttacctatatggataaacttatagaaatagaattgctgtgtcaaagaatgcatcttaagccagcatggtggtacatgcctatatttctagctatttgagaggctgaggtgggaggatcactggagaccaggagttcgataccagcctaaaaacatagtgagacccctttctcttaaaaaaaaaaaaagagactatatcttacacatttttaagatattactacatatttccataatatcaccatatttgatccaaatcctttggggctcagtgggcccttggagagtctctatatttgaattcctcatttaatttttttcaaatttatttatttattcattgaaaaataattttctgtatatttgtagggtatgatgtgacgtttggattgatatccacatgggagaaacacataagctaattaagatagccatcacctcaccaacttaattttttaaggagaattacaaattgattcctttagcagtttgaaagatacaatacatcactattaactgtggtcaccgtgcagtgccatagatcactaagactctccagcataactgaaactttgtactcttggctcaacatcttctcttttcctatctcacccacctgcagcttctgatgaccacctttgtactctagttccataaaactgacattttaacattccatgtgtaagtgatatcatatagtatttgtcttcctgtgtctggtttatttcgtttagcacattgtcctttggttccatccatgttgtcatgaatgaagaatttccttcttttttttttttttttttttttttgagacggagtcttgctgtcgcccaggctggagtgcagtggtgcgatcccggctcactgcaacctccgcctcccaggttcacgcctttctcctgcctcagcctcctgagtagctgggagtacagtcgcccgccaccatgctcggctaatttttttgtatttttagtagagacggtgttttactgtgttagcgaggatgatctcgatttcctgacctcgtgatccgcccgcctgggccacccaaagtgctgggattacaggagtgagccaccgcgccctgccaatttccttcttttttaaggctatatggtataccatcttgcatgtataccatattttctttattcattcatccactgatgaacatttaggctaattccatatcttgcttattttgaataatgctgaaatggacatgggagtgcagattcttctttgatacagtgatttcaatttcttgggagatatacccagaagtgggattgctgggtcatatggtaattctatgttcagtgctttgaggaaccgccatactattttccaaaatggctgcactaatttacatttccaccaatggcctacaagggtccccttttttttatatcctcaccaacacgtattatttgtctacttgttaaaagccattctaacagatgattacctctttatgattttaatttgcatttccctgataattagtgatgtcgagtgtgtttttcatatatctgtgggccaggtttattgcccttttttaaattgagatgtttgttttcgtcttattgagtgtttgaattccttatatctttgggatattagccccttatcagatatatggtttgcaaacactttctcctagtccctggatcatctttttgtttcctttctgtgcagaagttttttagttgatgtaacctccttggtctatttttgattttgttgtctttgcttttggagtcctgttgtagaaataattgcccagaaaaatgtcataaagatttccctccatgttttcttctagtagatttacaatttcgggtcttttatgtaagtctttaatccattttgagttgagttttgtgtatagtgtgggataagtgtccaatttcattcttctgcttgtggatatctagttttccttacaccttttagtgaaaagactgtcctttccccattgtgtgttcttggcatctttgttgaagatcaagtaatcataaagccctgggtatagttttgggctttctactcctttcctttggttattgtgtctgcttttacaccagaccatgctgttttgcttccaataactttatgatacattttaaaatgagagagcatgatgccgctatctttgttatttttgctcaagattgctttggctattcggggtcatttctgatttcatgccaattttagtatttttttaattcctgtgaaaaattgcattggaattttgatggggatctacagatcactttgggtagtgtagacattttaataatattaattcttccaatccatgaactcaagatatctttccattcatttgtgtcttcttcagttttattcatcaatatttatagttttcagtgtacagatctttcacttttttggttaaaattacttctaagaattttatttttgagtgctattataaatgagattgtgtgggcttctaaacctttgtgccagtccaaactcctgtctttattcttagtgactcctacaaaattagaaagtgtcaagtcatgctattgccttgagagagtgggagagaagccagacctttagaatacagtggagaggttggggtgtttgatatgtgtttcagttttttctttctttgcagagaaactgatagagtttatctcccacttattctgccttatgaaaatgagaggatctgaattaaatctgtaatatctataatatttatttgaattcgtgaattaacagggagcctgggagggactaatttcctgcatcagtgattccaggtttcatggcccttgttttgccctggtggccatttagcaccaggttttaaaccatctgtatttgtactgcttctctatttctcactggacattgctaagtttgtagatagcgttccacaattgtttcctagcctccgtctctctggcattgtctctctgaatctctagcaatgactgaagaaacaatttgggacatttttgttccagttctaacctttctccatgaattctctcatgtgtttgatcacccagagtccttattatttggagaaattgatatcttcagtctctcttcatccttctctgaccccaaaattaattgggtgagcagaaaatctggaaagataaatgggtggtttaaaaaccactgtccaggccctgtggtgtgagaggcagagctgagcactggccaagccagaagatgcccggtggcccatcttcccaggaccaggccctcaccggcagcccattgctcagccttagacacaactctgttgccagtcaagtttctcattatctctggcagaagtatttctagagaactccactgggctgggcgcaatggctcatgcatgtaatcccagcactttgggaggccaaggcgggcagatcatttgaagttaggaggtcgagaccagccttgccaacatggtgaaactccatctctactaaaaatacaaaaattatctggatgtggcagcgggtgcctatagtcccagctactctggaggctgagacacgagaatctcttgaacgtggacagcagaggttgcagggagctgagattgtgccagtgcactccagcctgggcaacaaagcgagactccatacccccaccccccccaaaaaaaaagaaagaaagaaaaagaaaacggcactgacattatggaaaataattttagtttcttaatgcgtttgtaaataatcatttagaataaaatgcctttcctgttcccttttttctttaactgtagcaaagtgcccattatctattgtccccttgacttcaaacgtgctgtcatttaaaataaagtctgaaaaactatttttcttgtcctttattctgagtccaatcttgcctctcctatactcagcgctgggacaaaaacaggatttccatccataatatggacattcactcttaatttccatacataatatggacattcactcttagaaggcatgtactccctgggcgatgatttaattatttaacataaaaattaatttaactgtgctaaaaactaaagggcaagggaattggcctgaaagaaaatacttcagatagcaacagaatctggttttataatagaggttttgtattccaggatattccaggggacaaacaatgcttagatgtgtgtttattactggtaacagtcaagcagatgggagacagggagagtgataggggccttcatgaacgtgaagagcaggtgtttcagtgcagctgctggattggagaatcatcaaaggtctgaaccatcaacccaaaggatacctctatcccacagccacgcaggtttggggtagctcattgccctgggatgctgcttcctccagatatcacagagctggggtctttttactccccttggtcctcaggctccttcggtcccttgagagacagtgacctctaggaggctcacagccctgagagcctttccccttgtccttctctggagcctcttggagaaagctcaccaggtcctagccttgcagcagcctgggacagaggacccagatgtagctgtcccctttgcaggagtgaaaactgcattatgggcttcgggtaagacaatgtgctgtctgttgggagctgcagtctcagtggtgccatcaactagctgtgggatcattagtgcatgacttcacctatcatggcctctgtctttcaactctaaattgggggcaatagagtctctccaaggggtcttgggtgcaagaccttgaaacccttgaaagattaatgtatgcagttcatcccgcaggcacgagcagacaactaggcaacaaataacagccacttaaagctttcttagcctaagctgctttcagaaacagcctgtcaaagtttctccaggctctacggtgcctttgaatatcacatttttaaccccaaagtccatgtaattcattctggcaatcacccaatattattcaaatttcatgtagttcattcaggcaatcacccaatattactgaaattttaatcttctcttagaatactcattctccatgaaatcttttccaaatgtatagtgctaaatgctgtcaatttcagaatgattcctgcatttatatcttcagctccaaccacccagctgaattccagactctggaacacatttcctgtcgtgtgcgctagaatctccaacagattcctcacccctaatgtccaaaactaaactcttcactgtacatctccccagcttgcaggcaccacacacacatacaggtgttgtcatttcagaaaatggcaccagtgtctctgcagttgttcagggcaaaaaataaaaatattcttcagatatcctaatattccatattcttacatcagcaacttctgttgcttctgtaccttcaatataaattttgaatggggccatttcttatcccctgcactgccagcaccctggtgcaatatacactggcttctcatctgggcttcctcagcccccttgtaactgggctcccgctgatactgggctctgtgctgcctctgagcacccgttttccagagctggtcaatacccctgtctagcgaggttctttcccagccattttcaagatgcaacacccaggtactaagtcctgacaggcactaatctccacggttctccaggaatgaacaaataagggaataaccacacatatcccatgtatccacaaacgtagtgcctttttttttttttaaagaggatgggtagctcattgtcctttcttaaagaagcactacgtttgtggatacatgtggatacatagcatgtccccaaagctatgctcttgcaattggtgtccagcagcctctgaacaagtgaggaaggttcatccaatagtgcaaaactgggctgtaggtgcccaccaggaggagccagaggtcctcatgttcatgaaggcccttatctctctccctgtctcccatctgcttgactgttaccagcaataaatatggtcatgtctaaccatcatttgtcccctggaatatcctggaatacaaaacctctattataaaaccggattctgttgctatcttattttcttccaggccaattgtcttgcacattactttgtaacacagtcaagttaattcctatgttaaataattaactcatccgtcaggggagtacatacattctaagagtgaatgttcatattatggatggaaatcctgtttttgtcctggccctgagtgacctggacaagtagatctttctaccctgagatccagctcctcagggtagaaagtgcagagctgacatctctatgaaaatgaccagggcaatagaaacaaaaaggtaagaaaaaaggtaaagaaaaaaataaggtaaagaaaaggggggactacatggcccaaatacattgagcttactgtgaaaactcatttttggagatagagagaagataaagaacaaggaagagagactaaattgttcgtttccaggttttcaaatggaatcttgtcctgatttgggtctcaattaacaaagcacaaggacagctgagcctgtaacaggtgttgctgaggatacaggaccgagagtgatactcagtggcaacatgcaggtctgcaactgcaggtgcctctcacctggtgacctgcaggaagatggaggagcatattgggcacagtgctcggtttgggggtacgggaaatcagatcagagcagcccagaggaggactgtgttctaatagagcaggttctaatagagcagaataaagagatcataactggccatctgtcggccattcaagatctggtgcttcctttcatgttttctgtcatttatatcacacagtccccactccctgcacacaggcactgagactcagagacatgcacatgcacgtctataacacatacatccccagtttccacctcacaacacactccactcaccacacaggcgtgcacatacctgcacaatataaacatacaaacatatgcacaggtgcacgcatgcacacacaccctgaagtgcagactccaaactctaatatatctggtttagtctctgaggctgaagctgctcagagggcgcctcccgcgatgcggggagtaatatctccccctctcccccccgggctattaccagccacatcacaggggggtgagggcgccccccgcgatgcggggagtaatatcgcccccctctccccccttgcatattacgagccacggtggtcacacagcgtgttgacattattgtcaataatatcttctctccctctggaaatgaccaactagatcacagaccggtgtacatcctcttcactatttgtagtaatagcatcctcttccccctggatattaagaacagtatcacaggagtctttctacccccagcggcattgggtgtagtatcgtcctctcccacgttgaaattatgaactatatcactgggggtgtgtccaccccatgcgatattgatagtagcatcatcctcttctctcctggatcaggggagcaatgtcactggggtggtgtacactttctgcggtatcggcagtaagatcatcctctccgccttggaatatgaaggaccatatcacaggggggctgtacacaccctgcgctatgaagacgaatattatcctctcccaccctgcacatgagaaaaaatatcacagggtgggtgtacaccttctgcgatatgggggggaaatatcttctcttcttctggatagtaggaacaatatcacacgggtttgtacactttctgtgatattgggagtaatatcaacttctccgcctttgaatattaagaacagtgtcacagactggatgtacaccccctgcgatattgggagtaaaatcagcctctcctctccatggatattaggaataatatcccagaatgggtgtacacctcctgctgtatgggaagtcatatcttcctctcccttcctggctactaggaaccatatcagagggtgggtgtacacagcctgcgatattgcgagtaatatcaccctctacccctccggatattaggaacaatatcacagaaggggtgtacactttctgcgatactgggagtcatagcattgtcttcttccgtgaatattaggagcaatttcaccgggtggatgtacacccactgctctattgggagtgacgtcatattccaccccctggagattatattcggatcaatatcactgggtgggtgtacacctactgcaatattgaacataatatcatgctctctccctccctggacattaggagcaatatcacaggtaggtgtacacccactgaggtattaggcgtaatattcatattcattattcctcatttattagtcacatgaatatgaattaccaatattaatattaataacaaattgctgataaaaagtgttcaaaatattaatattaattattaggagctaatattactgttttctaatgtataagatcaatatcagttattaatatcaggcattattaatcattaatattaatcatttattgttatcattcgtataactatttaatattaattatcattattattggtattgatgttaaaaattatattttcagttattaatgtcgataattattagtatcaattaataatggatgttattaattgcgataagtaatattgatattaaaatcgatattattgattatcaattattaattgcgataagtaatattgatgttgaaatggatattatttattattaattattaattgcgataataatattaattgcgataagtaatattgatattgaaattgatattattaattgtgacaagtaatatcgatattaaaatggatattagtgattattaattattaattgcgataatgatattaattgcgataatgatattaattgcgataagtaatattcatattaaaattgatagtattaattgctataagtaatattgatattaaaattgatattattaattgcgataagtaattttgccccattccacataatatctgtgatcttgttgctaatacccaggcggggagaggacgttattaatcccaataatccggaaggtgtagacctcccctgtgatattgtccctaatatccaaaggtggagaggaagatatacctcccaatttcgcaggggttgtacaccacccctgtgacattgttcctaatgtccaggggtagagaaaatgacatgactcacaataaggcagggggtgaacaccccgtccatgatattgttcctaatattcaggggggaagagtatgatgttactcccaatatcacaggcggtgtactccccatatcccaggttgtggatagtatcccgatctgtgatagactccgccacgatgtggggagtaatgtcatccccctctccttccctcggtattacgatacacatcgcaggggggcgggcgacccctacgatgcggggagaaaaatcaccccccacccctgatattacgagccacatcgcaggggggtggacacccccagtgatgcggggagtaatatctatcccccttccccatggatattaggagccacatcacaggggcgtggacaccctccgctgatgcgcagagtaatatcaacccccatccctccctgcatgttagcagtcactgaggacacacagtgtatttaccatatttccagtaagatcatcttttcaattgaaccttatgaacaagatcacagaggggtgtacacttcctgcgatactgggggtaatagcgttctctcctccactgcatactgggaacaatatcacaggggtgtgtattcctccttccatattgagagtcatatcatacttgccttccatatattaagaacaatagcaaagaggggagtggacactgtgacgatattaggagtaacatcattctctctacccctggatattagtagcaatatcacagggggatgtacatttcttgtgatattgagagtagtagtattgtcttccccggtggatatgaaaaacaataccacaaggggcgtcaaaccacctgccaaatttgagggcatgttatcctctccgcccccggatattagagacaataacacaggggtaatgtacacccactgcttgatcgggagaaggatcatcctctcccttcttggatattaggaacaatatcacgggggtggggggggggtgtactgcctctgcgatattgggagtaaaactctcctgtcttcccctggatattaggaagtgtatcagagggggagggtgcacattccctgcgatattcaatgtaatcttatgctctccctcccagggtatgaagaacaatattacaggaggggtgtacaccctctgcgatattgggagtcatatcatcctctttcgctctggatattaggaagaatatcacagggctgtgtacaccccctgtgatattgggagtcatatcatcctgtggccctgaggagagaaacaatttctctactgtctcctgtctctgaagaggaggaggaagtaaaagtgggaaaacaacaggaatgaagtcagtggcaagaccagccggtggcactgatgagccggtctgcggtgaaaagattaacccccccttagattaaccctaagcacatgtgctctgaatccatcacggccctttcacgtggaaccccttggagttgtaagcccttaaacgggccaggaactctgtcttccttggaggagctgggttcttaagacaagagtctgtcgatactctcggccgagtaaaaaaacctcttgcttcttgaatctgctgtctgagggacttcgtccacggctcatcctacttcatttcttagtgccctgattgggaatcaaacgggggcagcagcggtaaaagcaccgaatcccaaccactagaccaccaggggaactttgaaccttggggaaaatagattgcccaccattagaagtgggtcggccatcagaaggaagcctggacaggtcccttgcttctaaggtgtggcacaaggtaactggtaaaggacacctagaccagttcgtatagacacttggtgacagctggtgctagactccccacagtggctaagagggcaggcagcggaaatactagtagcaaagggacagatagctaaggaaggatcccgctccacccgcccagggaaatcaactcctgaagctctattccacccagcgtcagaagatgcattgcaggagatggcaccagagatcccagtggtgccctccccttagcagggaaagaggctccccactcttgagcccacagtgcttgcgcctccgcaagacaagcgtatccctaggccacctagagtagacaaggacttgggagaaacccctcccttggcagctcatttacaacccaaaaccgggatccaaatgcccctgagagagcagcggtagactgctatagttgaggatggtcacgtggtggagagacgtgtttttgggtaccagcccttcacctctgctgaccttctcaactggaaaaataataccccgtcctataccgaaaagccacaagctctgattgatttgctccaaactgttatccagacccacaaccccacctgggctgattaccacccgttgctcatgttcctctttaacacagatgaaaggcggagagtcctccaagcagcaactaagtggctagaggaatatgcaccagctgattatcaaaaacccagagagcacataaggacccagttaccaggaaccgacccccagtggaacccacatgaaagaggggatatgcaaagtctaaactgagacagggaagctctcttggaaggattacagaggggagctcagaaggccacaaacgttcacaaggtctctgaggtcattcagggaaaacaagaaagtccagcacaattctgtgcgagactgtgtcaggcctatcgtgtgtatactccctttgatccccagatccctgaaaatcagtgcatgattaacatggctttagtccgtcaaagcgcagaagacatgagaagaaaactgcagaaacaggctgggcttgcagggatgaatacatcacaatgattagaatagctaaccagatgtttgtaaacagggatgcagtaagccgtaaggaaaaccgcaaagagaatgaacgtccggcctggagaaacactgacctgtttgttagctgcagcaatcagaggggccccccgagagaggcaagggaaggggggccctgggacagaaactctgcttggctgtcagagtttgcagtgtaaccagtgtgcttattgtaaagaaataggacattggaagaacaaatgtcctcagctcaacagaaaacaaggtgactcagagcaggaggcctgggacaaggaggaaggggccctgctcaacctggcagaagggttattggactgagggagaccaggctcgagtgtccccaaagagcctctggtcagaaggacagtctgggatagagacattgattttcttgtagataccggtgctgaacaatcgctagtaaccgccccggtcacccccttatccaaaaagactattgacatcatcagagccacgggggtttcagcaaagcaagctttctgcttgccccgggcttgtgctgtaggaggacataaagtgattcatcagtttctgtacatgcctgactgtcccttgctcttgttgggaagggacttccttagcaagctgagagccactatctcttttatagagcatggctctttgctgctaaagttgctcagaatgggagtcattatgactcttatggtcccccaagaggaggaacggagacttttctgaactaagccgggccaagagataagaccagctctggctaagcggtggccaagagtatgggcggaagacaacccttcaggattggcagtcaaccaaccccctgtactcatagaaatgaagcctggggcccagcctgtgacggaaaaacaggacctggtcccgcagagaaactcttcaagggatccaggtccatctcaagcacctaagaacttttggaatcagagttccttgtcagtctccacggaacactccccttctgcatgttcccaagccacagaccaaggactacaggccggtacaggatttgcgcttgcttcatcaagctacactgactttacatccagcagtacttaacccgtacacattgctggggttgctgccagctgagaacagctgcttcacctgcttggacctgaaagacgctttctttagcatcagattagcccctgagagccagaagctgtttgcctttcagtgggaagatccggagtcaggagtcattactcagtacacttggaccaggcttccccaagggttcaagaactcccccaccatcttcggggaggcgttggcttaagacatccagaagtttcccaccagagacctaggctacattttgctccagtacgttgatgactttttgctgggacaccccatggcagtcggatgctccaagggaacggatgccctactccggcgcctggaggactgtggctataaggtgtccaagagaaaagctcagatctgctgacagcaggtaagttccttaggatttactatctgacacggggaacacagcctgggatcagaaagaaagcaggtcatttgcaatctagcagagcctaagagcagaaggcaggtgagagaattcttagcagctgtggggtttgtagactatgggtctcaaactttgcagtattagccaagactttgtatgaggtcacaagggggcggggactgggaaccgtttgaatggggatcccaacaacagcaagcctttcatgagttaaaggaaaaaatgtatgtcagccccagccctggggctacccgttctgacaaagccttttccattttatgtgtcggagagagaaaagatggcagttggagttttaacccaaactatggggctggggctgaggccagtggcctacctctctaaacaactagacggggctcctaaaggatggcccccatgtttgagggccttggcagcaactgccctgctagtacaagaagcaaataagctgactcctgggcaaaacctgaacatacaggccccccatgctgtggtgactttcatgaatactaaaggacatcattggctaaccaatgctggactcaccaagtaccaaagtttgttctgtgaaaatccccgtataaccattgaagtttggaacaccttaaaccctgccaccttgctcccggtatcagagagccctgtcgagcctgattgtgtagaagtgttggactcagttgattctagcagacctgacctccgggaccagccttcggccatccgtagactgggaactatacatggatgggagtagcttcatcaacccacaaggagagagaggtgcagggtatgcagtggtaaccctggacactgttgttgaaaccagatcattgccccagggcacttcagcccagaaagctgaactcattgctttcattcgggacttagaactccatgaaggtaagactgtcaacatttacactgattctcggtatgcctttttaacctttcaagtgcatggagcattctagaaagagaagggcctattgaactctgggggaaaagacataaaatatcaaccagaaatcttgcaatgatttgaagcagtatggaaaccccacaaggtggcagttatgcatcgcagaggacaccagcgagcctccaacttggtgggcttggggaattcccgcgctgactcagaggctcaaaaatcagcatctgcccccttccgggcatcagtcacagcccctctgctccctcaagcacctgatcttgtacctacttcttctaaagaagaaaaggactttctccaggtagagggaaggacaagtgatggaggaaggatggattcagttaccagatgggagagtagctgtgccacagctactgggagctgcagttgtactggctgtgcaggaaaaaacccatctaggtcaggactcactggaagagttgttaggccggtatttctacatcttgcatttgtcagctcttgccaaaacggtgacccagccgtgtgttacctgccgacagcatgatgggagtcaaggtccagccgttccgcctggcatatgagcttatggagcagccccctttgaagatatccaggtagacttcacagagatgccaaagtgtggaggtaacaagtatttaccagttcttaggtctacctactctgggtgggtggaggcttatccgacacgaactgagaaagctcatgaagtaacctgtgtgcttcttcgagatcttattcccagatttggactgcccttatggatcggctgagataacgggcctgcatttgtggctgacttggtacagaagacggcaaaggtattgcggatcacacggaaactgcatgctgcctactggcctcagagttctggaaagttggagcggattaatcggactatcaaaaatagcattattgtcttctccgctggttattaaaaacaataacacaaggggcgtcaaaccacctgcccaattagagggtatgttaacctctcccctcctcctccaccgcccccatatattagagacagcaacacaggggtgatgtacacccactgctttattgggagtaatatcatcctctcccttcttggatattaggaacaataccacagtgcgtgtatacgtctgtcgtgaaattcgatataatgtcatcctgtgcctccctagatatgaagaacaatatcacaggggatgtacaatttctgagatattgggagtgatatcatcctctcccctctggaagttagggacaacatcacaggggtagtgtacaccctctgtgatgttgtgactaatgtcatcctcccgccccctggatattacaaaccatatcacaaggggcgtgtacacacacttcgatattggtattaataccgtcctctccctctttgggtattcggtgccatatttcaggtggggtatacgccacctgcaatattggaagttctattattttctccccccgtggatattagcaactatatcacagggggtgtgaaaaaccccctcgatatttggagtaatatcggtcgtctcccctcatgaatgttaagaacaatatcgtgagggggcttgtacaccccctttgatatttgatatcatcctgtttccccctggatattaggaacaatgtcaggaagggatgtacagaccctgcgacacttgctgtcatctaattgtctctcccctagatattaggaaaaatgtaactggggatgtgaacagccctgcgatattgggaggagtatcatcctttccccccttgcgtattaggaacaatatcacaggtggggtgtactgcctctgcgatattgggtgtcaaattatcctctcttcccctggatatgaggaagggtatcagagggggagggtgtacattccctgagatattcaatgtaatcttatcctctccctcccagggtatgaagaacaatattacaggaggggtgtacaccctctgcgatattgagagtcatatcatcctctttcactctggattttaggaacaatatcacagggttttgtacaccccctgcggtattgggagtaatatcatcctctctccctctggagattaggaagagtatcacagggctgtgtataccccctgcagtagtgggagtgatatcatcctctctccctctggatgtgaggaagagtttcacagggatgtgtgcaccccctgcgatactgggagtaatatcatcctgtcgccctctggatagtaggaagagtatcacatgggtgtgtacactccctgcaacgtggggagtaatatcatcctctgccccctggatgttaaaaagcaaatcacgggggttgtgcacctgctgcgatattgggagtaatatcttcctctctccgcctggataataggagtaatatcacaggggtggtttacatcccctgcgatattgggagtgatatcatcctctctcccccaggatattaggaaaaacatcacaggggggtgtccaccccctgggatattggtgtcaaaccccctgtgatatcaggagtaatatatcatcctctggccctctggatattaggaacaatatcacggggtagggggtgtacaccgtgctatattgaaagtaatatcatcctctcctttagaaacgaaatcacagtgggttgtacagctcgtgcgacattggtagtaatatcgttccctccttgcctggatattaggaaaaatattacaagggggttgtacaccacctgcgatatttggagtcatatgattctttgcccacctggatattaggaaaaacatcacggcgcgggggtcgtggaaaaccccggctattttgaaagtatcatcccctttttccccggatactatgaacagtatcacaggagggatgtacaccttctgcgataatgggagtcatattatccgctccctccctgaatatttagaaaacgtcacagtggggtgtacacccctgcgatattgggagtaatatcatcctctccatccaggaaatgactaacaaggtcacgggggggtgtactccccctgtgatactgggagtaatgtcgtcctccccaaacctggatgttagccacaggatcacaaagggggtgtacacaccctgcgatattggaagtaatacgatcctctccccccggatattgggaaaaatatcacagtgcgggtatacatttcctacgctgttgggagtaatatcattcttttcgtctctggatgtcaggaccaatatcacagaggtggtgtacatttccttcgatatggggagtaatatcatcctctccctgctgggatattaggaacaatatcccagggttgtccaccctctgcaatattgggagtaatatcatcctctgtttccctggatattagacacaatatcacaaaaaggtgtacaccccctgcgatattgggagtaatatcatactctccttccctggatattagaaaacagtatcatcagaggtgaacaccccctgcgataatgggagtaacattttctctttttttcttttctttttcttttttatttatttgtttatttatttttgagacagagtttcactcttgttgcccaggctggagggcaatggcacgatctcggcccattgcaacctctgcctcctgtattcaagcgattctcctggctcagccttccgagtagctggtattacaggcatgagctaccacgcctggctaacttttttttttttgtatttttttgtatttttactagagaccttttttctccatgctggtcaggctggtcttgaactcccgacgtcaggtgatccgcctgcttcggcctccccaagttctgggattacatgcatgagtgaccgcgcccagccagcacttaacatttttatttgacatctgttgaagttatagatttatacacacattgattgctgttttattatacactcgcatatacataagatgggaaatagaaaagaataaaatgggcacagtatccctaaagtttcacgttctgagacattttaaaactatatgctttttagaaacttgtttcaattaagaaactctggtatacacacacaatgaagtattattcagcctaaaaaggaagaaaatcctcttcactgcagaaaaaatgggtgagattgtaggtctctatgttaagtgaaataagccaggcacagaatgacaaatattacatgtcctcacttctttgtaggaacaaaaaagaaaatcttgcccaggtgtggtggttcaggcctgtaatcccagcgttttgggaggccgagtcgcacggatcacttgaggccaggagtttgagacccaccctgccaacatggtgagaccccatctctactaataacacaaacaatgagccgggtgtggtgacgtgtgcctgtagtctcagctactcggaaggctgaggcccaagaagcgcttgaacccgggaggcggaggttgcagtgagcccggattgtgcctgtatactccaacctgggcaacagaaagagactccatcccacacacacctacacacagaaggaatctcaggaaggtggagagtataaagggggttagcagacgctaggaagaaaaggggtgggatggggaatgaagacaagtggataattgggccccaaaatacagaaagatggaataaatgagttctagtgtttgatagtacagtatgaatattttagttcacaagaatttcttgcatatttccagatgctttggtaagaagcttcctaactttctcattatgctggtttttaagctcttctctttctgctcttgatatcgtgctggtttttttgtttttttgttttttgttttgagatggagtttcactcttgttgcccaggctggagagtaatggtgcaatcttggctcaccgcaacctctgcctcctgggttcaagcgattctcctgcctccacctcccgagtagctgggattagaggcatgtgccagcatgcccagctaatgttgtatttctagtagagatgagggtttctctctgtcggtcaggctggtcttgaactcctgacctcaggtgatccacccgcctcgacctcccaaagtgctgggattacaggcgtcagcgactgtgcccggcacatgctgtatccttatctgttgtctgttgttgtttgtttgtttttgagcccagaaataacttctcacctatatgttcaaatgatttttaacatgagtgctaagaaagctcattggtggaaaagcagccttttcaagaaatggtgtcggagaaacttgatttccacatgcagaagaatgaaggtggactctaagtcacaccaggtgcaaaaattaacacaaaccagatcaaagacctaaccccaagcactaaaagtatcatatgcctaaaagaaaacattggccacactttcatgacatcagattgggcaatgctctctgggatatgacaccaaaagcataggcaacaaaagaaaattagattccttggattacatctaaatgacagacacttttgtgcagcaaaatcacggcaaactgagtgaaaagataacccatggattaggaaaaatatttgcaaatcatatatctgaaaagaggctgatatccatcatatataaagaatggctagaactaagcaacaagaaactcaaagcatcccatcaacaatggtcagaagactcgagtagacatgtccctaaagaagatatcacaatggccaataagcatctaaaatgatgttcaaaatcactcatcatagggaagcgcaaatcaaaccaagaatgtgataccacacatcaggatggatatgataaacaaacaggcattggtgagactagagggaagtaggaatgctcgaatatgatcggagggaatgtaaaaccgtgaaggaacggggaaaatagtatgatgtgtactggaaaaatcagaagcagaatgatcagatgttcccgcagttgcatttgtgggtacctaccaaaaacaattagaagccaggagtgtaacacagatttgtgtacacccatattcatagcagcattattcacaacagccaaaatgtggaagcaacccaagggttcatggacagaaaaatggaaaagcacactgcagttcattcataccgtggaagactattcagccttcaaaaggcaggcacttctggccggcgtggtggctcacgcctggaatcccagcatcttggaagaccgaggtggatggatcacctgaggtcaggaattcaaggccagcctggccatcttggtgaaaccctgtctctaaagaaaatgcaaaaaattagatgagcgtgggggcatgtacctgtagtcccagctactcgggaggctgaggcacaagaatcgctcgaacccgggaggcggaggttgcagtgagcccagattgtgccactgcactccagcctgtgtgacagagtgagactccatgtaaacacaaaacaaaacaaagtcaaactaacaaacaaacaaaaaacaaaataaaaaaaaacagacaggcacttctgatgcaggccgcaacatggatgaaacttgaagacattgtcgtcagtgaaataaagaaatcccaaaaggataaacacgaccaggctcagtggctcacacctgtaaccccagcacttcgggaggctgaggcaggcggatcacttaaggtcaggagttcaagaccagcctggccaatatgatgaaagcttgtctctattaaaaatacaaaaattagctgggtgtggtggcacacgcctgtaatcccagctactcaggagactgagacacaagagtcccttgaacccgcgatgtggaggttgcagtgagccgagatcacaccaccgcactccagcctgggtgacagagaaagactgtctccaaaaaaaaaaaaattaaacacggtatgattccacttatctatcaagtgtctagagtagttaaactcatagagttgcaaactagaatggtgacccccaggggtgggtgagagagaggagtggagaggttggagaatgggtgcaatttccattttgaaagataagactctttcagagatgatggcagtgatggttgctaaacaatgtgaatgtacttaatgtcattaaactgtaaactgaaaaagagtggaaattgtaaatgtgtatactggccattctatatgaactaatatatatttataatttttaatatttatacgtggtatattttcccataataaaagatgaaaattaaaacagttggatctttaaaaagaaaagaaagaagcgaataatacacaccagctttctcctgattagaggaagagccccaaagcttctatgcacattcacttttctcttcttcttcttgcattattatgaggaaattcttagaggttggggaacttgagcgactttggctaatgaggagctctgtgccttgagcccccgaggccacagaatagtaaatattcagtctgtgcctccagccctgcagtgtgaggttccagtcctgtgggctccacacccatcacctgtattaggaggctcatgtctcaccctgtcttctggccagccttgaggacggagtctgagcctcaatcgtgcaacacccagggaggacagtggacctgttctctgtggtcatggcccagcagaggggaagggcagttcagtgagtgtagggaaaagaaagagagatcagactgttactgtgtctatgtagaaaggaaagacataagagactccattttgaaaaagacctatacttttaaaaatcactttgctgagatgttgttaatgtgtagctttgccccagccactttgacccaacctgaagctcacaaaaacatgtggtgtatgaaatcaaggtttaagggatctagggctgtgcaggacatgccttgtgaacaaaatgtttccaagcattatacttggtaaaagtcatcgccattctctcgtctcattaaaccaggggcacaatacactgtggaaagcggcagggacctctgcccttgacagtggtatattgtccaaggtttctccccatgtgatagtctgaaatgtggcctcgtgggatgagaaatacctgaccgtccccctcctgacacccgtaaggtctgtgctgaggtggattagtcaaagaggaaagcctcttgcagttgagagagaggaaggccgctgtctcctgcctgcccctgggaactgaatgtctcggtataaaacccgattgtacgtttgttcaattctgagatgggagaaaaacctccctatggtgggaggtgagacatgtttgcagcaatgctgcctttactccactgagatgtctgggtggagagaaacatcaatctggcttacgtacacgtccagtcatagtaccttcccttgaacttcattatgacatagattctattgctcacatgtttgttgctgaccttctccttattatcaccctgccctcctactacattcctttttgctaaaataataaaaacaataatcaataaaaactgagggaactcagaggctggtgccagtgcaggtccttggtgcactgagcaccggtcccctgggcccactgttgtttctctattctttgtctctgtgtcttatttcttttatcagtctctcatcccacccaactagaaatacccacaggtgtggaggggcaggccaccccttaaagtgagtgctgaggggcggtcaggaggcttgttttctttcctcctcatcaggacaaacaggagagtgcggtggacagatgggaggagatcaatgtgcaaactgtctgctcagcagactgtggagtttctgttcttctttgtggtggggtctcagaaatcttattcaaaatgttgctttcctcccccactggttgcctttttcacagacatctcacccatgatagcagggaatgagtccctctaaactattccctcagaacaacaaaaagatgatgaaggtgatgatgaggataaagaggatgatgacagacaccatggcatcatgaacccttactgagggcttcctaaaggccaagctctgagctctgtgctctatgcagcttgtttcatttcatctgcatagtctcccagttattagtgcacatttcatgataattttacagactagaaaaggagcaacgcattttcatagaactcgtaccagatcatgaagtcaaaaagggtgaagtccaatttgaaccaggcagtctaagtccagacacatggcatttggccagtcctctccctgcatccaacctgccctctcaaatccttgtcactcaggcggttgcccctgctcactgtgcccttccctttgggggttccttgtagaccacagctagaccagtgggtgccgcagtcactgtgtcaagtatggaaaggacagctgagatcacatcaaggattccagaaagaattggcacaggatcattcaagatgcatctctccgttgcccctgttcc

SEQ ID NO: 597 - DNA, 207908 bp, Homo sapiens
acattttaaaaggtaatgatcacccgagtgaatttgatgatgtccgagacctactttaagatgcacttcgatgaaatgcagttaaccatgtgctgatcattgctgaagctggtgacgggcttgtgggggttctttacactggcctgcctgcttttgtgtcagtttggtgtccaaccttaaagacgtaactactacaaatattttgagaaatacctacctaagggtgttctgtgccaacatacagaggtagttctagaatctctgctttgtatgtgtgtgtatgtgttttaagactttatttttttagagcaattttagaatcacagcaaaataaggcgcagcgatttctcctatgccccccagccacccccactcagcctcccccgtgatcagcatctcagtagagtggggcgcttgttaccagtggatgaacctatgctgagacgtcgtcacccagtgtccgtagttgacattggggttccctcttggtgttggacattctatgtgtttggacaaatggaacccttggctttaacccctgtgtttcatgacaatgccatttggtgaggttctttgttcattcatctacatgtggtcgagatgcttgtgagccaaagagtcatgctctgttgggtggcaggacaggtgtgtgatgggacctttgcagccagccttctcgatgggagtcccagctccttcccaggagctccgtctctgggcaaatttcccagtccctgtggtttcagctgctttattagaaaatggtcccttctctgtaggattagtttgagcgttaaataagtgaatcgcatgtaagcagatgtgagtgagtgcagctcttgtccctgttttgacaacggattgcgttctctcatgcagctgtgctgggtgatttcaccattgccagctgctggacattagactctgtccagtttttcactggctggacagtgctgtgcctgactcagtgcacttttggggccaccagccccatgacaggtgccctttcctgcactccagcctctaggaccttttggcctttccccagtttgagagctgcaggccccagggtttctctgagttgtcataggcagttgtggctgcgtctcttcctctgtgaatacaggttcctttagcagccaactctggggtcctttcccagcacagatgtccagagagaggcacacggtggctgtgggccttggggggttctgggctccctgcctggtctggcccagcgggtgcctgggatggccttggtgctcctgttctcacctgtactctctgcccccagggaaggctacaacaatccccccatctcaggtgagaatctgattggcctgagcagagcccggcgcccccacaatgccatctttgtcaactttgaggatgaggaggtgcccaagcagccactggaggctgcagcccagacgtggaggagagtctgcactaaccccgtggaccggaaggtggaggaggagctgaggaaggcaagtcctgcgctgcgcctggccccggtggctccagcctctctgttggcttcccgtgtttacccagctgctccctgttcctggctgtggggttggctgcactgacctttacccattccttagtgcatgggaacttctcaccttcagatgccatgtctaaaggctgtgtcggtataagttctacattcccaaggttgaaaatgcttcttagagttcttaagaaaaatatgcgtgcgttgttcagatgtgacataaacgtggagctctgggatccactgagctcttattcttccattcactcattgcagccaagccagtggggcacctagtgtgccaggcccagcactttcttaccgttagaactggaaccgtgctgccaggcagccctccttccccgggcttgcgggtgccgtggagtcctgcgtccccactggcatgagcatcaggttcacaggccactgccacctggagcccggcgcttcccttacgcagtgtgcctgtgggagaccacgtggatgtcttgttgatttccagcagtcactggggcacactgtcagtggctccttattgcccaccaggcacagcccacattcctgacctgaattggctcgtgaggcccgctgccccagccccctggccctctacactccggccacactgacctttgcagtcctccccgggccaggctgtccccttcagccctgacgatgtcccacctcaggcacctgttctgtagattggggcagcatggggaccctgggactctagcatgtgccccctgagccgtactccccaccgcgctgtgggctctatgaggacagcgaccatgtctcttatcgtttgagagacccagccccacaactgcacttggcacaggctgggcatgcagcccaggcttctgagggaagggatgaattagtgagagcaggaggtcctagggccacgccctgtgtgtccagcccctgtcctctaccagctcctctctggaggggccgctggggcccagaacatgttgggagttcagggccgaagggtggaagctgctggtgctcatctcagcctctgcccttggcctccccagctgtttgacatccgtcccatctggtcccgaaatgctgtcaaggccaacatcagcgtccacccagacaagctcaaggtcttgcttcccttcatagcctattacatggtaagtgtcagctgcccacccacctgccttggtttccacccatgtggtccctggtccctgctgtgatgtcttagagccacagtaagagcagccaaccccctatcctggctccccatccttcctgccccacccccatcctggcccatccttcctacccacccctggcctggccctcatccttcctgccctgcccccaacctagcacctcccccgtcctggcacccccatccttccttcccccctgtcctggccccccgatcctagcatccctaagacagcttattaaagccagctagaaaagtttcagctccctgagtccagggcgccctccacagcctgttgggctgcagaacccagcccctgaccacagcggccccatgtcgtcctctacctgtgttgagtggggttcagtgggaggcagatccacctttgatccacaagcatgtaaagacacatgtcattactgaggttccaaaggtgctggttggaaagggatcctccccgctgccaggcctcacagagcattaggggaggccagcgtaagacatgactgtgagggtctgcaacaggcagtaggacacaagaaagactcatttcttctgccttgttggacttccggctcaggagagcgacctgtgctgcttggcgttggcattttattttattttatttattttatttattttgagatggagtctcactctgtctcccaggctggagtgcagtggtgtgatctctgctcactgcaacctccgcctctgggattcaagtgattctcctgcctcagcctcctaagtagctgggagtacaggcgcacgccaccatgcccagctaattttctttttttgcatttttagtagagatggggtttcgccatgttggtcaggctggtctcgaactcctaacctcaagtgatctgcctgtctcggtctcccaaaatgctgggattataggcgagagccactgcggctggctggcattggctttttagacataagccattcaaaagctccgtttagggacagaagatgtctcatcgattaggccagtagtaacattgggcacttaatatgtgccaggaaccatggtaaaggctccacgggcgctatctcatttaatcctctgaaaaaccatgggaggccaggcatgatggctcactcctagaatcccggtacttcgggaggctgaagcgggagaatcgcttgcatccaggagtttgagacgagcctaggcaacataatgagaccccatctctacaaaaaaattaaaaattagctgggtgtggtggctcgtgcctgtagttccagctacttgggaggctgaggtaggaggatcacttgagcccaggaggttgaggctgcagtgaaccgtgattttgccactgcactcagcctgggcaacagagtgagaccctctcccccaaaaaacaaaaacccacaggaaagggtgctccttttccctccatctgacaggaagaccaaggtttggaaaggccacgtgccctcaccaaggtgacagggcctgcatgtggcagagcagggctgggcatccagagccctgtccccagctcctgagctcttctgctgcctcactgtaggctctggcccgtccagggacctgggccttcacctcacctcacattttccccacttttctgtcccagataacaggcccctggcgcagcctatggattcgatttgggtatgacccccgaaaaaacccagatgccaagatttatcaagtcctcgatttccgaatccgttgtggaatgaaacacggtaaaaattcctgaaagctttgcttcctgcctttctctctctttatctttcagtttctagcattctcttttgtagtaagaatcttttcatttggaaagaataaaaaaaccttttgcccccgttgctgagactcttttgaatgcagaatggcgtggaaacgaaagtcctagttctgtgctggccccaccactgaccgcccgtttctgaaccacagtccctcattaagtgactccacgtgccctatggtcctgtgatgcaggccaggcacttgtgagagcatcagtgcccgccctgcctgggaagtgctgagatgtgttggtgaccgcagtggcgtgcttggcagtctggggttgccctctcaggagctggccccatggacccaactcccatctccagtgtgaagccagtgttgtgtgccgacgggccctgtgcccgcccacctgacttgcccgccctcgcctacaggttacgcccccagtgacttgccggtcaaagcaaagcgcagcacctacaactacagcctccccatcaccgtcaagaagacatgtaagcgtgccaggcgccttttgtgggtcatgagtgatttgccaaggaaggcggggcacctggacccagacggggaggtggttcctgggggtcactccagggctctgccggtcattcctcccctaggagggggtgggctggcaggagggcagggcatggtggttgggagagacacctcctccccaccctgcacattccaagcactgctgttgtccccacgcagccagccagcttgtcaccatgcatgacctgaagcagggcctgggcccgtcggggacgagtggtgctcggaaaccagcttccagcaagtacaagctcaaggtgggcgcccctggaggccaggaatggaggggaggacttccctcttggggccgggcaccttgtgggtgacacctggggggctgtgattagggcagctctgcccaccggggcctcggcaccttgcttccttttaggtcagccttcagacactgagggtgagaactcgggtgcaaagccccagggctgtgtgtgttggggacatctggcgaagaggtggtgacaagtctcagggaagtctggcaccagcagctgcatgtggttgtccttctcgagccctttgggagcctgggcccccactgagccacgtgaccactccgggaatgatcggaattgggcacacacaggaggacagagccagagcaggccatgtgggctgcagctgtggcaggagcctcactggctcacgtttccgtcagtgcggttgcccagcgggggttggcggtttccagagctgttcccacattcaggctcccgcaagccgctccacagccctgggggaggccgagaagggggcatcccgcacggtggaatcacctgctgagggagtgggtggcagagatgagtgcagcagagacgggtgatgcgagggacttgctgtcccccagtgtctggggccctgcctattttctaggttttttagacctttgctgccttcccagtgaggggcgatcatgccacagcctgtgcggccttccttctcgaggcctctcctaggaggccgttatccttactctagaactacatggctgggtacggaaaggagagagcaaacactcactaagccctgcttttcccagaaaagatgtcagggcagcccatagggggacatagggtgacaaattagcagcagtgggtgagggataaggtcagagtgcaggagggcacagagagcagagcccggcacaaggctagtgccagccccatgccatgggcgccatggcctgctgcacgggcgggctcaccgtttccagtggccccaggagggcctgggtgctcctctgcctctcccagagcctcctggggagttggacattgttttttccccaactcctccgtggccttccagcctgtctgcccaacctgctcctggtgaccagccagctccctggagagaccccatgggagcctacatggagtctgcaacactggcagccccagggctctggctcaccttccctgtctctctccccctttgtcaccaggactctgtctacatcttccgggaaggggccttgccaccctatcggcagatgttctaccagttatgcgacttgaatgtggaagagtacgtatgggaggggccctgagacactgaggggggcccgtgggacccagggaccaaagcggtctctgaactcttccacttcacgtcggccttcatctccggcaagagcactcgcctgtctgggagtttggtgctgccgagagccctggcatgctggtggccctcgtagaggcggtgccctatagaaagccgtggctccaagctgcgcagagacagttcttactgttatgtccttgctcctcttccactgtccacataaaggccccatgaggtggttctcaatcccaggacccatcagatcccagaaaccttttatcgacttgttctcagtgatgtttaaagaattgcagggaaagggcactcactgggatgagaggagatgggaacacatcaaatacatcttgaactctgctgaaagccatggttcaccagaagcatgtgcagtggtaacacggccagcttcatgtgtgtgaggcggtccagggagcacacaggtttagggccccagctgggaacacacagcttgtgtttccagttcctctctgtagacttcgctcacggggctgcctttgatctcagtacagctctgcctctggcaaaaaccaacactggcatctcttagcagagacccgccctgggactttatgtcccaaccctctccccacccccaggttgcagaagatcattcaccgcaatgacggggcagagaattcctgcacagaacgggatgggtggtgcctccccaagaccagcgacgagctcagggacaccatgtccctcatgatccggcagaccatccgctccaagaggcctggtaagagccgcttggggtaaagggggtccaggatgcctggtgatctcctttgagacagaggtgtccctaaggggacccattcctgggaaatggcacccaggtggcatcatcttgcccctggccctggtgggaggaggacattgtgagccagagcccagcccaggtgctggcatcaccccagctgcccagaggctgcctcagccgaggccctcagccctgcggtccggggcaggagacaagcccagaggggctgggtgcagcagcctggcactgccatcggggcctccacctgacgccctcacaccagcccatgtctttcagctgtgcatgcgcaggctctgcctctgtcttcttcctgttctgtgtggcccagccccttcctggaaccaggcagccctggcaggagtgagggccagctgcagggaaagtgaagggggcaacacctgccaggctgtgggtctcacgaggctcgggggagttataagaggccccctctctcagggaactcctcccaggcttggggaggaggcatcctggacccagccacgccccacagatctgaccgaagcaggggttcttggtcttgcttggaacccagattcagccccctttgggaatctaatcaagggtgtggaccctttcccagagaaaatggtgtgttcactcctgagggtccatgggcccttgaagctgctcatggctcccctgctgcaggattcccctgggtgcccgtcaaactacagcttccctggggggcctccaccccatacttacccaccagcttcttaagagctcgagctcggacccttatagtagtaaacaggctccccagagcctggtggcctttctggggccacccggcagcctgcatgggacacccatggccttgtctcctccggccccagctctcttttccagctcagccaaggctgatggcggaaaagagcagctgacgtacgagtctggggaagacgaggaggatgaggaggaggaggaagaggaggaggaggacttcaagccatccgacggcagtgaaaacgaaatggagacagagattctggactacgtgtgacagggcccaaggctgggcctccctgacccggccagactggtgtctggcctaatgagggagccggggctccccattgccacccacagtgcccggaatggccctaggaggccctctgaggagagctagagtcccagcaaagggtgcagctgaccctagcactggctgtgacatgctgcttggtgctgcctctggtcctgaggggttagggacatccccaaagggtataccctggctctgccacccatgaaccagcccagcatccagccagtgagtgggcacccaatgcctctcaggatgagaccagtaaatgccggaggtggagctgggcagctgtggagccccaggccacaggccagtctcgcttggctctcatgactgtggtggtggagatagcgtggggagcctcgcccatggtctcacgtggcaagaagtgcctttagctctggatcccaaccgtttggcacagctttggccacagccaggcccctctggaattgtccttattaaaccagtttcccgagaagtcttggtttcttggtgtgaatgttggcgctgcaggggagtcttcttattgccttggggcttgggccccctttgtcccttcatatattccttcattcattccttcattcattcagtgacatgctggcagtgctggcctgtgcccccctcacatgtggtcgggttgggtgagggcagctaggaggactccaggcctggggtcagttcttctctaaatgaataccttcttgacaaagtcatgggaaacgggccctgctgtcctgtggctgcccagtgtgaaactagtgggtcctgagcccaccgagcctgcctgcctggccccgctccccatgttgcccttggctgaggcacctcttgtgtctccccaagtcggcagcagcactccctcccaacctgtgtgcgtgccgagtatttgttgaagaaacagtcagttgtcagagaatggccctgttctggattggctggttgcttctgtgtggtgctgaacctgctcctctctcccctgtatttcctggggacaggtggaggctcagccagattcgggttcaaggtctcttcctaggctgcgtcagtctgcatgcacgggaggtctgcttactaggattgaccagcaggtttaggtgttgtcagcctgatgtgttggtcttttatctaacggtttttgggtttctgtggttttttgtttcatttgtgggtcttttttttttttttgagatggtcttgctttgtcacccaggttggagtgcagtgatgcaatcagggctcactgcagcctcaacctcctgggctcgggtgatccttccacctcagcctcctgagtagctggaactacaggttgtgtaccgccatgcccagataatttttgaatttttgtagagatgaggtctcactaatgttgtccaggctgggctcaagggatcctcccgcctcagccttccaaagtactgggattacaggtgtgagccactgcgtccagcctatttaatggcttttgaatagccgttgataattgcctggacctactacttccttaagggtgcaaaatggtgatttttttgaattatatcgttccctctgcatttagtagctggaatcctataaaggaatcttcctcatcgtctgtttgattaccctgaaatactattttcacagaaaagaagggaaaatgcctgttatcacctctaacagttttcagaacaatgagttagtgccctggcaagggccagtgacagggcaggagggggtggagagcgtgtttcctgggctgcctggtgaactctcacgtctgtcaattgcaggcttgctttttcatgcccaacttgtctatctttgcccagaggcggcctcaggttgacctctgtagtcctttgacacaagccttgggtcttgggcaccttccttacttacagctaccacgatgctgcaggctccagcccctccctggcatttcctgttgcggacccggcccaaccatctccccagggtgcactcagtcggtgtgaatatggtgtttagagaccccagtctggtcaccaggggtggggcttgctcctgggatttcgttactgctagggctttggaagagacagagccaggaaataagttttttttttttttttttgccaattttaaaaaaataaagtatgaggctgggcacggtggctcatgcctgtaatcccagcactttgggaggctgaggcgggcagatcacttgagctcaggagtttgagaccagcctggccaacatggtgaaacccagtctctactaaaaatacaaaaatcggctgggtgtgatggcgcacgcctgtaatcccagctacttcagaggctaaagcaggaggatccctcgaacccaggagttcaagactgcagtgagctatgattgtgccactgcactctagcctgggtgacagagaccctgtctcaaaaaaacaaacaaacaaaaaacctctgtggactccgggtgataatgacatgtcaatgtggattcatcaggtgttaacagctgtaccccctggtgggggatgttgataacgggggagactggagtggggcgaggacatacgggaaatctctgtaatcttcctctaattttgctgtgaacctaaagctgctctaaaaatgtacatagatataaactggggccttcctttccctctgccctgccccagccctcccccacctccttcctctccctgctgcctcccctctgccctcccctttcctccttagccactgtaaatgacactgcagcaaaggtctgaggcaaatgcctttgccctggggcgccccagccacctgcaggccccttatttcctgtggccgagctcctcctcccaccctccagtcctttccccagcctccctcgcccactaggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccactgagtgtctcggtgagggtgacctcacactggctgagcttaaaggccccatctgaagactttgttcgtggtgttctttcacttctcagagcctttcctggctccaggattaatacctgttcacagaaaatacgagtcgcctcctcctccacaacctcacacgaccttctcccttccctcccactggcctctttccctccccttctgtcactctgcctgggcatgccccagggcctcggctgggccctttgtttccacagggaaacctacatggttgggctagatgcctccgcacccccccacccacaccccctgagcctctagtcctccctcccaggacacatcaggctggatggtgacacttccacacccttgagtgggactgccttgtgctgctctgggattcgcacccagcttggactacccgctccacgggccccaggaaaagctcgtacagataaggtcagccacatgagtggagggcctgcagcatgctgccctttctgtcccagaagtcacgtgctcggtcccctctgaagcccctttggggacctaggggacaagcagggcatggagacatggagacaaagtatgcccttttctctgacagtgacaccaagccctgtgaacaaaccagaaggcagggcactgtgcaccctgcccggccccaccatcccccttaccacccgccaccttgccacctgcctctgctcccaggtaagtggtaacctgcacaggtgcactgtgggtttggggaaaactggatctccctgcacctgagggggtagaggggagggagtgcctgagagctcatgaacaagcatgtgaccttggatccagctccataaatacccgaggcccagggggagggccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggagaggtcaccttcttcttgggcgagctcttcttggggtgctgagaggccttcggcaggtcatcacgacccctccccatttccccaccctgaggccctctggccagtctcaattgcacagggatcacgccactggcacaaggagacacagatgcctcgcaggggatgcccacgatgcctgcatgtgttgcttctggttcctttcctccagttccaaccgccgcactctcccacaccagtgtgacagggggcccatcaccctagacttcagagggctgctgggaccctggctgggcctgggggtgtagggccaccctgcccttccccacctggaacctggcacaggtgacagccagcaagcaatgacctggtcccaccatgcaccacgggaagagggagctgctgcccaagatggacaggaggtggcactggggcagacagctgcttctcaacagggtgacttcaagcccaaaagctgcccagcctcagttccgtcagggacagagggtggatgagcaccaacctccaggcccctcgtgggggtggacagcttggtgcacagaggccattttcatggcacagggaagcgtggcgggggtgggaggtgtggtccctagggggttctttaccagcagggggctcaggaactgtggggacttgggcatggggccatcgactttgtgcccagccagctaggccctgtgcagggagatgggaggagggaaaagcaggccccacccctcagaaaggaggaaggttggtgtgaaacatcccgggtacactgagcattgggtacactcctcccgggagctggacaggcctcccatgtgatggcaaacaggccgacaggagacacggctgttgctcgtcttccacatggggaaactgaggatcggagtcaaagctgggcggccatagccagaacccaaacctccatcccacctcttggccggcttccctagtgggaacactggttgaaccagtttcctctaagattctgggagcaggacacccccagggataaggagaggaacaggaatcctaaagccctgagcattgcagggcagggggtgctgcctgggtctcctgtgcagagctgtcctgctttgaagctgtctttgcctctgggcacgcggagtcggcttgccttgccccctccggattcaggccgatggggcttgagcccccctgaccctgcccgtgtctccctcgcagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaaggtgggagtgggtggtgccggactggccctgcggcggggcgggtgagggcggctgccttcctcatgccaactcctgccacctgcagggaccctgaaggccaagaacttcaagaagagatgcctgcaggccaccatcacccaggacagcacctacggggatgaagactgcctgtacctcaacatttgggtgccccagggcaggaagcaaggtctgcctcccctctactccccaagggaccctcccatgcagccactgccccgggtctactcctggcttgagtctgggggctgcaaagctgaacttccatgaaatcccacagaggcggggaggggagcgcccactgccgttgcccagcctggggcagggcagcgccttggagcacctccctgtcttggccccaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtgcgtgggtgccttcggccctgaggtggggcgaccagcatgctgagcccagcagggagattttcctcagcacccctcaccccaaacaaccagtggcggttcacagaaagacccggaagctggagtagaatcatgagatgcaggaggcccttggtagctgtagtaaaataaaagatgctgcagaggccgggagagatggctcacgcctgtaatcccagcactttaggaggcccacacaggtgggtcacttgagcgcagaagttcaagaccagcctgaaaatcactgggagacccccatctctacacaaaaattaaaaattagctggggactgggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggactggggcaggggcaggagaggtgcatgggcctgaccatcctgcccccgacaaacaccaccccctccagcaccacaccaacccaacctcctggggacccaccccatacagcaccgcacccgactcagcctcctggggacccacccactccagcaaccaacgtgacctagtctcctggggacccaccccctccagcaccctacccgacccagcttcttagggacccaccatttgccaactggggctctgccatggccccaactctgttgagggcatttccaccccacctatgctgatctcccctcctggaggccaggcctgggccactggtctctagcaccccctcccctgccctgcccccaggtaactatggccttcgggatcagcacatggccattgcttgggtgaagaggaatatcgcggccttcgggggggaccccaacaacatcacgctcttcggggagtctgctggaggtgccagcgtctctctgcaggtctcgggatccctgtggggagggcctgccccacaggttgagaggaagctcaaacgggaaggggagggtgggaggaggagcgtggagctggggctgtggtgctggggtgtccttgtcccagcgtggggtgggcagagtggggagcggccttggtgacgggatttctgggtcccgtagaccctctccccctacaacaagggcctcatccggcgagccatcagccagagcggcgtggccctgagtccctgggtcatccagaaaaacccactcttctgggccaaaaaggtaaacggaggagggcagggctgggcggggtgggggctgtccacatttccgttctttatcctggaccccatccttgccttcaaatggttctgagccctgagctccggcctcacctacctgctggccttggttctgcccccaggtggctgagaaggtgggttgccctgtgggtgatgccgccaggatggcccagtgtctgaaggttactgatccccgagccctgacgctggcctataaggtgccgctggcaggcctggagtgtgagtagctgctcgggttggcccatggggtctcgaggtgggggttgaggggggtactgccagggagtactccggaggagagaggaaggtgccagagctgcggtcttgtcctgtcaccaactagctggtgtctcccctcgaaggccccagctgtaagggagagggggtgccgtttcttctttttttttgagatggagtctcactgttgcccaggctggagtgcagtgtcacgatctcagctcactgcaacctccacctcctgggttcaagtgattctctgactcaacctcccatgtagctgggactacaggcacatgccaccatgcccagataatttttctgtgtgtttagtagggatggagtttcatcgtgttagctaggatgatctcggtcttgggacctcatgatctgcccacctcggcctcccaaagtgctggaattacaggcgtgagccactgtgcccggccccttctttattcttatctcccatgagttacagactcccctttgagaagctgatgaacatttggggccccctcccccacctcatgcattcatatgcagtcatttgcatataattttagggagactcatagacctcagaccaagagcctttgtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaaacctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcaggggaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaaattatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctgtcggtgtctttctttgctcccaaggctaagctgcaggatctgcctggcaattgcaggcttgctttttcatgcccagctcatcttatctttggccagaggcggcctcaggttgacctctgtagtcctttgactcaacccttgggtcttgggcaccttccttacttgcagccaccatgatggtgcaggctccagcccctccctggcatttcctgccatggacccggcccaaccatctccgcagggtgcactccttcgtcggtgtgaatatggtgtttagagaccccaatctggtcaccaggggtggtgcttgctcctgggatttcgttactgctagggctttggaagagacagagccaggaaataagtatttttttttaaccagtaaaaaaaaaaaaaagtatgaggccgggcacagtggctcacacctgtagtcccagcactttgggaggctgaggcaggaggatcacttgaggtcaggagttggagactagcctggccaacatggtgaaaccccatctgtactaaaaatacaaaaaattagccaggtgtggtagtgcgcacctgaggtcccagctgaggcaggagaatcacttgagctcgggaggtagaggctgcagtgagccgagatcgcaccactgcacttgagcctgggcaacagagcaaggcaccatctcaaataataataaaagtatgaattcatacaggtatttcccagttgtaagactgtcaggttttacttctctcattttacacttgtttctttctccgcctatgctgaaagtctgggttcgacagcaccaacataattgtttatgttctttttcctataacatacatatgctagttttgaaatataagatataggccgggtgcagtggctcacgcctgtaatcccagcgctttgggaggccaaggcaggcggatcacgaggtcaggagatcgagaccatcctggctaacacgatgaaaccccgtctctactaaaaaaatacaaaaaaagttagccaggcacggtggcgggcacctgtagtcccagctactcgggaggctgaggcaggagaatggtgggaacctgggaggcagagcttgcagtgagctgagatcacgccactgcactccaggctgggcgacagagcgagactccgtctcaaaaaaaaaaaaagaaatataagatattgcaataaatcatatgagttacatttaaagtacatgaatttaaataaattataaattatataaagtaatatatgataaaatattaagactactaaggatcatttaagatcgttttgctcattctccttaaattatcccacagaataaacaattgtgcctctaggtcccttaagtaactctgtggttacttaattggtagattaagccatctaccgatacacagttagaagtttggggtttttttaatcatgcagatgtagacactgaccaaagacttcttgttttttcctttgagactgagtttcgctcttatcacccaggctagggtgcaatggcatgatcttagctcactgcaacctctgcctcctgggttcaagctattctcctgcctcaggttcctgagtagctgggcctacaggcgtgcgccactacgttcggctgattttttttgacttttagtagagacagagtttcaccattttggccaggctgatcttgaactcttgacctcaggtgatctgcccgcctcagcctcccaatgtgctgggattacaggcatgagccactgtgctcagcccctacctaggacttttaagcggatgtttctctgcctgaaaacaaagtttaagtgttccttttagagcaacctgtaaacagtaactgtagaccctgatatttattgtgccatgaacttctcatccatagttttgctgagtgaaggtattgatgggaaatgtgaaattcagagaggcaggcacgggcccaggccacacagctggggagcggcagcattggttgggacctgtgttggatttgcaattctgccttgtgtgatgtaacctggacttcattaaaattaaaaatttctgctctgcaaagacactgttaggaaaacaaagacaagccacagactgggaaaacattagcaaaagacatccgataaagcactgttatccaaaaatatacaaagagcttttaacactcaataaataaaaaaaaaacctgattccacaatgggtcaaaggcagacacctcaccagagaagctatacaggtggcaaataagcatctgaaaagttaacctaggttgggtgcagtggctcacacctggaatcccatcacatgcggcggccaaggcaggaggatctcttgaggctagttaattcaagaccagcctggacagcagagtaagaccccatctgtatttttttcaaaaagatatccacatcatatgttgtcaggaaaacgcaaatttaaacagtgagctaccactgcatacctgtaagaatggccaaaatccagaaaattggccaaacaccaaatgctgatgaggacgtggagcaaccagaactctcattcagtgctgttgggaataacaaacggtacagccactttggaagacagtttggcagtttcccaaaacataatgcctatttcttccatgtgatccagcactctgattccttaagatttactcaacctgcaaacagatgtttatagctgtaaaccaaagataaaactccaagcccggcagctgactgaatggaacgccctcttggccagggaaacccaaagggacctgaaggttcaggccatgatgggcagtaggggtcggacatgcctcatcatactctcttccctttggaattcaggcacagctgaccagctttaaaacagagatcttaagactgacagaacagactctgtagaaataagatataaaattccaacctgactgaagtatagcatcacatgacagatagcaggtcatgaaacaaattgaaatattttaccccaaaatgtatttctttgacgtattttggaatggccctgcacagctgtctcttgtggaggaaatttgcattctgtagagaatctccttcccttaccaggtcatttctgaagagtccagcaccctttagaggtctgagaggaaacatttgccatctattgtctctaagggaagccatctatgagatttcatctacataacaaaaatcttggaccaggcacggtggctcatgcctgcaatcccagcactttgggaggccgaggtgggcagatcacctgaggtcgggagtttgagaccagcctgacgaacatggagaaacccaaactctactaaaaatacaaaaatttagctgggcgtggtggcgcatgcctgtaatcccagctattcagagggtggaggtaggagaattgcttgaacctgggaggtggagattgcagtgagcagagatcatgccattgcactccagcctgagcaacaagagtgaaactctgtctcaaaaaaaaaaaaaaaaaaaagaaagagaaagagagaaagaaaagaaaagaaagaaagaaagagaaccttggtcttcacaactttttaacttaaccaagatcctcctttgtattgattccagggtttttgataataactctttcaaccaattgctaattagaaaatctttgaattcacctgtgatttttaagccatcccaaaccctctcacattactgatttatgtcttatgtccccctgaaatgtataaaaccaagctgtaactcaactgcctggggcacatgttctcaggaactcttgacaccatgcctctggttacagtcaatcatatttggctcaggataaatctcgtcaaatattttacagtttgggttttttggtcaacatagcagatgtttatagtagctttatccatcattgccacaacctggaggtaaccaagaagtccttcagcaggtgaatggatacaatacatccagacaatggaatctttttcaggtctaatgttgcgggacgcagaggactagagagaccagtacaggtgaatacaggaggatatttattttaaggtatgcaccagctcagtggattcacatccaaaaaggtgagccttgaacaaagacagagtggggtttttataagcaggcttacaaaagaaaaacaaaggcagtcaatcatagagtgtataacttgtggtcttgcctagctggtggccttgtagctgtgtcaaaagaaaaacaagaactggctaaatacaaatatttgcaagacatagtcatgcttaagaggccagggaaaggagtaacagtaaaggaatttgtctttctctctttttttcctcagccttgctctggaggtggggggctgtctggagctcattcctttggccttggctttttggacagcgttatcttataactgtcctcgaagtgagctgctaagcagaggaaaacttgtttctttttctttttaaccctcactacatttttccccacttcaagtccttttataaaagaagtttaatagaaggcctcactattacttaattctgcgtcaagagacaagttttcttctttgggcaaaggttgatatttatgcagagccgtcagctgagtggtagtttgcctagctactattgcctctatagctgattgaatgcttctagcaaggagaggtaagagacaaaggagtattaggcaacttcctagtacagccagaactactgctattaaagtcttgaaccctctgaaaaatgaaaaccagtctccaaagagagaatctggagaccaccctttccaagtttgaactggaacatgggcgaattttctcattcttgcagttattcctataattgcctttccattgtcatcaatttccaggcagcaattagttcgattgaactttccacatcctcctccttcctgggcgaggaggcagtctaaagctaatctattttgatagatagcattcctcatttttgtagattgctgggctaatagatctaaagcccttgctgtttaattagtgatgatctcaagcactatctataacctcatgatgcagttaagcatgtaaataggagaccagtaaccccatgagccatcgtcccccaccaggtagctggcccatagtagtgaattattctctcagggggccattcatcatctttccagtcccctatggctgtgtctttctttacgctccttctatatctttctctcttctcatcatagacaggatactctaaggcttctccttgtcttagagggattaagaagaaagacggcctaattgttccaagtacacaggcccctgtccatttggctggtagctgtcggtaggcccgtggcccacagatccgatagagaccagagggtgcttgccaggtatttggagcttcaagctgataccaggtgtggtttagagcagagaaacgggagaatggatttggatgaggtggtttgggactatctttgccgcgccataaagtttttcctaattttttaacatgtttctgttccaaacatgttaattcccctactgggtctgtagaagtttttccctagcaagcaatacagtatttcccgataatagaagtttttaagagccagacgcttgaacttgtgggagtcagtttgcaggaagggtcagtcagagtaaagttattttgaggcattaactcttttgcttcccaaggccattggtctcccatgtttgtccctccacaaacataacatgaggagatgcctaggctgccagcaatgttttcagccatctgagcaaataggtttttggctaaagggggaggctcggcaacttttgatttatgtgctcatagaatgacttaaagactcggaattgctgctgggatgacttcttggtttgagtcctctttatgatatataaatttactttagctttttgactgctgctttgtaatgccatggagtaacctgtagtccatataggtagatccggctctaagatagtaagatttacaggattgcaagtgcttgtcttacagtccggttttgctggcgctttgatgagcaagattggctttagcctcagtgatgatcggtcagtgaactgtgttgtgcggttccagcaagctattgctagggccttggaggggcaaacagggtatgcacatacaattttgtactggcagtttgtacagtaccctgtaggaccagagattgtgagataggttgggttcacggatgttaactgacaaatatcaaagtatatggctatagccccccctggggggtagaggcttggctttgatttataagacttcctttctttgactcagtatgaacctcaaaccaagtcctaggtaaagacttagaaggtcatagcatatataaggctggccatttcctgggtcacaaattgaataggtgatccgattgtaagtacaagttcctaggtgagtccctgtacactcctaataagtatagaataatagagtcctagttatactgtttcctgaccctgtagtgtgtgtacaatggggacactttctaagggtacttattttaacatggtcaaggggggtgataacagcaaaacaatgtacagcgtattcatatccagcaaggacagaagagggccttgcctgggggaggagattgagcacagcaacggaacaatagtaaaacagttagtattataaggaagactactagtcctaagatttctaaccacatttacttgcttgacgagtcctcaagcttcggccgtgcgtagactagtcagcttcgggtgtgtgactagagcggggcttgtctccttaagcttcagccgtgcgttgactggtcagcctcacgagtgaccagagcagggtgatcgtcctcagcagcagcttgttgtcttctcaggatcagctgggttggatgatctgtgtcctgctggctggtccactcgtcctgagctgccggtttcagccgactgtggtggatccaagacataacacctgcaactttaacagcaacgggagtggacaagatgacagtacagggcccaccccatatgggtcctagagaagttggattccactttttaacccaaacagagtctccagatttaaaggggcacactggtctatcaggcttacaggcatcctttcttgtacccagccatggacctcttgcatggctattcctaaagcctgcatttgctttcttaaggttaattcctctagttcctggagatcacctttaatttgacctatgatttggggttggccaactgaacaaaacctcatagggtaaatactcagtttgtttggtgggggtgcacctgtctcggaggaggaccataggcaaaacctgaacttatctcagatgagcttcctggcaatatttcttcagtagctgcttgagtgtccacttcatgcgttccacttttcctcaactatgcagccaataggctgtgtgtaacttccattttatttttaacagtcttgttaaatctcgtactatttcagctacaaatgccggcccattgtctgactgtaaagatagaggcagtccaaacctggggataatatcttttaacagtactttagtcatttgtcgtgctttttctgtcctggtggggaaagcttcaacctatcctgaaaaagatgcaaataaacactagaatataccgatagcttctggcacggggcatttcgtttaagtctataaggaagttttcacaaggcatggctccttctcctgttctgtttcccagaggaggggttccttttctcctctttttgtaacttcatataatagctcagccatcagcgagaaatctggaatccagatacggcagaatcctgctgccttcaacttctaatgtgaccacagactcctggaggcccagtgagaaggagcccggtctgtcctagtcctcacatccttcagctcctgccagcccaatcagattagtatctggttcctctaaggtatggcagcccttggccaatggcctctttgtctcacggccttggccatttccctcattgccttctggacattcatccttccagtgcccccttttttttttttttttttttttttttttgcatctctcacattgatccctctctagccttggtcagctcttaaatccttgtctaacttgacctcttccacgtccacatctgcgtccacatcctctcacatggctaatttctctttctataagggctgctgccaacagatccgcctttttcttaagcctttcatctgcttccttttcccttccttagttctcctgctcctgcagtcggctggcagggctgggcaaggacaaacctgaatataaaattcagtgtgtctgctgcccaccagtcctttatgcttggagaagagagagatgtttctctttttcctctcttctatctattaaacctccgctcctaaagtcctcgtgtttgtccctgtcctaaattttcctggtgcatgacgacaaaccccgggtatgtagaccagacaatgtagccgcttcaagggatttgagtgaggaaggaatgaatcaatggagcccaggggggttttagagcattcaaactattcaggatgatactatggggaccaagggagagctttccccttctccctctgaaggaccactgaaaaatcactgacagattgtctcataggagaaaagcatacatatttgtttaatgcgtatacacgggagcctttgaaatggagacccaacttctcaacagagtacagagcttagataccatcttgaggttccacaaagaatgtgggctcagagcatggccaaaactaggttaggggctgggcgcagtggctcacaactgtcatcccagcactttgggaggctgaggcgggcagatcacttgagctcaggagttcgagaccagcctggccaacatggcgaaactccctctctactaaaaatacaaaaattagccgggtgtgatggcgggcgcctgtaatcccagctacttgagaggctaaagcaggaggatcccttgagcccaggagttcaagactgcagtgagctgttattgtgccactgccctctagcctgggtgatagtgagaccctgtctcaaaacaaacaaaaaaacccctaaatctgtggactctgggtgattatgacatgtcaatgtaggttcataaagtataacagctgtaccccctggtgggggatgttgataatgggggagactgggttggggcgaggacatacgggaaatctctgtaaccttcttctaattttgctgtgaacctaaatctgctctaaaaatgtatatatataaaaagtggggccttcctttccctctcccctgccccagccctctcccccacctccttcctctccctgctgcctcccctctgccctcccctttcctccttagccactgtaaatgacactgcagtgaatatcctggagcacaaagggcatgtctcccagttcagaattacctcctttatttagggcaggttctcagaactagagtagccgggcaaaggtctgaggcaaatgcctttgccctggggcgccccagccacctgcaggccccttatttcctgtggccgagctcctcctcccaccctccagtcctttccccagcctccctcgcccactaggcctcctgaattgctggcaccggctgtggtcgacagacagagggacagacgtggctctgcaggtccactcggtccctggcaccggccgcaggggtggcagaacgggagtgtggttggtgtgggaagcacaggccccagtgtctcctgggggactgttgggtgggaaggctctggctgccctcaccctgttcccatcactgcagagggctgtgcggtggctggagctgccaccgagcgtctcggtgagggtgacctcacactggctgagcttacaggccccatctgaagactttgttcgtggtgttctttcacttctcagagcctttcctggctccaggattaatacctgttcacagaaaatacgagtggcctcctcttcctccacaacctcacaggaccttctcccttccctcccgctggcctccttttctctcctgtcactctgcctgggcatgccccagggccttggctgtgtcctttctttcctcagggaagaccacaagtttgggctagatgcctccgcacccccccacccacaccccctgagcctctagtcctccctcccaggatgcatcaggctggatggtgacatctccccacccttgaatgagacggctttgtgctgctctgggacccgcacccagcttggactgcttgctccatggccccaggaaaagctcgtacagataaggtcagccacttgggtggggggcccacagcatgtcaccctctctgtcccagaagtcacgtgcttggtcccctgtgaagcccctctggggacctaggggacaggcagggcatggagacaaagtatgcccttttctctgacagtgacaccaagccctgtgaacaaaccagaaggcagggcactgtgcaccctgcccggccccaccatcccccttaccacccgccaccttgccacctgcctctgctcccaggtaagtggtaacctgcacaggtgcactgtgggtttggggaaaactggatctccctgcacctgagggtgtagaggggagggagtgcctgagagctcatgaacaagcatgtgaccttggatccagctccataaatacccgaggcccagagggagggccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacgcaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctaccaacctctctgttgttcccattttacagaaggggaaacgggcccaggggcagggagtgtggagagcaggcagacggctggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggacaggtcaccttcttcttgggcgagctcttcttggggtgctgagaggccttcggcaggtcatcacgacccctccccatttccccaccctgaggccctcaggatggacaagcccaaacaaagcaacccccacggccccgctagaagcaaagcctgctgtgctgggcccagtgacagccaggccccgcctgcctcagcagccactgggtcctctaggggcccgtccaggggtctggagtacaatgcagacctcgcaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtggctctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcagggaaaactggaaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccctcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatggtttctatccactgactctcatgggcctcaactttgccaccttacaaaataatttcagcccaaggcctcattaaagaccttcatgtaataatagccaattagaaggaaaaataaggccgagtgcagtggctcgcccttgtaatcccagcacattgggaggtcaaggtgggaggatcacttgaggtcaggagtctgagactagtctggccaacatggcaaaaccccatctctactaaaaatacaaaaattatccaggcatggtggtgcacacctgtgatcccagctactcaggaggctgaggcagcagaatcagttgaacccaggaggtggaggttgcagtgagcagagattacgccactgcactccagcaggggcaacagagtgagactgtgtctcgaataaataagtaaataaataaataataaaaattaaaaataaattagcaatctgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatagagatgagatccagtacatctttggggagccctttgccaccccactccgggctaccggccccaagacaggacagtctctaaggctatgaccgcctactggaccaactttgccaaaacagggtaagacgtgggttgagtgcagggcggagggccacagccaagaagggcctcccaccatgaggccttgttccctcacttgccagtggagggactttgggcaagtcacttaacctccccctgcatcggaatccatgtgtgtttgaggatgagagttactggcagagccccaatcccgtgcacgtgcacagccagtgcccagtatgcagtgaggggcatggtgcccagggccagctcagagggcggggatggctcaggcgtgcaggtgcagagcagggcttcagccccctgggagtccccagcccctgcacagcctcttctcactctgcagggaccccaacatgggccactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccagttccatgccctccacaggggactctgaggccactcccgtctcccccgacaggcaactccgagtctgcccccgtccctgcaacgggtgactctcaggatgcccctgtgcccctcacaagtgactctgaggctgcccccgtgtccccctcaggtgactctgaggctcccccgtaccccctacgggtgactctgaggcccgtgcccaccttgggtgacactgaggctgcccctgtgtcccccacagatgactccgaggaagctcagatgctgcagtcattagtttctagtgtcccatcagccttggtctcaagaggccgagagggtgcaaccccaggggctcccctcccatcttgagctcttcctgaataaaacctcattcccctgtctggcgtctttctttgctctcaaggctaagctgcaggaaggagtggacctcagttacccttacagcaccaggtgggggcccaacctgtgaccccatcacctggcacaatccccaggctctggggcgttgatggtgccatcctcactttcgagtggaggaggtgggcccagggaagttgattggcaggcccaggagtgggagtcaggcacaggtcactccagagcctgcccttccctgaatggaaccaggctgctggctcccagggactagattctgtcccatatggtgggaggggctggtggcagctgcagtcagagagggagctggggtctggcaggctgtggctgcctctggactaggggatcccagccacacccacatcctctgggtgcagggagtgaagtctgtgttctaactggggtctggggaacccgcctgggaaaagaaagggattctgctcctccagccggatgcaagtggaagaaagaataacacatcacaccagaaggttggaagcagaggatggggagggtgctgggcagtaggcgctgggtggtgggcctctggggggtgcccaatggctctggcagagttgacggggcaggggcagagggcagaaggcagagtcaggagtactcctgcctctgctgggtctaagcccaggcacatcactgagcacttgaccagcctgacctcaccatggccttgtgaggtgggtatggtgtacaccctccttttagacgtttatagatatttagaggaaaatgaggccctgacagggcatcacgtgcccaaggtcactcagagcaaggatttgaacccaggtccctgactccaaagccagtgcttggaacaacgttgggggtcttcttccccactcctcacctaccttctaaacaggcactgtggggcagggtggggcttagatgagagaaaattctggaatcctgagcaactttgcctggggggctccgcggtggagggcagcagcacccaaggaccagctagccactctctctgcccctccagcctacaggtgggaggataaggctcagggccgacaagtcctgtggcctcatgcagcagagctgagccgggacgaaccctgtcccctggagaagcaggggacaccctggctggctgtgaccactttggccaccctgggcttcctgggttggtcaaggggtctctggtgtaaaaaggggactccctgtcaaagactgagtgagatggagctgcccggcaatgtgggcctctcccagtgactgtccctgttctcttgggcaacggaagcccgaggatacaatgatgtgtcccttccttggccacactggtacccacagggattattgtgtttctacctgtggagtcagctctcaggcgcctccagcactgtgggagaaacccctgggaccccagtgcttcttcccaacccttgggactggcacccgtctcttgttgagagaaagcacagtcatgtctgtcattcagaaaatcacatccctggatggccaagccacgtcagaagggatgggctgtggggatccaagcgtgttctacctctgggctgcacccgccatccctctgcttcggtttgaatgcttgtccccgccaaaactcatgctgaaatttaatccccaatgtggcagtattgagaggtgctgcctttaagaggtgactggatcatgaggccctgtccccgtagatggattcatccattcatggattcatgggttagtgggttatcatgggagggtaactggtggctttgtaagaggaagagagacttgagctagcatgtgagcaggctcagcatcctcaccacgtgatgcccagtaccgtctcgggacaccagagtccccaccagcaagaaggccttcacctgctgcagcctctctgaggcaggaggagagggaattagggaagccaagggttggggcataagcaaaggaacagcaggtacagcccgttcacataagccagagaacagcaggtgcagcccgttctcataagccagagaacagcaggtgcagccagttctaggcaggattggggagcacacaggccacatcctcactgctgtgataacaagtcaggagcttccacttcaacctctgattgaccctgggccaatcctccacttcagcctctgattggtcccaggctaatccttcatagggtgtaaccaattggaggcctctaaagggcatctggggtgttctttataaaaaccctgagaagcattgcaattgggaggtccttgagccgtttgcttgggcccgctcccaccctgtgggttgcacgttcgcttcaatcaatctgtgcctttggtaagctgttttcttgttgctttgtctttttttttttttttttttttggtggagtttcactctcattgcccaggctagagtgcaatggcacagtctgggctcactccaaactctgcctcctgggttcaagcgattctcctgcctctgcctcccaagtagctgggattacaggtaccggccaccacgcccagctaatttttttgtatttttagtagagacggggtttcaccatgttggcaaggctggtctcaggtacctcggcctcccaaagtgctgggattacgggcgtgagccactgcgactggcctgttttgtctgtcattgtttcattcttttgttactttgtgagttttgttcacttctttgttcaatacaccaagaacctggacaactcagtcaggaccttccatcctataacacctcaacctcggacttctcagccttcataactgtgagaaattccttttctttataaattacccggttttaggtattctgttataagcaacagaaaatctactttaaaagcctccatggcacaggtgagccctgcagtgtgtctgggtgatgcctgcagctgtcgagagggaggagacagctcagagtcacctgcaatctggctcttgccattacagactccagatgatgaagttgaaaatactgacaggctggaggccatctggggtcctgctggctcccagttccaggaagcctggaagagcactggggtgagctcgggccagcgcatgtttactgtcacaggggacatgtttcagcactttcattgtaaggctgtggccttctgtgcttgtggatcctcagtctcagtggccttcctcttccccccaccccaactcctgtgttgcgtgtttaacacacctacgcccaaccgggacataactaaatcctagactgtggacaaagaatacagtcacctcagggggctgcgagctctaaaggctcagggcccagctacccctttaggatgggtcagtaacaacacgactgactctgtaaattggtgatcacctgagactggacctcagcaccacacggacctgtgcttcaccttggccatcgggggagagtatggaggtcttttgctggcaggaatcagcacccttatcctggcaatcagcactcactggccattcatgaggctccagcaggacgagtggccacagtgtgcagggcacaggggatggggctttccaaggtgtttctggatgacatcaatcacacaaggagttgtaggaatgctggcatcctggttcacgggtagacgccagaggatgccaagggtgctgggtagaaagcagaggatgccaagggtgctgggtggtgggccccttgggggtgcccaatggctctggcagagttgttggggcagagtcgggaccacccccacctcttccgggtccaagcccaggcactgcactgagcacttgatgagcctgacctcaccatggccttgtgacgtgggcactgtgggcaggaatgcttatggaatgaggcccactgtaaccctaacacagcatcacaagtctttccccagagagaaaacgcacaggcaatggaaatctatggttaggaacaaagattcccgtctaagaaaaagggtggaccacgggcctctagaagggactgagggggcaaagtcctgcccgtgcactggctaacactcttcctttagcttttcccccccactttccatattgtacattttatctgtttataatttttcttagtgctgactaaattccagagttagaccttgaaatccacaagttcctaattggtggtcaacagaaacctcagcaagacaagcagaaaatgctcctcttcccctaaagctgtagaaaggcagccaccaacctgggctaggaaatggtccttacagatactattttttttttaactgtggtaaaacctatataacaaaactgatgctaatttaactgtttttaagagtagaattgagtgacattagttcgattcactgttgggcaaccatcaccactctctatttccataattttttcatcaccccaaatagaagctctatatccattagctaactcctcatttcccctccctctaacccctggtagcctctatcctttctgtctccatgaatttgccttttggagatatttctcataagtggaattgtaatgttttcaaagttcatccatgttgtagcatgtgtgggcataccataccttttttttttttttttaagaagcggagtttccctcttgttgcccaggctggagtgtagtggcacaatcccggctcaatgcaacctctgcctcccgggtttaagcaatactcctgcctcggcctcccaagtagctgggattacaggtgctcatcaccatacccggctaattttgtatttttagtagagatggggttttaccatgttggtcagactggtcttgaacttctgacctcaagtgatccacccaccttggcctcccaaagtgctgggattacaggcatgagccattgcacctggcctttttatgactgaataatattccactgtatgttgctggcatgcaatggtgcattctcttataaagcattatcttctcatcctttttatttgtgtaaagttggtaggaatgttcccactttcattccaaattttagtaatttgagtcttgtctcttctttgttcatctaaagtattgtcaattttgttctttagaaataaccagtttttggttttgctgattttctctatttttctattctctattttgtttatctctgctgtaatctttattatttccttcattctgctagctttgggtttagttcgctctttttctaattcctaaatgtgtgcggataaattattgatttgagatctttctgcttttttaatgtagtcgtttacagctataaatttcccccaagcactgctttcaatttcaccgcatgctgtaagttttggtatgttgtgtttttgttttgtctcaaggtgtcttctaatttcccttgtgacttccttttagacccattggttgtttaagagtgtgttaagcctgggcgcggtggctcacgcctgtaatcccagcactttgggaggctgaggcaggtggatcatgaggtcaggagttcaagaccaggctggccaacatggtgaaaccccatctctattaaaaaatatataaaaattaaccagctgtggtggtgcacacctgtaatcctagctactcaggaggctgagacaggagaattgcttgaaccttggaggtggaggttgcagtgagctgagatcgtgccacggcaccccagcctgggcgatggagcaagactccgtctggagtcggggaggggaagagtgttaagatccttttgtagttgatgaacaatgatgattgggtgttcatgcacatgcgtgagatgtgtcaccctcaaacccttacgtcggcacgttacccatctgacgtgaaaaagaagagagtgcgttaacttccacatattcatgagtgttccagtttttcttctgctatggatttataattttatcctattgtaattggaatgatactttgtataatttcgttttaaaaatttattgctgggtgcagtggctcatgcctgtaatcccagcactttgggaagccgaggcagggagatcacctgaggtcaggagttcaagaccaacctgcttaacatggtaaaactccatctctactaaaaatacaaaaattagccgggtgtggtggcgggtgctgtaatcccacctactcgggaggctgaggcaggagaagcacttgaacctgggaggtggaagttgcagtgagccaagactgcaccattgcactccagcctgggcaacaagagcaaaactccgtcttaaaaaaaaaaattaagacttactttatggcctaacatatggtctatcctggaaaatgttccatgtacacttgacaataatgtgtagtctgttgttgctggtttgtgtgttgtgtatatgtctgctcagtctaattggtttatagagttgctcaaatcctctttccttatagatcttctgtttggttgttcttatccattattggaaatgaggtattgaaatctccaattgtgtatttctcatttaattatatcaatttttgcttcatacattttgggtgttttaagtgtgtgtatggatacaattgttgtatcttgagaagttgcagcttttgtcagtgtatactgaccttgtcttgttacggttttgacttaaaatctattttgtctgataatactatagccattgttaaaatatactattttcatggaataactttttccaacattttactttcaacttttttgtatctttgtattcaaaatttgtctcagccgggtgcagtagctcacgcctgtaatcctagcactttgggaggccaaagtgggtgggtcacttgaggtcaggagttcaaaaccagcctggccaatatggtaaaaccctgtctctaccaaaaacacacaaaaaaattagccaggtgtggtggtagacacctgtaatcccagctactcaggaggctgaggcaggacaattgcttgaacctgggaggtggagtttgcagtgagctgagattgcatcactgcactccagcctaagcgacagagtgagattccacctcaaaataaaataaaatttgtctctacaggctgggcatagtggctcacacctgtaatcctagcactttgggaggccaaggcggacaggtcacctgaggtcaggagtttgagaccagcctggccaacgtggcaaaaccctgtctctactaaaaatacaaaattagctgggtgtgatagtgggtgcctataatcccagctacttgggagacttgcccaggggtcaagtggcagtgagccaagatcgtgccacttcactccagcgtgggtgaagagtgaaacaccatctcaaaaaaaaaaaagtctatacagcatatagatagacaaagttctaaaaaaatccattctgcccatctttttttttttttttttttttttttttttcctgagacagggtcttgctcttgctctgttgtccaggctggagtgcattggcaggatcacagctcactacagccttgacctcccgggcttaagcgatcttcccacatcagcctcttgagagctgggaccacagatgcacatcaccatgcctggctaattttaaaatttttctgtagagatagaatctcaccgtgttgcccatgctggtctcaaactccggggctcaagccatctccaacctcagcctcccaaagtgctgggattacaggtgtaagccactgcatctggcccaatctctgctttttaattggagaacttaacccatttgtatttatagtaattaatgagaaaacctttacttctgccatttagctgtttgttttctgtatgtcttatgattttcattcctcaattcctccactactgctttttacggatttacttttgtacaattttgatcctttctttgctttcctatatactttttagttattttcttactggttacttttggtattacaagtaacatcttaaacatataacaatctagtttcaataataccaattgaatttaagtagtatacactgctattacacatcttccctctgtcagtcacagattatatctttatacattgtttccattaatgtggatttatagctttatgaattttacctttaaatcataagaaaaaaggatgagttacacaaatccaaagtgaaataacactggctttgctaactacctgttagttatctctaccagtgttctttagtttttcatatggcttcaagttactgtctagtgtttattttagctggaaggactccctttaccatttattgtagggcaggtctactaataaaactcccttaacttttatctgagaatgtcttaatttctccttcatccttaaaggatgttttgcttcttctttcagcactttattttgagaatattttttgagacggagtcttgctctgtcgctcaggctggagggcagtggtgcgatcttggctcactgcaacctccgtctcccgggttcaagcgattctcctggctcagcctccaaatagttgggactataggtatgtgccaccatgcctggctaatttttgtatttttagtagagacaaggtttcaccatgttggccagtttggtctcgaactcctgacttcagatgatctgtccaccacggcctcccaaagtgctgggattacaggtgtgagccaccatgctcagccttctttcagcactttaaatatgtcatcctattaccttctagactccatggtttctgatgagaaatcagctgttaatcctgaggatctcttgtatatgatgaatctcttcttgctgctttcaagattttctgtcttttgacaatttgactaataaatttgggtatggatctgagtttatcctgtttgaaactcattgagcttcttggatatggagatttatgtctttcatcaaatttgggacgttctggaccattattcaaataatctctgccttttctgaactctcattaaatgtatgttggtacatttaatggtgtcctacaagaacctctagttctgttcatttttcttcctttttctttctgttccctggacagaataatctctattgccttatcttccagtacactgattctttcttctgcctgcttaaatctgctgttgaatctctctagtacatttttcttctcagttatacttttcagctccggagcttctggttggtttttataatttctatccctttattgctaatcacccatttgctcatacattattttccatggtttcctttagctcatcaagcatatttaggacaagtgatttaatgtctctgactagtaattttaatgtctgagcttcctcaaggatagcttctgttaaatcctcttttcccctgtgaatgagccatatttttgtttctttgtaattttttgagaactgaacattgagtattataatgcagtgactctggaaatcagattgtctccctcctcaggaattgcttttttgcttattgaaggatgcagtcttctgtgtccatagtgacttttccaggcttatattcgtatttttgccaggcttatatttgtattccttgttgtgtatagtcacgaagtttctgttctgttgtctcttggtcagcctgtgacttgatggagatcctgttaactgttggagttcagcagcatctcccttcaccaagtgttcccctggtgactatgtccgaccaggttccagagtcccaaaacagtttattctgatagttttctttcttccagcttaatcgttgtttctgtgcaaaaactgaaccctggggcctcctactctgccatcttttgtcacaaatgttactttattattattattttttgagacagagtctcacactgttgcccgggctggaggacagtggcgtgatctcagctccctgcaacctccgcctcccaggttcaagcgattctcttgcgtcagcctcccgaatagctgggattaaaggtgcctggcaccatgcctggctaattttttttatttttagtagagatggggtttcaccatgttagccaggatggtctcgatctcctgacctcatgatccacctgccttggcctcccaaagtgctgggattacaggcatgagccaccacgcctggccacaaatgttacttttaaagacagctaaatttcagaaattcttgctatgccttgtgaaagtacctccaaactctagtcccaggagttctgagggctgtctcagcacatttcccagtttaatggtgccaaaaggaacatctgctgtatgaaaggtaaacttttgtgtttccttcagtgtgctgagaagagtggctggcttttcctgtgcataaaataactggataaccctgcaagggtccttacttaaacacggaatgtgagagtctctatctcattttaattaagacaggtaatgaaagaacaaaactgtaatgaccagggtatagtagaaacaggattttaatataatattcaagtctagcatttgctatttacaacaaataaatattgcccctccccaatcagtaaacaaacattttttttttctttttgctttttatacaaatattcaatcaccccacccccaccccaaatcctccttcctcactaacccccgtcttgcatggtctcgtaaagcccaggacgcagtggtgaatggcacttgcagtggcatgagattcaacatcgatgggactcagctgggactgtcctcactcaccgggtgcagagtctggtccatgaagagggtttctctctctgctcccaggggagggctggggtaagcggtgggtgagactccctcactctcagttggccctgatgatggaatctttggtgcagcctgagaaaggctagagtggtgggaggggccgggacccctgcgaaggtcacaggccagtgcctgtgggcatgagagaactgcagtggtcacagtgggtgctctggggtgcccatgggcacaggtggcagtgacccacacctgggaaggtgtcagggaagtgtacagaggtggcgcccgggggcaggcagggcaccatgccatgcccgttggcactgctccttggcaaaagtcagctagtcctctggttccagagagcagaaggcacctaaggcagcgagtggtccacgggaggccaggtcagcctgaccaatggcaggcgtcaatcccagcagcgggagaggttcaggatgaaactggagtctggggtaccctgggctggcaggtgggaggaaggcgcccagctggcctgggccactctggtccataagtgcttggctaccagccagccagaccctgggaggatgccctcagaagatgcccttggcaatcttgagtcctttctgcttcatgcgagggagggtggagctggctccgtgcttgaccttcactcccttggtgaaggtccgcttcttgaggacaaagtcatagttggcggtagagttcatggcatagaagacgttggcgttttcagggatcttcagctctggtggggaggggcagaggggtgatcagggatgctcctgggggccctgcaggatacccctaccgcttgagagcccatacaaggactgtcttgagccacagacctcagatcccctccaatacagctccagaactccaaggacccctctcaatgactcctgcctgaggacagactctgctgaggtcctcacaaaacctgatgactcttgtttaaacagggactgactccagaaccccccggcttggcctgagctggcagagggtcaccccgtcctgcccatactgcagtgctggctgcccacctggaacaggctttctagaatccaggtcacctcccagaatcctgccctactcaggacaagggatccaaggaccaggaaaggacaggcctgccccagggctctggcgcccgttccagggaggcctgtactccttgaaccctggcacccggcaagcacttccttttggctccatttcccaccatctcctctggcccacagcctgctataaaccagagctgggctcgatttgtgctcctgccgacatcgtgtggcttttcgtcatctttaacctctctaggcctcagtcttccttttctgtaagatgggggtcccgcctaccctgcccacctaaccgaaatggtgcaagaagctgccagaggatttagactgtaacttctagggatcacaggagtcattgcttactgtctgggctaatggtgggaggtggtgttcagctcactggaaagaaaacagcgatgatagtatttatagttaacttttatggtgcacatagatgctttatatatacatgcatatatatacacacacatatacatgcatatatatacacacacatatacatgcatatatatacacatatatacatacatatacacatatatacatacatatagatttttacatatatgatgaacacactggctactttcatttccatttgggggatgagaagacaagcacagagggcttaaggagcttgcccagcgtctccaggcccaggataccccactctgagcctgcactggttcttgacactttcccagtttctagaatactgagttggcctcctagtagcctgttctgcttttagaatcacacactcatggattttaacacttgacactttggtccacagctgtcaccattctttgtagagcacatgttttcttgtcttagccagaaagagtcccttccagtgggccacgtggctaacctgtcccagtgaaaaatgccttttctctttgctcctcactgatgtgagctttgaactgcctgttcacgcctagggaagggcacacactggggaggtccagtggttgctggggacagcaagcagacaatgggggcagccagggctgccctgtccacagtgtctacccacactctgctggtgaattttctggggccaaaggcttccaacctggggctggggagtggtgtggacctgccccctctgccatcgccctctggtcttctgacttactccggtcatctgagagaatctgcagcagctcatagtcctccggctcctcctcctccaggttgtgtttgtccatggccttgcggattacagccggagccttatcttggctggtcacctgcatcgcggcgggggatggaccatcagggaaaagaccctggagcggctcccccagagtgcagtggccaaggaccctctggagtcccctcagcaccaagcacaggcactcacagcctctggccaggtgctgggtccggagagggccttgtcacattctcctactccccaagtgaggcctccgtccttctgttccccatgtgaggcctccatggaatgaggaggggtctgtcccagcagtgcctaccctgcttctcctgtaagagactgttccctcctcccacacttccttgagaagcacttgcccctccaggataacagcatcactgagcctggggaacagacagtccctagtccaagccctggaggtaagaaaggaggggccggccaggatgctcagtgtggtcagcataggccaggcccctgctaccttgaccctgagggccagagcacaggcggaactcggacatagggccacaggtgactgcttaatgacaaccatgctagctcctggcaatgaggggtcaggagcgtgtgtgaataatggggcacctgacccagggctggggtacagagggtgggggttacaaatggttcatctgtcgcaggacacctggaggatgaagaaagagcccccaggcaaacccattctgtgagcaattcccatctgctgtctccaaatcctgtctagactctgaccctgctggccccttccagggctcccagcctggttgccacagcggcctcctaaccaacacccctgcggctctggtaccagcccacaccagacagagaagccagccatcattgctcctgtcttcctccccgagaaagtcgaggtcctggcagggctcagggcctatgtggccaggccctggatacttccctgacctcacctcccctacagcaccgccccttcagctcctgggggctttgcacggctgctcctttcctccccctctgccctcaggccagccttgtccctgatcactaccttcttcatttctgtacctggctgacatctgtccttccccgccaactacaaggtagaccccgggagggcagggatggtgcactgtgttcagggtgcatttgccgccagtggagggaggcacccaggccacccccgccggcttaccaggatgctcttgtacatgttgccattgtccacgtccaggctgacgcggatgatacagcagtcgcccacctgctggttgtagagcggcagcgcggagctggagttgcagagccctgagacagagcgcttgtgggtgcgtgtggcagccacgggcgtggtggaggctgaggaggacgaggtgctgctggaggctgagctgatgccggaggtctccggggatgactgtgaggctgattcccagaactgagggagacggtaagatcagcagatcccactgccctgtgggggcaccccaggccagctgccagatggggaaccttctagaagctgtgttcaggatccagggcttcctggccccatgcatggatttggagtggggagatgggaaaggatattggggagaagggcaggcagtcaccttcttttcctggccatcaggagactccgggacgaagctgatgttgatctcctccacgtcggagctagaggagccggccgagtgcacgctgagcgcgtcagcgatgtccccgctgctgaggtaggggccacacctgagctggtcacaggacttggagtgggagctgccactggtactgagctcagtgctgggggcctggcggctgggtgaagagttggcttagttaagggggctccccaaggacacatcccaaccccacagcccctgcaccctgcgcccaaggactgtgcaaagtgctgggacagttgccagtactccattcaccacagccatctgggagagcatttagtatcaccccatttcacagaggaggaaactgaggcccaaaaaggtgaggggactcatcccagtctcagggccagtcagcagcagggtaggattccagggccagcctccctgactccctgagcccaggctcagccctgaagcttctgagccccaaggcagctgcccctaccacccttggccaggcccttactcgctccagcgcttgacaatggctgtgttcttcttggtcctgagggtgttgctggctgactcggatgggggctccagctcgcacgacaggttgtagctatgagcagaggggcagtggtgtgacaaccaggggccatgctccggccttcccccagcacctgcccagaagctggagtcggggtgccccggccatcctcaggcaacaggggctgaggctgaccatgggtcatagctgctggccctctggagctggccccctaggacagcctgcccccactgtccccatttgctgccccggcctcacctctcagtctcgctgagccgctccacggcccggaaccaggccccaaattgctcatctggcgcgatgctgtagttgttgcaggccgactgcagcagcttgatctgggcgatcacctcgaactcctggggccagagggaagcacagggcggtgacaaggccccccgggcagcacaggggccagtctctgggtctttgttcttggggtcccttcctcccctctactcccatccaggccttcctgttctcaaagttgggctcagccactccccaggaggtggtcctggattataacctcctaccctcaccctccagtgggaggggacccccttctctctgtgtccaaatgtcccatgtcccatgaatctaaggagagggtaggagttgaaatgtcctaccctggtgggtctgttttccacccctccccaagtcagggctgcctgcagctgcttaccttcctcctcttctcaaagttgatgagtctgccctggaaggtggacacccaatggccgtcagaaagtgaccccttgaccattacagtctccccacctcatgctgcactatcaagagtgcccaccagggggcagggcacgcacacccctggattgaagccggtgctgggcaccagggcaaggggacatgcgggcagaggcttggggacttcttgtccagcactctcggaggacaatggactgaggccttgggtgagaaggccctgctcagccaccacgtgccgcctgaccgctgagggcctggcttccctctgtgctcagggtcactgcctgagggatgggctgtgtcccactcagccaaaccctgctgcagctctgtgtttgggcagccctggggtgtcaccagcagggcactgagctgtttactcattgctgggacaggtgtggcagcccagcccccagggctcagggaaggtctctcctcccgggccctactccagccccgcccggcacactcacatacagatagtccttcatggcagtgtccagcatcaccaggtcggtgaggaacgtgcccaggtagggaacggtgccctggatgatgccctgtgacattggggtaggaggatgagcaaggcccctcccctgaaggctttctcagcccccagccccaactggtctcacttggaacagctgggggacctctgggggcctcctggggcccactgtctccctggaccccagactccctctagccatctccctggctggcatctgggaaatgccaggttcccaagtcgtgtggcccctggccctccccagccccacacccgcctgagccggctctgccaggcctgtcctttcgtggctgcagctggtcttcccagataccagctgatccaggtgtggctctgctagggtccagaggaggctacctctaatggggcccataggcaccgtggctagagaggaaagggccctcctccctacccccaggccagccccctgcccctccgcggccttgggcactctcaccgtctccttcggccgtttctgggctctcttggggttcatctccagggtggcaaacttggaggtgccctcctgccagggtagaggacagggtcagcaaggccctatcccctcagccctcaggcaccctgacctggggtgctgccagtgtggtcgggttccagggctgaccctgtatcaatactcactagtgtggggtcctgggccggtggcctggccttcctgagcctgcctccccctctggaaagtgcggatgagaactccgcctgctgcatggtgcggtggctcacgcctgtaatcccagcattttggaaggccaaggcaggtggatcacttgaggtcaggagtttaagaccagcctggccaacacagtgaaaccccatctctactaaaaaatacaaaaattacctgggttggtggtgcacacctataatcccagctacttgggaagctgaggcaggagaatcccttgaacccaggaggtggggattgcagtgagccgagatcacgccattgcactccagcctgggagacagagcgagactccttctctaaacaaataaaaaaactccacctgcctcgcagggcctcagagactctgcgctacagtcctgttatggctgcacactcctttctcccttgaaccttccataaggtcagcaccccagggctggcattcctccattttctagatgaggaaactatggccctgagatgggcagtgacttgccctgggccccccagggactcagaacaggctcttctgtcctagccagaggctctgccccatctgcctttacccgtttggtcactgatcagggtaccgtcctctgggcttctcgtgcatgccagggcccccagtggagctgtgccacggagggagagggacaggtgtcccaggagccccctgcgatgctcccctgtagggaactctgtgtgtgtccacgcaggaggggggccctagatgccatttcactgaccgggtatgccaggggcaccaggcagtgacacttgactccctctgaggcctcgtgaatccattagtcactgaaagttctcctcagtcatctggggtatccgccacagctaatggggtgccatgggaagaattctacagggttctctggtcagtgtctcttctcggggcagggtagggaagccacatggggcctccaaatctgcctcccaggtctggccacctggcccctggcatcccctgcagctcctgtccctggggtaggcaggctgccctctccttgggtgtgtagagcagacagaggtagcgtcaggagcctggcctcccggggacagactgggccggtgtgggggcaggagccgcatccccttcccacccagcaggagggaccggcgaggaagccagaggcctgctggtcctgatgcccatctactcctcctggaacctccactgctacccttactgtgtccaattaactggggccctgtccctcaaacacccaggggccaaacagatccctcttcccccttcacgcacacgggaaaggaactttcccagcaagaagcgaatgccaccgcccgccgccccagcccccgccccagcccccgccccagcccccgccccagccccagcccccgccccagcccccgccccagcccccgccccagcccccgccccagcctgccgccactccaccttgatgagcagctcccggctcaatgagtagttgttctcatctgagaagatctctgacagcttctgaaagatccggaaactgtccctgtcagaagggcaaagaaggaaagagaaagctgggaatggtagggaggggtgtgagtgcaaatccgttttattttagagctgaaagaccccagactgcctgaacgcagcacacagggtaccccagagcactaacgctctgcaggtctggggagggggccttcatgttggtgcaacaggaccccattcccgtttccactgagcagctatttccaaaggggtttttttctttttttggagacagtttcagtcacccaggctggagtgcagtggccagatgtcgactcattgcaacctctacctcctgggtccaagaaattctcctgcctcagcctcccaagtagctgggattacaggcgttagccattgcgcctggcacaaaggttttgatttcaattggatgagggttctgtggctacaacacgaatacctgaaaatctctgatgtggctcaacccaccatctgacagcttaggaagccgagctctgaggcagagctgctgccaactcaggtcagtgaagggtccctgccctcagggtttgtggcctcccatgggctcactaagggggtgatgccagccctgtgggaggtccctggtgcaccaggagctcctacagaggcatgcccacctggaaacgtcttcccacgtcttcttcagacggtggatggagttgctctgcagggcagagaggatggcatacagtgacgagaagttcttgaggatccggcactcctggggcgggaagagcaggaggcatgaggtggggctggagctcccagcttgcctggcctcagtcccccttggccaagcctcccctcctaatgagacagacacccagggagtccccagagggcacgcctgcgacccgggggtgacaggaggattttagctcaacccaaggaaagagtgtaaggaagacgtgagcatccaggcagtgggctgggagagtcaaggccagcatgcccctgggaagggtagactggggcctgtacagggccttggactgcagaccacaacctgagaacagatgaagccaaagtgggggcccaggcccctcctctggcataccctggccacctcgatccagtgctccaccaccctggccctgtctggggctttcgtgcttcggttcccgaggcaggtggtgatgacacagttggccacactgttgaactgggtgacagtggcgcggatggtgggcgccaggtgctccttgcccttcttgtcccgctgggaccagatggagcccaggcagtggtagggcaccaccttcttgaacagttcctggggaggaggctaaatgtcacctggtcctgccccagcagtctgggctggtgctggggaagctgaggatgcagcttgagccttgtggggatctctgggttttatcccgtgtccatgcagggtgcccagcacacaagtgacccgggacagaacgctggtgggaagaagaggagcaccgcctcgcgcagcctcaccaagccccagctccaacaggcggctcacgcctgcccaccccccatccccccgcctcagtctgctccccatccagacgcacatctgctgtgggcgctacaactaagggctttgtccagtgtctgccataggctccaggacacaccaagtgcctaatgagtgctgaggctggtgagcctcctgaacagatgggggtgacccatggatgcaccttggtgagcaccctccgctcccacaggccaggcctgctgagcttcctgtctgttccatctagaatctgcacagtcactctggaggataggggtgacctcatctctactgtccagaggtaaactgaggacttggggttaaggaacgacctggttacttggtgtgtagcagcagagctgggatttgaccagaacatcagctctggatcagcaaatggtaggtctgggacagcagatgctgccagaaggcaggcccacccctgccctgccaagctgagctgctcaccgcatccatcagtgtaaactgctctgccaccagatctggagggaacaccaagaggtgaggcttctcctcactcagcccgttctctgcaaccacaggtgaaggccaggaaggctgtaatgatggaactggtgctggagctggctccagctctagagtttgtgagggagctggatcctgttctggagctggctctagttccagagctggcgctggagccgattctagtcccacagctggctctggagcctgctggagctccggagctggtgctggagctacttctagctctgaacctggagctggtgttggagctggctctggctccggggctggagccggcactgggctgggtgctcgagctggtgttagagctagctcgagctctggagttggttttagagctggcactggtgacagagctgcaagaggagaaaagttcaacaacatgccagcctttcctgtgcctttccaaagacacagaacagccccggcttccagagaagcctctctccccgaacccacaaaacgtgtaccaggccactctcctgcctgtggtccctgcctgtgtggtctgaggctcatctgggcccctgacccagcaccagaccctggagcctcctcttcgtgtggcccagcaccgacccctcctcattcaccctctggcacccaccccagtcctcctcaccctcaggctctgcctcaatgggttccgagtgctccagctgggccaggagaaggtgggcacggcgctccaggtctgagcctggcatgttgagctgcacgtaggccaccagctgcttgaggcagggaaagtccggaggttgacagaaatcctccgagtactggtccagccaggtgcccaggatggaggagatggcactggggacaggtgggtggcagcagagtcagaggcctgggctcccctgagccaggctgggctcctgagccggcccctgtccatctgaaggccacctgccccggcccaagcccccttggctgtccagctaaaagaaccaaggaggcccctggtcagtggcgaacacctctcccctcctccaaggaagccccgcccacagctctgcatgtctcccagcaccccctcctcgctggaatgtaaactccatgagggatcggtcctcctgccgggcatctgcaggtccctggcggctcctcaacttgtagctcagtgctggtgagctgccttactctctcagagctgtgtgtgggtctcatcttcccactaatcctgttctcccagagggtggggtgcagcctgcccactgagcactcactattgaggggtgaggcaatgtgagagcagaggctcaccccacctcttgccaggggcccctagatcagggcccactgagccaaggccagctgggatgaggctatggtgggatgagttcccgccgggggctgccccgagccccagccaccccaggacccctccacagctctcggtcgtctttcttcctgcaggcgaagcccccagaccccagccctctagcaggaaccacaagaggtgtgggagccagggttctgcccagccagccccggctccggccccagccccatgtactctcccactgttcggtggggacagggtcccttcctcttggctcaaagctcactcactttttaagttggtcctggggtccaccatcctcgtcggaataggggaggatgcagccgtatctagaggaggccgtgagggcgtcacatctaccgtacctgcttatgacgtctagtgttactgtctgactctccgactagaacggaggcccaggagggcagggatttttttttttgctttttttcatcaaattatattaaatgcctagaaaagggccagcacacagtaggtgcttcatatatatttgttcaatgaataagtcccaaccagctccttcccagctatctgagcgccccttgggtccctccaacagcccccagatagaatccggaatctccttgacaagtgggaaaactgcttcgcccaaggccacatacaagagaggcttggggcagagagcttccccatgggggacaggaaaatcataaaaacgagcaccacagccccgcagcccattccctacagggccaggcgttgagggagcactttccacgcctcatcccgcccaggcatggtgacaaccccatgaggtcctcttagcactccagtttctctttcatatgagcaaagcgaggctcagagaggtgaatcagcattgccaagacccgcagccaggtgggggtgggggcgagggcccctgtgcaccctgtgcagtggagggctcatgctcaccttttgaacagcaggtccaggacctgttgggtggtggtgaaggctctataggtacacaggaagatggtgacgtaggagaggtcgctgccctggaaggctggcaccaggtgctccaccagcttctccagcgtgccagccttcacggtccgcaccttgcaagtctcataaaggttcagggccgactcattctcatactggggtgggacagaggagggacagacagtcagtggcagcacacgaatctcctggagctcagatggaaccccgagccctcagcagcttgtggcaagaggcaggactgagtatctctagcagaaaaaggttatcagctttaaaagtagaatttcaggccaggtgtggtggctcacatcagtcatcccggcactttgggaggccaaggtgggagcatcacttgaagccaagagtttgagaccagcctgggcaacaaagtgaaatcccccagctctacaaaaaaattgtttacaaaacttaaaaattagccagggccaggcatagtagcttacgcctgtcatcccagcattttgggaggctgaggtgggcaaattgcttgagcccaggagtttgagaccagcctgggcaacatggcaaaaccccatctctacaaaaaatacaaaattagccaggtgtggtggtcccagctacctggggaactgaggtgagaagatcgcttgagcccaggaggtcaaggctgctgtgagctatgatcatacctctgcatggcagcctgggtgacagagtgagaccctgtctctaaaagagtgaaaaaatttttaaagtagaatttgaggtgcgggaatgatttaaatactgacaccttcaggtccgttgttagctgagtaatggtagctgccctgtgggaagagcgtcatctgagagctctaacaaaatatccccattctagagatgaggaaacagaggcttatccaggggctgggagggactggcccgttaggacgcacagcatcttccccgtggcactgttttgttttgttttgagacagtcacccaggctagagtgcagtggtgtgatctcggctcactgcaacctcagcctcctgggctgaagcaattctcatgtctcagcctcccaagtagttgggattacaggcacacaccaccatgcttggctaatttttgtatttttagtagagatggggtttcaccatgtgggccaggctggtctcaaactcctgaccttaggcaatcctcctgccttggcctcccaaaatgctgggattacaggcatgagccactgcgcctggctcctgcagcactgttgaagtgtcctcagaggactcacagtggccccacagtcatgaggagctgaactggggcagtggctccagcctcccttctggaatattatgcagctgagtcaggccccggctctcaacctggaggaaccccagggatgtgttctgggagatggcaacttgcagagacctaacagcctgaagcccttttgtccttgggtgaagacagccccactactccagatggtgtgcacatctgggagaaggcatggaggatggtgaggctgatggctgcacacccggggaagggaggtcaaacatgaaaacccgattaagcctgggctggacagtgggggtcgggaagggagtgaaggccgtttcctttgggatcagaactgggggccctcaagtgaaaaagtcctgggagggatccccagctgcgtctcccagtggagaccccgagcgcactcaccccgagccagcgctgccccttgttgcctccgtggtgcagctgcaccttgcgcagggagatggagtagatgactccgttgatcagctcctcaccgatctcctgcgtggagctctgtgaagacaacgcccggcagccgggcgcggggacgtcaagggcctgcctggccaccgtgcaggggatgcacctgtgtaacctgtttcccagatagggcacagactggcggctgcacagacctacagcctggggtggaatgagatcacagctcgagagccactgtcccggcactccacttccccaacccggccagccacgacctgggacgtgattatgatgagtccaccaggcttccaatcccctagtaactggcttctgctcctgcccaggacagacccaccctcaagccatccccttccacacaggggactgttattcagccattgcacagatgggtaaatggaggctgagagaggaacaactggtccaaggtcatgctgcctcgggtaagtggtgaggcagggaccccagggctctgacacggctgactgcatccaggcggctatgccccaagagaaggtccccctacctccccagggccagaggcccatgggcatcctcacactcacccctcctctacccagcctggggggccctggctgacctagcaggaacgcacagctcctctgggcccagccctggtgcgttggcagcccaggtctgggcaggtgtggggcaccccagacagccacatcccagccacttccttcccctctgctcattcatgccctcgtgcctgcttgggcaatgggagttcccagttccctgaccatcatcacgtgaggggacgggtgtgagaggtgacggtgctggtatccaggcagatgctggggttccacagagccctaaaccacaggcctagactggaacaggaagggggcatctggccccaggcagtaaggaaaggccgttgtcttaggagacagacttcccccacctggcaggctggcctaggtcacttagccacaattacccccggcctcacagccccctatgccacctgctctgtccagggacggaatgagcttgcagcgggtagaggagccggggggttaaggacatcaacctcagaggttaggaaggagctaagaggtactggcctggcccagggtcattaaccgcccagtcagtgccccagcccaggtaggcgtggagctcagagaaggcctggcagacagtgctgactcaggcccttccctcaaccccagcaggagccaggtagactgtccagcatgctgtggacgggaccctggcctcctgcctcctgcgcaccctcagaggcccaggagccatcctggaagtccacttcctccgacctgaggtcgcctcccacgctgggctttgtacaacaggaaagctgcgggcattgtgccgggctcctgaccgccaccgcctctggacagagagccagccccatttcttggaagttagcagggaacccacaggcacactcacacccacaccccacaaacagccccgccaggggaggtctggcccttccactgacaggaaaagagacatacgctcaccccccttttcctgactcacacatctctcccctgcctagaaagttgttcctttgaaaagaaaagcattagaggttacagcgaccagggcccccaaccacccgggcctcctcaggggtcccagactgcctcctgtgaaggccgttggctcagctgggagtctctctctctcccagggattttagccacatctggaccagctgggaggcagacagtatcctgagtgtccaagtcaccggcagtggctctgagatctcgtgcaggacaagcccgccacaggggactaaacattaaccctgggggagcccagcacagcacccaggtcctggctgagcaccatcagtgcctgctggacagaggtgtccccaggcaggccaatccccaggaggggctgaagccaggtggcctcggctgtccctgagcaggtctagagagcggctcctccgtgagctggcaggccagcagctggcccagccctgcttggtgtcatgtgatccctgcacccttcccccacccccggggggccctcttctgccagccgggtggtggggaaggatgcaggcccaacactgagagccatgcatgcttggggtaagggagttgccaccctgtcacacagtcggggagacgctctagcccgcgtggagctggcctgtcttctctggtcgcttcccgtcacagcagcagcaggcatggaaccagaccatagagctacgtggagtacaggggctgtttaaaccatctgctcagatggtggaggtgcaggctccagagagagctgccctggggtctgggaacaaagtggcagagtaaggcctctatcccttgccccctcacaggacagagaaagaaagcagccaacagccctggcagctgccccagaaccctctgcagcaagaaaggcagggttccagcacccacaggccaccctaggtcactctgttagcagacagcccatctgggcagcgcctgggccccagggcactctggccgggctgggagctcagagcgggaggagcaggaacggcctagtgaacagctgatgcagagaaaacgctttcccctgagggcaggtgcccaggcagccgctatgagctgactgctaggaggagaaaagaacaccacgtgcttggctgtgtcctcaagggacactcctgtcccacccctagcaggcatgctgatgtccctgggctctgggacccagtcggcagctgtgcctgtaaacacactgtctggccttctaacatttgggtcagtgcagtgagggtggcatggggtccccggtgagcaggggcccccacaccccaatgtctccagggacacagcccagagccctgaagatgaggatgggaaacagggcctggtggtgtctggtgagtgtgtcacctgatcagccttctcagagtgacaggccagcaggatgccgtgtccctggctgacagaaggaggaagccacaggccaaacccagactccctctgggtagaatagtgagggtcttgaggaaccctacggggcctgccccagccctgccatctccccgctcaggccaacggcacctcctcccagcatcagccttctggtgcagctccggactcagacgcctttccttggaaaccgtagctagtggccccctgccccatggatggctccaggaactcaccggcccctcccaaggagacctggctgagggctgaagcggagtgaggagagggctctagcctgcacctcggcctgctccgcccctggtcctccccgggcctgtgtgtggaaaggctcacggcagagcctccgtgtgcgtgagattgtcctgggggacctcccaagcccctctgagctgctgctcaggtcccagtcaccagaggtcaccccggggtgcttgccacccccctgccagcacctcacagttctggcccaccagacagcagctccctgtctctcgctggctctgcccagcccctggccctcggccttggtgtgtcatctggggagggcagcactacctgtcacaggcaacagtgggggtcaagagagaatgcacacagctcggtgaccggcactgggacctgatggcgtggtaccggacaacacctgacatcatatccccctggggccggcgacggatgctgggctgtaaaaacctgagggaaacttgtctgaggcctgcctaaggctcagggacctagccgagggacactgtaaagagaggctgagtcaccctgaaacccagtgggtgggagcagctttctgacttcagctttccgctccaatacagaagccaaacgtaaaacgcatcacagaaggctgctcgctctctacagagcccaggctcctgcgacagtgcggggcccacgctgctgtgcccttctccgtcctacagaggtggggacccatgcccgaggacaggagccggtggggcgtgtgctggctgagccagaggtgagagcccaggacttctcaagtcatgagctcggaccatgagccccatcaagggaggtggaacgcaagggcctcgtgtccgtgtccgtgaccctcctgccctcgggcctgccctccagctccaggtgggtggacccaaccctgatccccagcgcacagacaaagcatcaagatgacaggaggccagcccggggtgtgggtgggccacactcctgatcctgggcatggcagcccacagaggcggcctcagaccgggacgacacgcggtgcctgcccaccaggatgctccctggcctcagaaagtggaggctgggaaccaaccagtgctgagccccgcaaaggccggcccatctctccagaaaccctccctgccggcctgtgccctgctactcactgatgggaaaatcgtgcctcaagcaggaggagggagaaccagacctccaggtcagccgcaagccttgggcatccagggtccctgtccacgcccagcccctgacagtcaggtgaacacagggccaggcccgggaggggcgtggctggtggcagctgaggaggaaggtgggctggtcccaagggggtgcagggcagccccaactttaaccagctacagtgcccagcacatgcgggcacttcctgggtgcaaggccctttggacacccatcacgtttaatcctcctaacgccctgcctgatggacaaggaaacagcctgagaggaactcgcccaggtcaggagccaggacgtggcagccagaacagggatttgaaccctggcctgttgggacccacccaggcctggcgctgcctctgccatggtctcaggcttggagcagagtccagccccttgtggcacagatgtggaggaggggccagagacaggaaggatttcctcaggtcacacagcaaattcgcaggggagggtggcagggccagctttctagcacctgcatctccgagaggtttgtggacgtgccctgggcaaaaggcctacaagacaccaggccagggaagtgccatgctgaaggtgccaggtgacgcacccgaggagcccagggcacttggaagggtcaggccgctcccctggcacctaatcagaaaacctcattgtggcagctgctacctgtccactgtgccaagtgctgtgcaggctgctcctcaggtctcttgtctaactcgagggtcctcaccagaaccctaacaggagagctggcatcatgtccattttacagatgaggaaactgaggctcaggagcacgtctacatctgctagggggctgagctggcatcccagcatagctctcttctctccagagcccaggctccctgcccctcggttgagatggacaaaagtctccaggaatgactacaggggaggctgccaaagcatgcaagcttccccatggaggaaaacgccaaaaccctccaacgcaggtgtcctgccccgcccgccaagccactgttgggctgccatcccactgcctcccccgcccgtgggcagccaaggtgtgcggaactgggagaattgggtctgctcaaagctcagcttgtcctgcatgaggctgcatgcatcagtgtctgccccttaacaatcaaatggggaacactgctctgctgttgctgtatatctgggaacacagtgattctgggcctgcaaggctggaagtccaaccctgggactgggtggccacagcatggtggcaccacgccatgggagccatctgggcggccaaccagcagctcttgggaaccagtccttgactgcctgggtgcagcttcctgaaaccgctccactggctcgttcagagcctgcctgcagagggccagtgataaatctccccactcttttctcattggcaacgcagacaggtcctggaaatgcccaatttccaggttaagaatcagaccccagctctggcaacgagcagcttgatatctcccagggccattcctgagcctcccgggaaacaggccagcatgcctgagcatcccccgcctggagaaggaacaaagacccaggaccagccagcctggtccccctcttctgggggaccctcccgagtagagcaagaggggaacctgagggtcctgggggctgccccttcagagtcacccaggaagctctcctggaagaccacagtctgtacacatgcatgcagggacacacacccacacagggacaggccctttgccttggggtcttcagtgtcaaagtgctcatgagccctggggattaaaccgaagacctgcacacagtgtgatcaagagatcaaacagtgggaagacgcgggaggctgaagggagatgctccctgtgaatacagagaagccctcttcactccagcccacctgcaactgccctcaggccttgggtcagaatcctggccctgccactgaccagcttggtcactctgtgcaatctaattcacctctgttgcctcagtgactttatctgtcaagtgagctcttaacagtcttgaccccaaaaggagatgatgcaaattacttagccaaggacctccccaaaacctgctggctcttattagctgttatcttaaacctgtggggtccagttctgggcttgcttcctccaggtagctctccccagcgtcctgtggcccaaagcacttttgccttcctctgagccataagcttccctactgctcacctgacctcagggcttctgggctgcctgggcttcctctgactcctggtggctcctgcacacagtaggtgccacagagaacacagcccatgcttaaatcctggctgcggcccttgctggctgcacgggtgtttaggtcagagacttcccttctctgaccccctagcttcctagaaggtggtgttggcacctactctgtagggttggtctaaggcagatgaagtgagggggtggcccacaacctgcactttttgtctggccaaagcaacagcctgtccagagatgggggcacggaccaggtcacctccagaaagcaagaactgtgcaggccaagctgggtcattggtggcttggcttagaatcgggaagataagcggaagcccagatgtgaggagatctggcagcccagagggaagcaccgggtggaagctaggtagggaaacagggatgcgggggaaggcagaaactgtctggtggtttccagagaggacagggaccaagtgcgcagcgtcagctctggcaggccacatagacaccaggaaaccagccccaggacggggggtgttggcaggagggacagggacttccccgccccctcccttgggcccttggtaaatggtcattgtgttcagtttccggcagtggcctcctctcctgccaggatcctggttttcctgacccagccagaagcttcccctttgatttctaaatagcagtcgaggtctggatctcagtgctgaggctgggcaaggagcgccagggccagagagagggaagacaagacccccaggcaggggtggggctcagctctgcctctccctcagttcctcagggacggagagagggaacctgcacggccactgtgagcgctccgccggaccctcccagcacacaaagcccgagctgctgccagaggtaatgaaagccagatgagcgctgggctggtgtcagcctcccacccccaccctcccaggggtccctctccagccgccaatgaggaccagagccctggatagatgagggttgagggaacacgtctggtccggccatctgccaagctcaggaggaaagggtctctcaggcgtgtggtgttcccccaccaagagctctgcccaacactgggcggagaaacaagtcgcatccaggccctgtctaggtaccgggacaccaagaggcacgagactcaggctaacaatcgccagcaatcacaacgcgccacagtctaaagccatgaagcgactggagacgcagcaaggcaacacgatgccgcacggggactcaggaggttcactgtgaaggctgcagcccagccaaagctctgatgggccctgagcccccgatccaggaatggcctctgtgcaggccctgtgcccaggcagagcagggcgaggggggcatctctggattccactccctctgctgtgtagtcagcagcagtcaggtgggaggcagatggcaccacccagagacccagggcacacgagaaacaagcccccgccctcacctagtcaccctcccctccatccatcacaggtacaccactcccttctctgaatcctacccagtccttaccgattcagggtgttggcactctttccagttaagcagaaacaagtcttgcccgccctgggcctgggccaccctcctcccctcaccaccaggacatctggtcccacgtgttggaggcctgctgctccaccccatcccccgaccccccccccaccccgctctgagcagccccgatgtccctggtcaccagatccacatctgccccaagtagggtctgtctggaaggcccctatggtctcatcacctctgaggattctaggatttggccttcccgaccacttgttccacacctgcatcgtaaaggctaacgacgcgctgcgggccctgggtgggaactgagtgaaataaggcacaggccaccgatgtaaacagggacagtgccgcagaaaaaggtccacctgggctgcagcggccttggtgacagcaggccctggaacggtattgaggggcgcaaaaccccagccgtggtccctactgttggacggggcgcggcggcagcccccactgcccaccctgctggctgatttctgcagaaggccccgacccccacctatggaggagagaggagggaggcggcccgctgggatcgcccggccccgtccggggctcgccccgacctgcccagctctgccgcgggtggggaggctccgacgcaccccccgcccgaccgccccagctcacccacctccgggcgcggcaggtcggggtctagctgcgtgaagctgtgcagcaccaccgggcagctgtcggggacgcccacctccaggcgcacggcgtcccacacgctgcggctccgccgggagcccggaaacagcggctcggcgccgccagcaggcccggccgcctcggcccacatgcgctgcaccatggaaggctcgcagcgcgggcgcggggccggcccggcgcgcggcgggggcggcggcgcggcccgcgcggctgggctttgccaccgctgtgagcccgcggcccggccctgctgatgtcaggctggggggcggggccggaggggaagagggtggggccggggaggggcggaaccggagagtccgagggacgcgtgcgtgcgcgcgcccgcggccccgccctcgccgaggtcagacccggggcgggaccgggagcctggaggggcggggtctgaacaaagagggcggggccggggaggtcgaggggtgcgcgttggctgggtctcccggaggaccggctgtcacgtgtgtcgtggggccttgggtaccccggttaggcaccgtttgcgtgtcacgctgctgcagtgcgtgtgttgcgtagggctgaaatgtgtacgtgctgatcatgtgtggggaagccgccctggagtcagctaccccgaattccagcaaagcctctccccaactctgtggccttccacaagttgcttaacccctctgagcctcactgtttcttcatctggaaaatctgggtagtgaaaatgacttcctcaaacagttgcggggaggatgacattacgtaatggacatgaagcactcagcactgagcacctgcacctgactacaggctcaggcggagtttggagaggctgaccatgtgttcagtgaccctgtcagtgcaattggaaatcctgagtgtggggctgtgtgtgcagtgggggaaagggtcagagagtggggccctacctttttggggcaaagccccacactatccccttacagacaccctcagaggaggggaagccagggaggtgggggagagcggaaggcaccaaggttggggctgagaggcatctgacaaggaggaaggcatcaagagtgacaacgctgggcagagcacatggctgcgtggcctgtcagctggggctgcttgtggcttggacatccctggtctcagggtggaagtggggctgctggggctgaaggggaagcagggacagggacatcctcaactactctttctggaagccagtgaggaaggaagacagcctggggcttaacagcagggccaggagaatggatgaatgaatgggacccttcctcatgcctcactcatcactgggcctgccctggcctcagccttcagtcttcatggaggccagcaattgctgccagcagccctggccatgccaacctccccaggtctggtccgtactattgggcctcagtttctccatctgtaaactgagagggcgggaccagacagcacattccacgagcacatcttgcccccttcccaagtgccaatcctcagacacccacgaaacacttccactgtgactggagtgaggcggcagttcatccgttcagaacaagacccccatgtgcacacgactagaagggcctacttcacaaaaattatggtggtaagttgcagctgggtggaagctctactggttttcattttacttctctgaatttctaatttctaaaatcagtattttaataatcagctctatgtgataaatgctgtttttgagacagtctcactgtcacccaggctggagtgcagtggtgtgatctcggctcactaaggcctccgcctcttggggtcaagtgattttcctgcctcagcctctcgaggagctgggattataggcacctgccaccatgcccagctagttctgtatttttcgtagagacagggtttcaccatgttggccaggctgatcttgaactcctgacctcaagtgaaccgctcgcctcggcctcccaaagagctgggattacaggcaggagcactacgcccagcctgtttttgttttttttttaagaagcaagatgggtagatttgatttgggatggagatccctagaggctgtttaggaagcctccaagccgtttggccagggagggtaatgtgggtgaggcgtatttcgaggcaggaggtccccacagggccacaaagaggtgaccgagacactgccctcggccctaagctcctcctcccatccctttcttctggggccaagctcccaatgcctccggaaactgaaagtccagaagctgcctgccactgactttatctcctctgctctctttatctccttcgctgagtgatgggcctgggaacaagcgcccacccgttttatagcccagaaggacaagtgactcatgaggacatagaggaatcaccactattctggccttgaaggtcctgggtgctggggcgaggggtggccccaaggaggctggagtggtgaagagtaaagaattcatcacactaaaccccccaacgcggctggcctggctccctcccatctgactatatcatctacaggagccagggcgggggagggcgttacttagccagtccctctggccggtgtctgtttttacaaagttcctcttcctgccttgttcccctacctttgggactcacctcccaacttctgggaagcctgatcactgctctggctgtacatgagacacacacacacagacagacacaaagatacacagagatgcacacacagagacacacacatagagacagagacacagacacacacacacacacagagacacaaagatacacagagatgcacacacagagacacacacagagagacagagacacagacacacacacacacacacagacacacaaagatacacagagatgcacacagagacacacacatagagacagagacacagacacacacacacacacagagacacaaagatacacagagatgcacacacagagacacacacatagagacagagacacagacacacacacacacacagagacacaaagatacacagagatgcacacacagagacacacagagagacagagacacagacacacacacacacagacacaaagatacacagagatgcacacacagacacacacatagagacagagacacagacacacacacacagagacacatacatagagacagagacacagacacacacacagacccacagagacacatagagacagagacacaggcacacacacacacacatagagacagacacagagacacagacgcacagagacagacacaggcacacacatttagagacggagacacacacacagagacattggaacagagacacacacgcagagatagagacacacagacagagacatacctactcagagacatagagacagacacagaggctgggtgtggtggctcatgcctgtaacccagagcttagggaggcagaggcaggatttcttgagcccagaaattggagaccagcctgggcaacatagcaagaccccattctccacaaaaagggaaaaaacaagtttgagatagacacagacacacacacacagatatagagacatagacacagatacacacacatagagacagaaacacagatacacatgcccccctaatgaaggcacagataaagttccctgcacaggatgtgttgcccaatgccctcagatcgggcgggcctgactctgcctcacactgttagcaactggggttggcattcatgggacgcctcctgcatgcaagaccctctcctgaggcctcctgtaagctgtggggacaccctaaccaagggcaaggccatcctgggacagcgtgtgtcaccagtggaggaacgcagcaccactcacagtgttctcctcaaaacccaaacctaaatcaaggcaggcctctgcatataactgccatttgtgggattacaggggacagagaaacatgttcaacacaccacaagggtgcaatccacaaatccaggctgtgggaacctctatgggacaaacaacccagtttcttcaacaaatacatttcagaggaaaaagaaaggggaaactagactaaaagaagggtcagagacgtctaacaaatgcaatgtgtggattttggatcatgatgtcagcaagacaactgtttaaaaaaaacaactataagacatgtggattgtctgaacactgctacatattggatgacattagacatctttttaggtgtgagaatggtgttgccgtcactagtagagttacatcttgggctatctgtggatggcatcacatgcctgggattcatgtaaacatctccaggggcgggcagggagtggggcagtgagaggtgaacaagagtggccctgcaccgatggtcgtgaaagctgggggtctttatgccattttctctatttttgtgtctatttggaattatccataataaaagttataagaagaaaaatggccagacgcagtggctcacgcctgtaattccagcactttgggaggttgagctgggtggatcacttgaggtcaggagttcaagaccagcctggccaacgtggtaaaacctcatctctactaaaaatacaaaaaaattagcctggcatggtgacgcgtgcctgtaatcccagctacttgggaggctgaggcaggagaatcgcttgaacctgggaggtggaggttgcagtgagccgagattgcaccaccgcactccagcctgggcgacaaagcaagactccgtctcaaaaaaagaagaaaaaggacacagcttgagactcaccctctgatgcctctgaggctcccagcagtcctccagagagggctacaaacttctgaccccgggcagtgactcctgccaggctcaccgtttcctgtattactctctgtgggcacaggggtcactgatggcatcttcactacaaaaggggttgggggctctgctgtggggactgaggccgtgggcagctagaacccgagtccggatgcccacatggggctatcagagatggctgggggcagtccaggtgaacttgggtgggtttgacactcaaggccaatgacaaccctgtgcttggcggttggagcctctgctgggaggaactaaggactctcgagatcactaagcactgcccggaagtggggggttcttatgaatcggcattgatcccttcctccctcctgccccagctcacgcccccccacacccccacctagccttcccaggttcccaacctccccccgggacgtgcacctgcctttccttgggggctacaaccacaagcccctggagagcacggctgcacagacctttcggaagtcgggacgctgctcgcagaggaactttaaaaggcaggctgtgaactgacagctggcagccagatcccacccacacatgtgttttgtttggcttgcgaagtgtttttaaaattttaagccaacagtaaaaggtcaggcgacttcacataaaaacccacatttccctcttctcctgtaactctgggtgacctgaccacaccgggtctgtgttcccaagtgccgccggaagctgactgcagctgccccctgtagccagggcatgtgtggggactgctctgacaactgtcccccactcccgcagtgcccagtgcccgacaccctggggagtcactgccaccccggaggggccaccaattcaacatgtgacaacccgaagtggagggaagcagaggaggaagagacggagggggacacacagatggaaactgagcccaagaaccaagagtgagcctgaggaccacagcgagggacagcgggagagggaggcagcaggcagacggaggcgaggagcgattccttgggcatcttaagtcactctctggcccctgagcagctgtctcgtttagggaaaaggtgtgttcaggctgaatctctgtggtccctcttctccctgctcccatacccagacaccgcggccagtggggtcttgatcccgcaaagccccccactgccctcaggcagaagaccactggcttggtgtggccccagctccccactccaggttccctctcagcagaactgctgcagctccttcttcatgccgccccttctgtctggctggtgcgtccctccttccacccattccttggccagtacatccttggccggtacctgagaggcagatcataaaagctgcccctgtggaccttcaagtcgggacccaggcctgccttaacgcagggccccagacagtgggctttgggcctggggtgcagttctgggggctgccggacacacagcagttcagagcgggaactgggcacagggcagtgactgggtgactgtggcctttggccatcaccttttccaacctgggcttggccaaggccgggaggaatggcagccaggtaccctgactcaggtcaggccctggtggaaaacctgtcacctcctgttgggcaggtggaggtcactgacccctttctgtctcttgtgatctatatttagagcctggggaggacatgaaaagggtgaggcctggacacgctccttggtcatttcccaacactgacgtcaccattcctagcctgcctaggtcctggggtggccctctgtgggcgggtgagcacacaccttggcaggaggtgacgcagctggaccacgcgtgggaactcccggcacagcgggcgggcctggctcagccccacctcccctgccactgggttcctggcaacctctggtggcttcttcctcctccttctgccgccaggatgcaggggtccccacaggcgagaggctgaactcagagctggccaggtgagaagcgaagcaccgaaccactgaaatctccaggagaccacactgggtggcagatgtgacagcaaccctctgacctcacggggcgctgccgtcccagcacaaccagaacaaggtgtgccgatgccgggagcagtgcaaacggccctggacggggatgcagagggctccggatcagcctggggctcgctgtggggccctgctgtcatcccttggaaatgggtacacccccggcatattgagggggaggcacgcagaggaacaaacgtgataaatgcatccatgggctgcaaatcgggggccgctcggacagctgtcccccactcctgcagtgctcgctgcctggcactgtgaggagtcactgccacccccgaggggccaccaattcaacatgtgacaggccgaagtggagggaagcagaggagagaggaagacatagagggaaactgaacccaagacccaaaagtgagccggaggaccacagcgggagagggaggcagcaggcagacggaagcgaggagacagggcgcagaggggctgcggggggtgctgggcacacctggctgaggaagggaccaaaggcccagagggtcccatagtctcagcctagtacctgtccccaagcccaggggccctgatcacaaggcagcaacgtctatcccacagctgtgataggtggggcacatcacaccccgaggggccccggcatccatgatctcccctcctggagggtggtcagccgccatcctggccccggactccttggaaatgctccacaaagtgccagctggaaatgtcacagcacagggggccttgggatgagccagccccaaggggccattctttcctgtgggtttggggaactcttttaagatctggagtgcagattcgggttccagtgcctgctctgtgtcttcctagccttagtttcacctcctggggcctcaatttctccatcagtaaaatggggacagtaaccgtcatagcaccagctctcaggcttctcaggggagcagacagtgaagcagtgcacagaagtccttggtaatccaagaagcaccctctggacggagctgccaggacagcccgcagccaccctggactgacccgtggggctgggggcagctggggaggccaagcgtgtgcacacgggcaccagcagcagagcagacccccagtctcctctctcatacccgagatgggagatgaagactcccctgtgagttccaaactcctccaaccagttctggcagggaagaaagggagtcctgggaaagcaactcccatgcctggggctcggcggtgacccacccagcccctccccggcagaggcactggttgccctggaaactcacctcggtggtggccggtgctggcagaggtgccagccaaggtgtcgggctttggagagcggcacgacgggcgacggcccttctcctggcggtcaccacagagacacaggcaaagaacacagagcccttcctccccctgggcacggcaggcctggcacaaacctggcctgcttcccgggccatggtggggcgagagccaggtggggagtgggccctgcgggaggccctctgccagtgtgctcgtcgcctgcgtgccctagtggagtggagcacccgagtgcctgggcctggtgtcacccgcgtggctgtcatacctgctgctgtgacaggcaggaccaggaattcccgcttgtaccaggccatgggccagccgaggacgagtggagaggctgccccaagctagcctagctttctcccttaattctccaagtccccactcccattccccctgtgtcgggggcctggaaaccaccacacagagccagaaaggtgacagatacaagtaaccaaatcaaaacagggttcggtcagcagagccaccaggcggatgtgagtctagccagaggcactgggaggcaggcaggagaccccactcacttgttctggaaggcttccctgccccctagacctgagctcttccatccctggcacccaggcacgagatttcctttcttctttttttttttttttttttccctgagatggaatctcgctctgtcgcccaggctggagtgcagtggtgcgacctcggctcactataacctctacctcccggttcaagtgattctcctgcctcagcctcccaggtatctgggattacaggcacatgccaccatgctcggctaatttttttttgagacatcgtctcactctgtcacccaggctggagtgcagtggcatggtctcggctcactgcacctctgcctcccgggttcaagcgattctcctgcctcagcctcctgggtagctgggactacaggcgcatgccaccacacccagctaatttttgtatttttagtagagatggggcttcactacattggccaggctggtctcaaactcctgacctcgtgatatgcctgcctcagcctcccaaagtgctgggattacaggcatgagccaccacactcagccacttggctaatttttttgtatttttattagagatggggttttgccatgttggccaggctggttcgaactcctgacctcaggtgatccacctgccttggcctcccaaagtggtaagattacaggtgtgagccaccgcacccggccacaagatttcattttaactgggcgcaggggtgggggatgccaatggtttgtttcattaagtagggtggtaaaaaataataatattaccaccactactcccaccattcagaaaaaacaccaccaaaggtaacaagaaagggctgccatcagaaagaagggcaggcttgaaatgagtacatttggcttttagaataatttactagagtgactactggagttgtaaacaaccaccaccaccaccacaacaatacaacaacttactaccttgtccctgtttttctcattttgctgcaaaccagacattggaagccatcagacgcatccaacacacccgtctgacaagtggaaagactgagccccagagagagcagggacttgcccaagatctcacaggaaaagtgtctgtccagctgctctgcaaagcttgcagacgctccttccatcctgacctgggggccagaacactcagagccccaaccccaaagcccagagatgccagggcgaagtcagaggccaagagtctcagctacttccttaccttcctgggaacctggccgggtggatgcccagtccctggctgcaagtggagggcacagggcagggagcagaacagcagaggcggggaggagagggtgtgggcaggggctgtggagtgcccccacaggcacatcaggccctggggcccggcttcccgcccagacactgccccagcagcacctcgctcccagccctgctcctctgagcatctcacatcctcttccggtggctttgtgggccttaggggacccagctgagcagacagttcagggcctgggagctctgccaccctcagggtggagactctcaggggatgtgggtgggcatgtgggggtgggctgggctggggtgggggagcatcagagaaatggagctagagggtttcaggggggccctgaaacctacctccctgtactcaccctgtggccagaacaagtcacctccactaaaatccctccaccatttctgtcccacccagaagagaatcccaagtcctcacctgcccacagccccctcctactaactccagctgccagtgtcctctgctgggaaccatgttcttcccccttggtctcaggactcggcccccagtcagagcagccttctccaacacccctgtcttaatgcagcaacaccatccctgccccagccacccattccctgttctttttcatctggcacacttcctcctctgtgccaggctccaaggccctgtcccctgggaaagtcaggcatcaccactggcctctcttgcgcacagtgactcaaccttgaccttcgaggaacagtagagccaaccaggctgtgaattggtcagcccaggactgaaattctgatccccagggactctggaaccctgggccaatgatttagcatctctgggccttagtttgctccttataaaatgggcacaagggcgctggaggattccacaagaactcagcatgggctcggctcatggccgtgcttggcggatgtgcaatgatcatttccagtggggattgaggagttcaggtgccaaagggttacatgcctgccccggtgccaggcacataacagacatttgatcaatgttggtggatgctgcccctgtgccaggagtgccatagcctgactccatccctggcagcaaggtccagatggcagtccggggtctgcccagtgctcagagtgtggcttgtaactggatcctagcagatagcttggaaatgtttgctgatgtagaagcacacacagatgggtactgcaaggcaggcccggtcccgggagaggggaccagcgaagaggtcactgtctgggtacacactattaacgggagagacgccctgtgcagacaggcaggatctgggtgaggcaggcggcaggggttggtatccgagcagggatccgaggctgtccccagcctcggcctctcaccccggtgttgctgactgcctggccatgtgactgtgggcattgtgtggtgtggttcggctgccactccaggtttaacagggagcttaccacgtggtttgagggggtggggagggctttccctgagcctcggtttccttgtctgcaaagtgtgacctcgcagcctagccccgtagaagggctcagtggccgagaaggtgtttcctacagtgtgcgcatgtttggttgggtggggggcttaaagaggccctggaaagaagcgctcaactttctttttttcttttttttttgtttgagacggagtctcgctctgtcacccaggctggagtgcagtggcgccatctcggctcactgcaacctccgactcccgggttcaagcgagtctcctgtctcagcctcccgagtagctgggataacaggcatgcggcaccacgcccagctaatttttgtatttttagtagagatggggttttacatgttggccaggatggtctcaaactcctgacgtcgagatccgcccgccttggcctcccaaaatgctgggattacaggcgtgagccaccgtgcctggccagaagcgctcaactttcatagtgggggtgggggaccagtagggaagtggcagggaaccaggccaccctgctggtgtgtttgtgagctaatgcctttgcttggacaagcagctcccgggtaccaggccctctgcagggccttgcatctctcacacaagctttctgtgctattcttgaatagcccactccagcccagcttcccaagcctgttacccccatatctcccctgcccccacctccagcacaggtcagcctggcctcagggcctaatcctggggctcctcctttcggagccagggtgggcagggctacccggggcagtgggcactgagcttgctggaaaggccatcgagggactgctgacacagtcaggctgcaggaggagcagcaccagctgccacgcagaaatgcaggagtcccgaggaggtggtgctggcaggaggggagcagcagggccatgcacccctcctcccacccacgtggtccctggccctgcctctgccgccagcctgggggagagcagggtctttgttccctgctggccaggccgccacgtgatgcgccacatcactgtcactgcctggaacgaagactgccatggacagccgaggcgctggggcctgggggtgaggccagttggaggagctccacctgcagcctccccaccgcaactctggctgccttcaggagctgggcctagtgagggccatacatggcacaaacatttccagctactgtgcatgaagcttacgacgaccctgaccccaggcttctcccaggacacacgacctaccagtggtcccacgatgctctgcccagcacgccgggtggcctgggataatgcacctggccacacacacaagcccaggctagcaaaacccaacccacaggcacctttctaggtaggggcaggccctggctgggtgtgaggcccattgtttacaaacactgtgcagctgtcgctaggagctgtgactcagagccagagcagtgactcctcgcgaagctgtttactcggcaccacatcctgtccaggaagcagatagcagaggccgaggcctggcttttgctcctctttcctgctgctaacttgactcagggagctgctggccagactcggtgtccagctggggggacactccagctcccctccccctggcttctgggaacctgaggccccgtcaagtcgctcaacacacattcaggcccagccggctctgctaggtagtgatgctgtggtcgtgcaggagacagatcctgcccctggaggctgcacctatgcctggcatcccctccctctttggctctgactaggagactcccagggacgggggcatcactgacacctgtcactgtgcagcccagaggcaaattcttgccacgttcagaagcctggcaggcaggatcaactcctgacaccccttcgtaccctagagcctagtctggcgccgcctttagcacacctcaatggggacaaagcacttttccagacagcctctgccagaaagatgaggccacagtcatcatctctgttgtaaaactgagaaaactgaggcccagagagggcgaacaacttgcctgatgtcacacagcgtgtcagtgccaaggcagggtgtaagtccggcccccaaggctgcttgctttcctctactctgttccaaattaaggatcacaagtagatttgttccaggcagcacacagacttgacgctgctgggaccctgtccctggggtgggtggtctgtcccctgtaggaggcctaggctggggactctgacttccatttctgctgatcactgctgcctccaacctggcgcctaaaccagagtcaacaaccctctgataatttctactacgcactgccatgccaatgcgggtatcatttcaccatcatgatatgtgacgcaggttttgcaggtgagtttgaggatgaagctcagagatggcacaaagctcatccaaagccacacagcagagcagggcttccaatcctgtctgactctcaggtttgcgctcccagtcactccttcctgcaaactcctagcaggaagactctttatgacttttcataaagagtcaaaggtgattttatcctcacggtgcccttctaagttcagggtgcaagtatctcaatgacctccagttcacaggagggcccctgtgtgtggtggggaggcagagccgcagaatgacttgtggaaggctacacaccccagtggggaggacctttcccctgctccaggctagggagacccggggactcccaggagcagcagagccacaggacacacctgccaaggcatgtggaaggtgggccaccctggagtggggagagaaaggcaaagaggggctgtgcttattttggcagttggggcttggcaccaccccaggcaggacagtaattcagcaactggctgattcacccaccgcagggctcccctgcactggctgcctgcccgccggcccctattaccagcccactgagtcacgcaggttgccaagaagctgaggatccaagaatccaggccctgccccagccgctcccattggctttgagcccagcaggacccagccctgccaagggcaccgcagctcccctccccaaccctgcctgcccccaggtccagctccaggaggaacccaacgtctaactgtaaggatccaagcagtggctgggagctggggcctacagtgtcaggagtcttgggccaaaccctcatcctgtcacttcctggctgggtggagctgggtgagccaggcaggttcctttcccttgctgagccttggttctagcccatcaacagggaacatctctgcctcaaaaagactgcatgctgaaatgaaacactggatgggaagcactcaagatagggcctggcacatgctccgtgtcaaaaaaatggcaccccaaggtggcatcctctgcagggaagaaccagagttcttattttgaattcaaggccagctgatacttctgtaaaatgcaggtgaaatgttgcagcaatgtcaactgccatagagtttctaaacaatgtccatttctctactgaaggagatgaggatcagtaacagagtttgtagcctgcactgtctgcagaccacagagagggcccggggcacaactatattcacacagccagaccacgcgaatttactgaacacctactaggtgccgggcactattcaagtgccagcgatagaccagggaaaaacacaacacataaaaatcacctttggcctaggtcataataagtaaaatgcatttttgaaaataagaatgctccagaaggcaaaaacagaacagggaaggctgatggggcccatggggcaggagcaggtgctacaactgcagacaggccaggagggctgagggggcagcgcgggtatggatggaaggagggacattaaaacatttcaccttggccgggcgcggtggctcacgcctgtaatcccagcactttgggaggccaaggcaagtgaatcacttgagctcaggagttcgagaccagcctggtcaatgtggtgaaaccctgcatctactaaaaatacaaaaaaactagctcgggtgcggtggctcacgcctgtaatcccagcactttgggaggccgaggcgggtggatcatgaggtcaggagttcaagaccagcctggctaacatggtgaaaccctgtttctactaaaaatacaaaaattagccaggcgtggtggcggcgcctgtaaccccagctactcgggaggctgaggcagagaactgcttgaacctgggaggcagaggttgcagtgaccaagatcgtgccactgcactccagcctgggcgacagagcaagactccatctcaaaaacaaacaaaaaaactagctgggcatggtggtgcgtgcctgtaatcccagctactcaggaggctgaggcaggagactggcttaaatccaggaggtggaggttgcagtgagctgagatagcaccactgcatactccagcctaggcgacagagcaagacttcgtctcaaaaaacgaaacaaggctgggcgtggtggcttacgcctgtaatcccagcactttgggaggccgaggcgggcggatcacttgagctcaggagtttgagaccagcctggccaacacggtaaaaccccatctctactaaaaatacaaaaaatagacgggtgtggtggtgcacctgtagtcccagctactcgggaggctgaagcgggagaaccacttgaacccgggaggtaaaggttgcagtgagctgagatcgtgccactgcactccagcctgggcgacagagcaagactccgtctcaaaacaaaacaacacaattcacctaccacggggtcctttcatgccccccatggcggggagtttgtaagctccttgagagcagggactctgttccccagggtcctgatgcctagaacagcatctagcacacagctggctctccataaatgcctagatgaacaagtgagctcgatgggccagactctaaaatattcggaggttcttgtgggaagatcaccaggagagctccttggaagaggtgatgaggctggagaggagcctgagggagggcagggggccggagggccagggaagggcggggcgcctctgctcacctggctccctcccattaaagtgctttccccccaggaaccaggctgagaagagaggcagaggcaagccaggcgggggaagagcgaggaggaaggcagccaggctttctgggaagcaagagccctttttcttagaagcagggccctggagtttcccagaagccagcctgccctgggacggtggaggcggtggtaggtggtcaggttggccctggtttaacctagggggttttcccttcctaaattcctggcccaggaacaattcttggggaatgggtctctgttcacaggtaagtagaagttgctctgctgtgggcagagacccctccccaaggcacagccgtggctggtgaggatgggggatgggggctgagcccacagtcaggcccctgtgtccagcaggccctggtcgcccagtgcgctcgggccaggggaaccaggacaaacgggcccttgtggttgggaggctgcctgccgtgccagggacactgtgtgcccggtgccgccaccagcctgctgcctgcctgaaggggctgagggcctgggaagtggggctactgtttccaaagggaacctcctaagctgccctggcctctggagagggcacagggccttggctggctgccaggaggtggcagggctggtgcccgctgccctctttctcacagtcctttgcctgcaagaagttccccagggctagagaagcgcaatcccttgggactctagggccctgggtctgagggacactgctgtgtcccaccctcctgccacccactgtcccgttaatccctgggcttggctccttccttggcttctcccctggaaggcgaggctcaagggcctctcctatctgcctcacctgggatgcctgacaaaggacagcaaggtaccagctgccctcccctgcccagggaccctccaagagctgttcaggtctccatgccagcatcatggtgggcagctgggtgtgccaggcagtggctgagcagttcccagccaccacaaccctgtgagctgggtccggctgtcaacccagtgacacatgagaaaactgacactcagccctcctcatggtcacggctccggcctgggcctggtgctttgtttgtttgtttatctgagacagagccttgttctgtcacccaggctggagtgatctcggctcgctgcaacctctgcctcccaggttcaagcaattctcctgcctcagcctcccgagtagctggaattacaggtgtgcaccaccacgcccggctaatttttgtatttttagtagagatggggtttcaccgtgttagccaggctggcctcaaactcctgacctcaggtgatccacctgcctcgacttccaaaatgctgggagtacaggcatgagccaccgcacctgtccaggtctagtgctttaaaaaggcaaaatgcaaacccccactccctcccacactcactgtggcaacgtgctgtccctccccaggcaccagccatgtgtccccacacgcagccacacataccccttcatatatgtgctccctcagccactgtcaagcttgtcacatctgagcacatgcatgctgcagacatacagggtcacccaaaggcagagagatgcacctgcccccaacacacgtgctagaatgcacatgtgccccaccgcatcccacagcacacagccgctgcccctgcaggcccagaggccctggatacacaccctgctccctgcatatctgccagacagcaatctcctcagggctgcggagaggggaggaggcagggctccatgcagggactccccgaccccagaagctgggaaggaaacacctcatggagtcctgaagaacggcaagcggctatttcgagggggcagggggaccaggcaggcggtgccgccagctgagaccttccacactgggcactacccacctgcccactacccccagctgtcacctccccagccacccagggcctggggccaggtggactgcttcacccttgaactccagtcctgtcaactgggcagcagggcctggaacttggcctcagggaagaagggggtcgggggagagtgggatgcgtggcctgggcaacttactcgcctcctcggggccgtagttcccctacctgaaaaaaacctgtggattcaacttagggcctgcaagtgtccctgccctccacccacaccctggctccccaagggcagcgggagctggtgggccatcggccatctcccttctgcgaagcggagcagacattggctgccatctgcggagggcctgcccatgcggtgccaggggcctcaggaacatctcatactcccccacatccgtaggcccacagaggaggcaatgggggtacagaggagttaaggaacccacttgtctgggtcccctgaggccaagccagggctcccatcccacctcccaggcttctctccccttgacctctagacagcccgaacttccctgcggctgctgttcctggtgaacatcgtgacagatgacagcactagtcaggtgattaatcagctgatcacttgatcatcgggacagataagtgctgctgcagctatagcccagcaggggtggggtggggtggggtgggagcgggaatccctttggaatggattcaggtcaggtggtggcagcccccaggacttaaataccttctgccaccctccccatggtcccaccctccccacggtcccaccctcccagttttgaacttacattacaggcaaagggcacccccccacacacacatctgggatcaggacaaagtcccaagaggggcgggtgccagaggtgggggaagttcctggactcagggcctctggttggccaagggtgctttcttctttctctccactggacaagcccacccctccctgccttcctccctcggaacacaaaggtcagatgggcacacctgacctctcgggtggtgtccagcagagaggtcctgcacccttcccatgggagccctttctggaccctaacctagaaagagggaaggactggggtgccctccagcaggcagtgggtcccggccccccttatccttcccagaaggactgggcagctcaattcagttaattatgtgcccaccatgcagtgcagggaggggaggccaacgtgggggagggggtggggaaggtccttagtgcagcacccacgcagggtgggtggggctgtgtgcctgaatcttccctcccaccaactggcttcctgcagcctgttccttggtgctgggctgggggctcgcctcatccgcccgccttcttggcgtggcatccggcaagaacgtgggccggggctgcacgcaccttgggctgtgggccggcagctccccgccactgtctgtgctgccctctgccctgcccctcctcctgtggcactccagctgggggtggctgggcagagtccccatgggatcaccctgagcccagccgacgacccccaagtgaacatacgagcccagtacccaactccggaggtgggcacaccccttgcccatttgacagatggggcaagggaggctcagaggggtgaaatcatgacccagggtcacacagtgagcaaatgaccagggtcagactggcatcctggctccatgagagcaccgggagttcctgcagagttgtcaccaacagtcctaccctcactgccatccccagagagaacatctgaggcaaccaggtctcatagccttcccatccccaaagtccaacccactgggcagtgtggccccacctgccttttcccaccattctactgccccaccctctcccagggtctggggctccacctcgctccttccaggctggacacccctcatccatgttctcacctcggctcccgcagtgcccaagtctgggtgcagggtgggtgcccacaaactaaggcagcccctatgggagcccaagggcagggctttcttacaccctcacagcaactgcggggacctcagggcagacagggaggctcagaggggacctgtgctgcttctaggatgcccagcaataagcgctgagctggaatttggacccaggtgtcctgctccaaagccacctgcctcacctgaggaccaggggcctgatggccgaggtggatgccgacatgtgaggaggaagggcagtggcggcctggtcctggtcccctcactctcctgccccaaggccccagtaggtgacataattcacagggcaatgtttatgcactgaacggtaaacacacaggcagaggggtagatgggccaccaatggggaaactgaggccagcgagaagggacacactaaggtcacatagtcagtcggtatcaaagttggcccagaaccacagtcccctgttccaagggctgtacccagcccaaccacaacctggcatgccatccagccccaggccagggagcccacggctgcagggcggcaaagcacacggtaccacacgtggtaccccatggccccacacactctggctggcaccgagccatcgctgtgctttctgaccttgcgttttctgacattctgccactgtcaactctcactcaggtatccaggaagcggcctctgttgctaggggactggcttgatgccgggtggctggcagagtggggagatggggaggggggagtggactggggtgtccctcaggaaggatccaggggcagagtctactgggtcctgtgtcagggtggagggccatgagaagtatctgaggaaactcagcaggtcaggccccttcctccccaggctctaatgaaggtcctggaccctggtctctgcattttctctttcagcctcagagtcttctttttgggccaggggtgggtgtgcgctggtgggggttggaagtgagccatcggaaagcccatcggaaagccccagcccggagccttcctgcaggcaagtattttgggggccagcagttgccaagcaactgctctgggttgccacgggaacactcccttttttctggggcttgtcattcttagggggatgccacaatgcttcccgttccctttcctctccacttcctcaccctggcttggctgccctgggaggggacactgggagtccataagctcacaccccacccctatgggggggcccacatacccctggccctaagactctttgaggctccagaatcaagaacccccaaaatgcaaagcccagagtccaaggccttcattagagcagggagacgatgaaaggggctcattagctctgtttatgtctccttgccgccattaaccaccacttggggcctagggcctcccagccccgccctgcccagcagccgggcccagccctgaccgttggaaggccactgtaattggaaggaatgtggtcctggtgcctggcccttcccaggcttgtgtgcacacggggaggcgccattgccaagctgccactacctagctgtgggagttccttccccttccagtgcctcagtttccccacctggaagtgaggatggcagtggcacttatcttgcagagtgctgagcagatacaagggacactttagcacaaggcctacaggctggctgtcatcaccaggcacctctgcagcaggggacagagggaaggactctgtggagaatagtcctgtggctagcgtgcaatggtgactgaccacgccactgatggcagagtggccactgaatccaggtccccaggctcgcagcccatgccttctccacaagatctgtctgccccatacccctgagccttccacagaagccagggtgcttcccacaggccaggcacccagcgccagccaggtgtacagaggccagtatctgctgtgtgaatcaatcgctgaaccaactgtcaaggaccagcagcctcaggggcgggcctggtagctcggtgagcgaggaggtggtgggagggccttgtgcgggtagggaggtgacagtaagaaatggcctcttgctggatgcagtgtctcaagcctttaatcctagcagtttgggaggccgaggcggggggaatcccttgagcccaggtgtttgagaccagcctgggcaacatggtgaaactgtttctacaaaaaaaatccaaaaattagctgggagtgttggcgtgcacctgccgccccagctactctggaggtctgagcccaggaggtcgaggacgcagtgagccgtgatctggcccctgcactgcagcctgggccacagagcaagaccctgtctcaataataataataataataataataataataataacaacaacaacaacaataataataataataataataataataataataaaataaaggaatggcttccactcattccactcctgggccagcggcccgctgtgcactccgctccctttcgctgatgccatgtgagcagctccatggcggggacctgacccctgctcctcagccccacactgcctcgcccctttgtatatcaaaggcgcctctgaggggctgtgctgacccccaccaggagcagcaggaccacctcaggcatcccagctcccctgaggcagggtctggggctggggttggggggaaggacccctcaagtctctatctgcacagacagcccacccgtgcccagggctgccttccgagcacccgcagacctgggcctgcagtaacaggagagctatctgcaaaccgcagtgtcatcagccgcacggcctctggagaggcctgagaaaggccggctcagcttgcaggcgaggaaccaaacgaaaggcaaactcctggcccctgcagcctcgcaggtcccctatccctcctccctgccttcctttccgccccgctgacaccacggtctgcaaaccatggtcctcctcgccacccctgtcacctcctcctccgccccccgccggcctccgacgcaaagtcgccacccagtcaccccgcctcggccccgcctggtttgatttcctcccgtgtgtgtcacccatgaggtggccgtgcccctggcctgtttacagctgtgcgcaagctcctcgcgacccgaaagcgagacctttgtctgcggcagctccgcgccgggctgggcggccgcacgggagggcacagcgccacctgctggtgctgccgccagagcgcgccaagctgaggagcaggcgggctccgctcacgcccccacaccccctggctgggggctgggttcctgcgatgtcttccgactccccgctgctcccctagtccccgtaggcacgcgggtacccggcctttgggagggggatcattcccaatactcctgttacgggttgaactgtgtccctgaacaaaaagatctctggtacccgtgaatgagatcttatttggaaatagggtctgtgcggatagaatccggatgaggtcatactggattagggtgggccttaatccaatgactgctatccttatgataacagggaaaattggacagacacgcacaggcggacagacacgaactgatgaaggcacagtttgcagtcacacgtctacaaaaccaggaacgaatgccaaggaaactggcagccaccagaggttggaagatgcaaggaagtatcctctcctagaaccttcagagacagcatggccttgctgacccctggattttggacttctggcctttagaactgtgagagaatacatttctgttgtgttgagccacccagcactttgtgacagcagcccaggaagctgacccgatagacactggtcccagtcatcaccctctgtgccatcaccacacctcccctccacgaatcaaccacgaccacaggacacctccttctggaatctctctgtgcccacgcactccccagatgagcacttccccttcccctggcaactccccggattcttgttacccccaccccccgccccggcatggcctgggcccaggagacagatacgaaatgaatgagtgaatatccacctttgctacttcgtcatattcagatgttcgtaaaaatctgtatgttcgtcatattcagatgttcgtaaaaatcaagtggcagcagtgctgggggttaaggaaatggggagagtgatggcagatgtgtgaggggagacaaggggcacttccaggtactcacagccaccctgggagctgggacagccaaccagtgtgttctcatgctcccagcccctgaggctcagagaggggaagccatctgggtcaccaagctcctgcctcttgccagttctgtgaccccaaactagccattgtgcctttcagggcctccccagtctcctgacctgcacaatggggatggttctaacgtctacttcctggggacatcaccacgctaatgtgagacaatactacaaaacctgttagctgcctcacagacttagagatggaaggattaggaaggaaaagggccttcagagactgcagggtcctgctgacccctggattttggacctctggcctttacaactgtgaggaaagaaacttctcacaggggcgagacacagcccggaatacaagtcggacaggctgggcactggtgctgtgatctggggaaagtcactcccttcttggtctggtttcctcatttgcaccatgaacgggttgaaaatgaagcaaaaatcagatatcggccccctgtggcatatgggagcatcttccaatgggaacaccttccaatggctcccatgatgtttgtttgtttgtttgttcgtttgtttattgagacagggtctggctccgtcgcccaggctggagtgcagtggcatgatcttggctcactgcactcatcacctcccaggttcaagtgattttcctgcctcagcctccggagtagctgggattataggcacctgccgagacacccagctaatttttgtatttcttttttgtagagacggggtttcaccacgttggccaggctggtgttgaactcctgacctcaggtgatccacccgcctcggcctcccaaaatgctgagattacaggtgtgagccaccgcgcccagcctccgttatgtttagaatcaggcctgactgcctcctctcagacactgtcccaggcagcctccacactggccccagagatccctgcctcctggtacataagttgctgagtgatccccttcctccgagggtgattggatttagtgactggcttctcaccaacagaacacagcacaggtgatgtgaggtcacttccaagatttacaaaaaactatgacttctgtcttgcttgtttgctcttgttttcctccccaccttcacccctcactctggggaagtgagttctgatgccgtgagctgcctgccctacagagagacccacatggcagtgaaccaagggagggcccccaccaacagtcacagaagaactgatgccctcagtcaaaactgaatcctgccaataacatgagaatggcctgggggcgggtcctgcccagtccagccatggatgagaccccagtcccagcctcccttgagacctgggggcagaggcacccagctgagctgccctggatctgggtccacagaaactgtgtgatgatcaatgtctgttgctggaagctgtacattagggtagtgttgtcacatagctgtccacaggcccctgggctgcccctcccacccccagctcacttgggccacactggcctcctttctcactcctctctggccaaactcatttctgcctcccagccctgcctgctgagccttctccatcacactgtccagactcgtgcagggctggcccatgctttgtcttctggtcacagcacagatgtccccttagcgagacctctcagatccccacccagcaggccccagccctccatggcagccccggcattattttcgctgcagcactgctttttcctttctgtgcctgtttgcttttgtgccctgtccatcgccccctccagactgccagctctggagggcaggcccccctgggtcactttcagagccacacccaagcccaacgctgcccccccacaacccagggtgagtgcttgggcacacctgctgaagggaaagaggaagctcttggagccccctcccgcctctgagcagctaacattgtggagagggatgctagtaatggggggtgtgcattgggtagaggccggggtcccccagagggaccctgccgggctctccctgactccagttgctccaatgagtacagtgggcactgcctccccctggtggccggcactagcacagcagcagcagcctcaggcagaaaacccagaaaacaaaacacacacctttgtttgggtgttgtcaaggtagcagctctcctgagtcccagggggtcaaaggagcagaacctgcaggctccaggggtaattcaaggcgcctcagaagcttcatttgctcccctctttccctctgctggtcctggggtgtccagttcactcgtgaggcctcctcactccaaccagggcaacggctctggccccacttccaaataagaaccctgaggctccaacaaggacagtcttgtcccacaagagttgtccagtgcttggccacgctctgcaccaccccaggccctcagcccttcagcccccccggcttctcttgctcagaagaacctccaagaagaaggcattttccacagacctcggtgggtagtgggggcatccccagtggagacctaaggccgacagacacgtctacgagcctgtgggacccttggagtcacccaggccaaacattccaatttatagagcaggaatttgaggcttcctttcctacagccccgtccacactgaaggggtcttttcctgcttccaggtgatcacagcggtgaacacagaaccccacaatctgtcctctccaggctgccccagcccagacagatcctgggaaccttggagaatccccgcccatcaagctggcgtgtcctccccttgccccccaccccgtgccatggccccaggcatgttgctgggtactggatgcccctgcccgtggcagagtagcccccgccctctttcttctttcccccagtcacttccccagcgtcccgtcctactctgagccccaggaagtgtgtggtgtgtgtgtctgcgtgtgtgtgagcatgtatgcgcaggcctgcgcctgtacgtgcgcggagaagcccaggcaaatgagcccacatgggagatgggcaggggtccccaggatcttagaggctgtcattcccaaagcaaaccccacgggaagggtgagccgagcccttcctggcctaagaggccggaaccctcccttcatctctggactccgccaacttcgtgtgccccgggcgagtccctgcccctctcctgtcctcagtttccctactgtcccgggcggggttggacgcggagctgcgtaagcgcacgctcagcgtggacgcggcgccgggctccctccccccggtgggtgtgggctggggcatacggtcctccctccacccgcgacgcgaggctggggacggcgcgcactcacctggcaatctaccatcatcctcagcctcggtggcacatcgccggccccagggcgggacccggggctcgcagaggccgctcgcctgggcccgcgcgcggcgcaggggtgcgcccggctgcggggctcatggcgcggcctccggtccccgccgggcccaggactctgcggccctcggggccgccccggcagccgccagcgccgctcccattgtctgcgccgcgccgcgctccggccgctcgggcctcgccgctcggttccgccccggctccccgggctcgggcccgggtgggcggggacagccgcggccccgccccagcccgcccgcaggtgcgaggggcgcgccccgccgcgtgagctcggggacgcgctcgggggcgcgctcaggcctccctcccgcgggccgacgcgggtgttccccccgcggggcagccgggcctgttgtccaaggccgggcgcgcacacggggcctgcgcgggaccgcagacagcgcgtgcacgtcactccgcttcgccgcgcgcacgcgccacgctcccagcgccatgtgcggccgatctcacgtgtccgtccgccccagccgcctgctcagtactccccaccccgctaggacctagggccaacctcgccccagccaggcgggggccgctgagtcggcgcgccggcgtcaccaaatatacacgttcaccctggcgcccagcaccccgatgccacctgctggactcggctcggcggatggctgggagctgggggacccgaggtgacagcgaactcagcctgggcagggagaaagtcaggtctccccttcccctcctcttccccacctccctccttgtcttccctgacagcacccgggaccacaaggtccagctgcagcttcagctggtgtaagatggggctcaagggagcctgggggaaggaggcctcacactggggttgagcgactgttgggggtagtcagtgttattagggctaactgatttcgtccctttttattttttatttacttttgtttttgagatggagtctcgtttgtttgttttttgagacgaagtctcactcttgtcccccaggctggagtgcaatggcgcgatctcggctcactgcaacctccacgtcccaggttcaagcaattctcctgcctcagcctcctgagtagctgggattacaggcacctgccaccacgcccggctaattttgtatttttagtagagatggggtttcaccatgttggccaggctggtctcaaactccagacgtcaggtgatcctcccaccttggcctcccaaagtgctgggattacaggcatgagccactgcaccagccgcagtctccttcttgtcgaccaggctggaatgcagtggctagatcacggcttattgcaacctctgcctcctgggttcaagcgattctcctgtctcagcctcccaagtagctgggattacaggtgcacgctgccaccaccacgcccgactaatttttgtgtttttagtagagacagagtttcaccatattggccaggctggtctcgaacttctgacctcaggtgatctgccctcctcggcctcccaaagtgttgggattacaggcgtgagccactttgcctggccaacccttttgatttatttatttattttatttttttgagacagagtctcactctgtcacccagactggagtgcaatggcacagtctcagctcactgcaacctccacctcccaggttcaagtgattctcccgtctcagcctcccgagtagctgggactacaggcatgtgccatcacacccggctaatttttgtatttttagtagaggcggggtttcactatgttggccaggctggtctggaacttctgacctcgtaatctgcccaccttggcctcccaaagtgctgggattacaggcgtgagccactgtgcccggccttttttatttttaaaaaaactatgtagagatgaagtctcactatgttgcccaggctggtttggaactcttgggctccagagatcctcctgccttggcctcccaaagtgccgcaattacaggcgtgagccactgtgcccggcttcattcaattttataccagagccaaggcaccagcactgcaggccactcagctgtaagtggccaggccctgctgtgcgtggtgacccccacttcatggctcttccccgtcactcatccccgagctggtcatcagaggcctcatcctgtgttggggcctcgctggccaggtatcccctgagtccagcgcttgggccccatatatattgatccccctgctgggacaggcctgcggtgacccctgcctcctagcctggcattcagaaccctgtgtgacctggtccctataccccaactctagcctcctggggccatcctgacccagggaccccatcaagcccctgcccctctcagagccccctgccagcactgcccctccctgtatcctcctccacaatgcactcaccttcagagctgcactcctcccaccctgtgcagagcacagtcttgaacccagatgacctgggttcaaacctgcagctgagccacatcacaggcaagctcatggtgacctctcagagtctcagtttcctctactgaaaatgagtcagggactcccacccgggagggtgtgccaggggtaaagctgggtgtaagtggggtgaggggggtatgggggacttctcccctgctaggtggagctgcccaggcctcagagtctgctgtcacctcaggtcccccatctcccagccatccacccagctgagtccagcgctccatggccctctctgtgctttcaacagaagctcctcggaggcagggcctactccttcagcacagaacccctcccctggagcaggtgctccctatgagggacacagaggccatggttccattcctgcccctctgcccaggaggcactcagtgccccttcaagactccaggcctctccagcccagtctgtctcctccaactggtcactccatctgtccacgctcttcgggtctgtccctgctcgccagccaaaccacaggtgaaggaagaatgaactcagggctggccccagcttttccacgggtgaccaagtgggtgggtgcctgcccgttccagtatgaccagagtctaccccaccctcctttctgtcttctccttccatgaaaaagatgctgctgtctccagggcggtgagcaccaggccgccaagccctgaacccataccccaccccatctctgcgtggccaggcagacagaaccacactgtaggcctctgaagtccttctggatccagactggagaggtcatcttcccatgccctctaatcctggcctgcaccattggctcagagtcccacgcccactggtgacctcacagggctgcagtgaccctggatacgggagctcccagggttgtccggctgctgggctccatacccctctacacagttgggagtgtggtggctctgccagcatgctccacttcacccagtctccctggagaactggaatgaaatcctgtccgttgtagcctctagctttagctcagattttctggagtaactatatccctattcgattgtgtttgacttccagtctgcctgtgtccccactgcctgatggaacagacactggggacacaggcaggctggatgtgcaggtaaaaaccaccttagtggccgggcacagtggctcacacctgtaatcccagcactttgggaggtcgaggcaggtggatcacttgaggccaggagtttgagacaagcctggccaacacggtgaaaccccgtctctactaaaaatacaaaaattaactgggtgtggcgggcacctgtaatcccagctacttgggagtctgaggcaggagaatcgcttgaacctgggagccagaggttgcagtgagccaagatcacgccactgaactccagcctgggtgacaagagcgaaactcggtctcaaaaaaaacaaaaacaaaacaaaaaaaatcaccctagctagggttgagcacacgccccctttattataaactgccccaaaccctcttaagaaggaggtggctagtcccctgagagtgcggctcactttggggtgcaggaaaccgagggagcctagacctgttccatttcaaaggctcactctgggggcctgagtgaggaattggctacatgtggttgggagacatcaaaggacccaggacccctgtgaccagagaaaaggggtctagggcgccttcacaccagggtattagaaatgctacgttaagggcaatatgcaataaacgggggactggcgcggcagggttcaggcactctgagtcgggctgaggcttcagagcctgccccgcaaaggcacggctgcagaacgtggcaagcctgccgggccctgcctttgtaactgcgcctcccctccccctgtctcactgttcccatgccgcgttactgtgagatcctgtgtgctactgtgtgcacagccctctgcagttcacagtggcctttccacgtcccttttccggttgaattcgcctgactgacagggaggcgggacagggctggtctgcacgctagtgaagcactggtggctgcaggtctttgggtccccatccatggcaacccccagctccgtggtcagctcctcaggcagctgatatccttgtccagtgtagaaaagcggatcagcttcaggctgggtggctggggcttcctgtcgtcccagaggtactcgggggacagcaccttggacggcttgtttgagatgaagtgacggttcaggtggctttcctcccgccaggcagccatgatgccattggccttgtccgccaggatggccatgtggcagcccctagtaaactcatataccctggccacctgccccccgaagactgccccaccataatagaagtccccttcgctgtctgccacaaaggcagtggaaacacgcctgcgctcataggggaactgctggcggggaacggcgtagtagcttgggtgaatggcagccaccaggtctcccaaggtctcagggccccacgggttccgaaacaccatgtccacatcaaggcagaagaggtagtccacctcccggtgagccctcttagcaatgtgctggctgatggtctccatccggcgcatggatgtctcctcccagtgggagtgaccctggatggggatggagctgagaagccggtggggacccagcgggaccccgggaacggctgcagggttgtcagtgaagatgtagtagtgcacccggtacccacgcatgaagaactcctcggctgactccaggaaggactggatgaaatgagtgtacctagtgatgatcacccggtcacccactgctacaccagcagcctgccagggtccccactgtgtgctggggtcagccaggctggggtccacttaccagctccccatctcaagatgtcactctgctctggccctctgggtcctcatttgtccaattcccaaaatgctagtaccagcctcttacggctgttgtaagcatgttcctggtagagattcttatgctcctaggccaggtgaacttttactgagcaatttctaagtgcccagcgacgttctaagaattcttatgatctttgatctgcataagcatgcccattttacaggcaggaacattgaggatcacagagaagaaagtagtgaagaagcaggtaagtggacgaatcaagggaaggcaagttgagctagatgctgggggcatggaggggggtgtggttgacacagccctgcccccaggccaaaactcattggacaagggggtcacctgaccctaggtggaccattcatcatctggtcatgctttagggccccaggaagttccaggaaggagtcccagaggcccagaggaaggctgccaagcggcagctcctaaaggaaggccaggtggggtcatgggagagacaagggcagaggaggggtctagatgaaacagggaggggcaagggggcctcctgacaaaggctcctgctgtcccctcacctggactctgcatcctgtctatgctagagccagatcccctactccaggaagctcccatcccactatcacaccctacactgtactttctatctgcttggcacctggttccgagcctcccgggtgcccagcagggtcctgtgtgcacgtctggtctggtctcttcccaactataaactcctgtggctcagggagacctccctccccttccccagcccactactcacttccccacggcaaacaccgtgaccccaatggtcaggttcagtggctggtagatgtgctgcagaagctctgggttgaaggttccctcggagacgatgggcgccaaccagggtgtgagtgtcagcagctgtgtgggcctggcagcaggggggccgtgggcactgagaccctcccctgtgaaagcctaagtctcatcccagccctggctctcacactgtgtgacccggggcagcttcgtccccatctctgggcctccctttcctcatatggaaagtggggataatgatagccacctcccagcagggttgggagtaccaggagttaacgcacaccaaggagaagcctggcattattcatatgtgccaagcccctaataaatgagggtcattaaaaagggcaagaccacgttgttatgaacaatggcctgagcacctcctgagtgcaagcacggtgcagatgttacaatacctctcatctgctcctccaaactccagtgagctaggcactactatccacctgcacagaaaaagctcagagcagttgggtacgctgcccagggtcacacagcccaggtccctgactcccagccctgtgtctttccacagtccctaactctctgggccccaaggccaccctgatgttagcacctccactaccccaccttataaatcagagctcttttgtccttttcccccgcccccatcaggcctctccatgacacctacctgtgctccagcagcttgggctgagggtactgtgacctgcaaccaagaaggaccagtgatggaggagagccaccaccctcacggccacaaaagaggaaatgccagtctccttaccataccacgggctggagtggcttctccctcttgtagtgcagcttcatgttgctggtggcagaggcaagaaagagccatcatcatgggtctggggacagagacactcagcacaggaagaaggaggagtcagaggcccctgcgggtgggcacccagggtccatgcaggctccctctgaccttcccccacagccccacccgactctacagaggagctggggacccctacagaagtgatctgtccagggtcactgagagagtaagtggcagggcagtgattcgaacccagtgccgcttgctcccaaggctgatgcttttccaaccatgtcgctctcgttgtcggaaagaagatgtgaaaacctgcaaagggccaggcgcggtggctcacgcctgtaatcccagcactttgggaggcggaggcgggtggatcacaaggccaggagttcaagaccagcctggccaagatggtgaaacctcgtctctactaaaaatacaaaaattagctgggcatggtggcgggcgcctgtaatcccagctactcgggaggctgaggcaggagaattgcttgaacccaggaggcagaggttgcagtgagccgagatcgcaccattgcactacagcctgtgtgacagagcaagattccatctcaaaaaaaaaaaggaagaaaagctgcaaaggcctggtgactgggacctcgggtgagctaagagctaattaacctgagcccactgtaatggtcagttgtaggcaatcctcctgccttagcctcctgagtagctggacctgccaggcactcattaccacccccggctgattttttaaaattttgtagagatggggtcttactatgtcgcccaggctggtctgtgaaagtattttgtagatgtgattaacattctatatcagttgattttacataaaagagagtatcctagacaacctgggtgggaccgatccaattggttgaaaggccttaagaacagaactggtggccagcccaggtggctcacacctgtagtcccagcactttgggggcccaacgcgggcaaagcgcttgagcccagtagttcaagaccagcctgggcaacatggcaagacctcatctctacaaaaacaacaaaaattagctgggtatggtggtgtgcacctgtggtcctggctacttgggaggctgaagcaggaggatggcttgagcccaggaggtggaggctgtagtgagctgtaatcacactactgcactccagcctgggccacccacaaagtgagaccctgtctcaaaaaaaaaaaaaaaaaaaagaacttcacctgtgggctgtggtgtctgctcctatctgagtttcagctgcttagccagcctcaccatcacataagtcaattttcctaggtatgttggccatctgtctaccttcctacctcttactggttctgtttctctagtggaacactgactgccatttctctgcatctgcaaaatgggcaaaaccatccttagccttagcgatgtggtgagagttacacaaggtgtgtgaggggctcttgaccatgtccagcatggagcaagtgctcagtaaggtgagggatcctgggcaagtcttggcaggcagcctccatggtcagtttcaaggtcaaactggttggagaagaaagaagggggtccatgaaggaggtgccagggctgtagggtcagacccctgggctcacctctggctctgccactaactggcccagggacctggagccagacagttgaccctgtgaactttagtttcctcatccacaaaatggggacaataaaaccatccacttagagtgtttccagcaggtggaagcgaggtgcagagaagggaaagaccggccgggcgtggtggctcatgcctgtaatcccagcactttgggaggccaaagcgggcagatcacaaggtcgagagatcgagaccatcctgggcaacatggtgaaaccccatttctactaaaaatacaaaaattagctgggcgtggtggtgggcacctgtagtcccagctacttgggaggctgagggaggagaatcgcttgaacccgggaggctgagggtgcagtgagccgagatcccgccactgcactccagcctggcgacagagcaagactgcatctcaaaaaaaagggaaaggccacccagccagcagcagcaacaaaaggcccgaggccgactgtccccaggcagaagctcataaggatcccacccactgatgacacagtagtctgccaggtccttgtaagtttcttttctttctttcttttcttttttgaggtggggtctatctgtgttgcccaggctggagtgcagtggcacaatctcggctaactgcagtcttgactgcctgagctcaagcggtcctcccacaccagcaccctgaggagctgagaccacaggtgcccaccaccacacccagctgtttttgtattaatattttttgtacagactgggtttcaccatgttgcccaggctggtcttgaactcctgagctcaagtgatctgcctgtcttggcttcccaaagtgctgggattacaggcatgagctgccttgcctggtcccctgtgagtttcaatacatcatgtatgatggggtggctgaagcctccttgaactcttccacctctaggctatgctcttttatttgtggtaaagtatacaaaacacaagatttactactttagccatctttaagtgtacaattcagtggcattaggtacattcacattgtcatgcaaccatccaacatttgtgtccagaactttttcatcatcccaaaaggaagctcggtcctcattaaacaacagcttgccgttgccccgcccccagcccctgggaaccataattctacttctgcctctatgaacttgagtatggaaagtacttcctataagtggaataataaagtttttgtccttttgtgattagtagctacttttttttttctttttttagatggagtctcagtaaccttgtcatcccagctggagtgcagtggtgtgatcttggctcactgtaaccttagcctcctgggatcaagtgattctcctgcctcagcctcccaagtagctgggactacaggtgtgtgccaccacaccccgccaatttttgtatttttattagagatggggtttcatcatgttggccaggctggtcttgaactcctgagctcaagtgatccaccagcctcggcctcccaaagtgctgggattacaggcataagccgctacacccagccaagttgctactcttgaatcaacaattttttaaagtcagttcgtcaaattggccctctgccctagtttcctacaagaaagcatgtttcagggccctgctcagaaagccctgggattccaagaagcggtcaggagttagaaggggtaccaaacagcccagcattctgtgcctccctggcagcgagctcctcttttctctccacaagcccagacacactccagctgcagtgaagagttacatacaagaatacaaaagcaggccggtgtggtggctcatgcccgcaatcccggcaggggcgagttgggacgaccccttgaggccaggagttccagaccagcctgggcaacatagtgagaccctgtctctacaaacaaataaaaaaaaattagctaggaggtgtggtggtgagtatctgtggtcctagctactcaggaggctaaagtgtgaggatcacttgagcccaggaggtcaaggctgtagtgagctgtgatcgtgccactgcactccagcctgggcaacagagccagaccttatctccctccgccacgcacacacacaagatagacaaactggaaagaaaaaaaaaagttgtaggtatacttagccaagagtgatgatagagaacccacaaacggaccaaacagagaaggtggggaagaagcacttcacacaagaaaaatttcaattaacgggaagacgtagggaaatgagagtctcactagtaataataaaaaaaaaaaaaaattaaggccaggggtggtggttcacgcctttaatcccagcactttgggaggccgatgagggggcgaagcctggccgaagggggcaaagaccaacctggccaacatgatgaaatgctgtttctactaaaaatacaaaaattagcgtgtgtgcctgtaatcccagctattcaggtggctgaggcatgacaattgcttgaacccgggaggtggaggttgcaatgagctgagatcacgccacggtactccagcctgggtggcaaagcgagactctgtctcaatataataataataataataataataataataaataaaatttataccaaagaggatagcattttccctctcccaatcagcaaggtaggttcatttttgttttcataacctctggtattcccagcagtagcccaggtgtactacacggtggctttgctgggtactgcttgggcagggcacatgaatgagtgactgatgtgctgtggtccttctggaaataacccaatgagttggatcagaacctatccacatcctccggccactaagggaacatatctgaacaaaatgatctttgaaatggagaaagggttatgctgctcatcacaaactaactgagagccctgggaaattgggagcaacctaaatcccgagagcaattggtggtgggaaagagagagaggctcaaaaattatgtgtcagtccctgggtggaataagatgatggtgaccggaccgatgcagtagctcatgcctgtaatctcagcactttgggaggctgaggcaggtggaacacttgaggtcaggagtttgagaccagcctggccaacatggtgaaacgccatctcaaataaaaatacaaaaattagccaggtatggtggcgggtgcctgtaatcccagctacttgggaggctgagacaggacaatctcttgaactggggaggtggaggttgctgtgagccaagatcacgccactgcactccagccagggcgacagagtgagactctgactcaagaaaaaaaaaaaaaagactccttagttgaggaggactttggtcacatgttcatttgttccttgaatccatggaacacaaaattgagcaacaaggtcaagtcctaaaagcactgaacacaacccctgctggtcaccgggagcaacagcaggctgtttatgggcatctttgcactctgtgttctcagtggccagacacagcaagcaaggctcacagctgtgcaacatgtggacggtcagaccatgcagggggctgcaaggatgctggaagaccgaaatgggaatttcacttcacgcttgtcacagcccttaaattacataaatactattgcatttatcagaaacatgaacttaggaatcaggaaccggcagatgaagtgaacttaaatactctcctgtctccccaactgtgagcagccctcagggcccccagttctcctagccacacccatacttacaagatctctgggcaggggagataataggggacataggagactggcagccagttctcaagatacaccctgtgaataaaaaaaagaaaaaaaatctgttgatccactctgcaccagaggctgaaaacgcacctcatgcacgtcattgggagtgcaggtctcccacagtgcattaggaggccaggtcccctgtcattctgtaggtctggctgaccttggaggacaaagcctgctggtattcctggcatgtgtcacagggcctgccatgcagtcattcattcacccatagagtcattcattcctagggagtgtatattcttgatgccaggccccccacacaaacagcagggtgaggggcagccccaggagcttcatggaaggacagaaacagagggtgaatttgggagcgtgaacggggattccccatcaacattggttgaaggatgatccaggcagagaaaagagcaagtcaaaggccaggaggccagtacaaggcagaattcagaagccggagacactagttgggtcttgttggggctggggttggagaacaggtgagtcaggaggggttggtgggatctggaatcctatgaggagatcaaggttttggggttgatctgcagagacagggggagtcctgggtggggatagagacagggagagtcctgggtggggatagagacaggggaagtcctgggtggggatagagacagggggagtcctgggtggggatagagacagggggagtcctgggtggggatagagacagggggagtcctgggtggggatagagacagggggagtcctgggtggggatagagacagggggagtcctgggtggggatagagacagggggagctccgtggggcagactcaccacaggacactgaggcttgtgcccgccaacaggcagaaccccagacccagggccagtctccggcgatgcattgctgggggctgcacctgagcctgggcacttgtagagacccccactggcctgggcggatgaggctgtcccctcgcagggatgtcaggctctgagcctggtctctgaggtcccaggaacacctgcaaaggaacacttttgttgttttgagatagagtttcactcttgtcaactgggctggagtgcagtggcgcaatctccattcactgcaacctcttctcttgggttcaagcgattctcttgtctcagcctcctgagtagctgggattacaggcacaagccaccatgcccagctaatttttgtatttttagtagagaagaggtttctccatgttggtcaggctggtgtcctgacctcaggtgatccacccgcctcggcctcccaaagtgctgggatgacaggcttgagccactgcaccgggccaggaatgctctttatggggagacggtgaccccagccctgcagccctgccctccctcggtcacccactgcggtcatgtggactctaggtcccgctggaccccgggctcagctctggcagctctgggaggcgcacggtggcagtggctcggtgctcagctgttgcttccagctgtcctttgggagaggggctgggaccgacttcgcagaggccgcgaaggcggatccctgccttggctcccgcgtctccgtactaggtccattgtcagaggtgagccgaggccgccgggaggggtgcatgggccagtccaccgtccgctggaaatcaagcaccgaggcacagcgaggacacatgcagtcccagcgcaggatgcgcgggaaggggcgcccaggattccccgaggggagcgaggtggccgctgtccacctctccgggaggcagggcccgggttctccacggaacgatgggaacgcgcctcaactcgctggctcgttgaccttgggccagtcatcccctgctcccggcctcagtggatggggggcggcacgcggcgcccggggggaggacacgcgggaacggctgtaaaacgctgggcgcagcccgggccacagtgagcggagagccggggtcctggggattaggccgctgccactcgggagtgtccggcaagccctctccctctctcttcctctggggcctcagtttccccactcgggcctccaagccccgtctcgcccccgcctcccgcgaacgcagagcccagccccgagcgccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagaggaagacagacaggaaagaggacagaaaagagaagccagacgggaaagagggcgccgcagccccgcccacctaccgcaggccccgcccctgcggtcccagagccccttccctgcggcctgggagcaggatcccgggggaccgagcgcctgagctgacccctgggcctggcttccgctagccgcctagaactctgcctaggatgcagcaggcccagctcggggggccgagaaccgcaggtccggggccatggtagggtgcgggtggagaaatgaagcgatttgtggggaaaaccttaccttgtttataagagctttgaagcagtcacggaaagggagaaccagctggacgcagcttgctgtccggtttaggatctgtcctcctttgctgggggcctctgagccaggcgcccctacccagcgaggggacacaagtgagtggctcccagaattacccggagcctccgtgttctcttctgtgaaatgggactggccacactttcttcccacggcctgtcggggttgcattatcccttccacgaagggctactcttttccaccccagggactctgggaccccaggagagaccctcttgcagctcaccagaggtccgccagtgcatggggtagaaagttttcgtagcagaaacctctcctaggaagggtgcgagaggggagggacagtaaggcgaaatgaaggggccctaagggaaaataaaagagagagtgacccaaggggtggggggtgggacccagccagagacgggctcagagaggttatgggtgtgctccaggtcacagtgcagctggaagttggaaacccagccctgcctggtgcctgggcacagcctcccaggcccctcaggggtgtgatgattacctgtgtccttggggtttctctagagcaccttggggttcctgtaaggcagggcctgttttctcagtctgcaggagcctggcaccggccctgggagctggtgagtgctgttcaaaagg[450 bp omitted]gaaataggaatgtaggcagagacttgcagtgttcaagggaaccagaaagaacaaatccaagccaggcagagtgggagaagagcagtggggagaagagtcactgctagccttccagttctgtctctctctgtctctgtttttctgtctgtctctctctatatgacttaaagaaaactcttattaaatattacttaaggccgagcatggtgactcaagcctgtaatcccagcactttgggaggctagggtgagaggatcacgtgagcccaggagttcaagagcagcctgggtaacatagcaagctatgaggctggagcaagggtgccagagtgagactatgtctcaaaaataagtaaataaataaaatttatgttttacttaatttttttttaatggagtctcgctctgtcacctgggctggagtgcagtggcgtgatcttttgagatggagtcttgctctgtcgcccaggctggactgcagtggcacaatctcggctcactgcctcccagttcaacctctgcctcccagttcaagcaattctcctgcctcagcctcctgagtagctgggattacaacatctggctgatttttatatatttttaagtagagacggggtttcaccatgttggcgaggctggtctcgaactcctgacctcaggtgatccacccacctcggcctcccaaagtgctgggattacaggtgtgagccaccgtgcctggccttacttaactatcttttgaggaggtggtgggccactgaagctgggacccagatcggcgcttccactgctagctgtgggtgagatgctgtccctgcttttgcgctgtgagctctcaggacagggatggtgtctggggttcactgtcatattccaggtgtctgcacacaacaggggtgctggatgcatgaatgagtgaaggaatgaatgaaaccaagacttctttgtgtctcaggttcctcctctgtcaaataagagtacctgcttcaaggggctgttgggaggatgacactgattcattcatctatttattcaataaatgtgaagtgcctcctgtgcctgaggctctgttctagaggctaagaacacacggtgaacaagcacgttccccgccggtgtggagccccccccaccccgagcagggtttaaatgaggaaagacgggtctcaggcacgtggtccaagctcagcgagggcagcggctgggatcgggaggtcagagggcagcggctgggatcgggaggtcacgggcaagttcttgtgcagcagctcagggccagcctgggtggggtcggcggtggaggggatgtaggactcttggtccgaactcccaggctatccagtgtccctctgtgaccattcccctcactgggcctcagcttttcatctggaaaatgggcttgtgaggactcatctctcggtttctccataaattggtcttgatcttctgaagctgacaaagaagtgacctgtcttcccactggtaatcctggagggctgaggtttgcattcatgaagggaatggggaaatgtcctctcgtagggggctggctaaagtcccccttctggtt[135 bp omitted]ggccttacctctgggatgccagagaatgctccagagtgtttcccagaaataagggagttcatggtcaagtctgggaactcaggtgagcaggggtggcagaaccccccagacctttaatctctaaggagaggtggggagagtctgcagagcttccctggccgtggagctggggtggagggactgggtggggtggaggcaggccccatggccccccgtgtgggcctcactctcctcactttaggagaagcttctgtctggaacaagagccagtgctctcctgagtggccatcaggcatctctgcaaagctcagtttggacccagacattgattttggctccccttggccttggaacctgggggtgggcagcagcaggagggtcctgaggacagaccccaagtctcagctcatcacccaagcttctgcccctgctttgctggctgatcttggacaaagcctcagtttttcccactatgcattgcagtgacagcttcctttagtgcttgtcaagctgggcctctcagaggcctaggaatggggtgtcggggaggaggctcctgaagtgtgtctgtgtgtctgggttgggggtagggagtccagacctcatcccagctccaccctgagcagctctgtcctgggtttgatacattggggttctacatctgtattatcagaacaatgtatcactgccccaaaaaggtggggtttaaagactacagggctgggtggactctgggccagccctactcctctggggctcccttcactgtgttcctctttgacctggtgtttcaggaggacaagtgcgttcacatccatacagttggcccacccagaacccagcggcatccaggagccagtctctgatccaagcccatcatcctgcactagctaaggcctggcctggatacaagcagaacccactgcaccctgtcccagggaagccagtccaagcactaactgaaaccagccagctaggcccggaggagggatcccagggctggttcctgggcccccagcacctgggagaggagcttcttggctgtgctggaagccatacctagaccttgaccccagggatgcccagaagaacacatgttcagcaggctcccctgagagcagaaggggccacgcttcagaaatggtggaaagatgaaaatccagcctccgcctgcatcaggacaatgaaataagataatgagttagatagcatatctcacctatgaagtgtgcagccatttcccccaaaggtccttgagtggaaaacacacacatacacacacacacacactctctctctctctctctctctctctctctctctctctctctcaaagggctttttctcttccctcattcaacagtcaacacagaagacttctgtggtccagcgtgtgggggtttcccacacaccaggcaacagacaccaggaggtagcatcagatcccccgggttgagatctcagtcccacaagactgccccctcccccacttcccactgacgccatcacaaatctgggtttccaaggagaatcgcttgaacctgggaggcagaggttgcagtgagctgcgatcacaccattgcactccagccggggtgatagagtgactccatctccaaaacaaacaaaaaaacaaacaaacaaatctgggcttccagagcttctgactcaccagctgcaaactggagttcccagagcctcctctttgggttcaattaatttgctagagcagctcacagaactcagggaaacatgtttactggtttattataaaagatactacaaagcatacagatgaagggatgtgtagggcaaggtatgggggaaggggtgcgaagcctccagccctccccggacgcccaccctttgggagcctctatgtgttcagccatccagaagctccctaaaccctgtcctcttgggccttttatggaggcttcactgggtaatcggataggcatgactgaagcatggacaactgtgtagaaacatggttggacaaaaagggcatggtctagcattagcgcacaatctagcattggcgcacggtctagcattggcgcacggtctagcactggcgcacggtctagcactggcgcacggtctagcattggcgcacggtctagcattggcgcacggtctagcattggcccacggtctagcattagtggagggggaaactcacaaggcctgtctgtgcagattcttcttggcctctccctacagcattccttcctccagggtctggggtgggactcctaaaatggggatcttgtgacctacaattagacaaggtaggtcagagaatttatggccagacagaaaggcaggggaagattcttgccttggggagaaaaaggagcaggtgaaaggagggcaggagaaggtcagagagagagagacagagagagacattctgttttctgaggcctgcttctgaggcctaaaacaccccaacattataacaagcactatgggagttatgagccaggaatcatggatggaaatatatatatttggcatgatatcacacccctgaagtttgaaacccttggattggctgagggggatggacactttccccctggcagtgggagaagggtctggactctccttctggagggtgagttggcactaagaccccagcacacccgcccttggattcagtttgtctacttctagaaaacaggaaaggtttagagacacgaacaaagggttcaagttcgaggatagtcatctctgcccatctcagagccccgagtggcacactcgccccccagccttgagcagggggatctggtgtccctggaggaagaaacacgccccgcagccattaaaggtgttgctgttggccgggcacggtggctcacgcctgtaatcccagcacttttggaggccaaggcgggcagatcacgaggtcaggagtttgagaccagcctggccacatagtgaaaccccatctctactaaaaatacaaaaaaaaaaaaaaaaatagccaggcatggtggcatgttcctgtagtcccagctacttgggaggctgaggcaggagactcgcttgaacttgggaggcagaggttgcagtaagccgagactgcgccactgcactccagcctgggcaacagagtgagactccatctcaaaaaaaaaaaaaaaaaaaatgctggtgtcagatcagacacggtggcttacacctgtaatcccagaactttgggaggccaaggcaggtggatcatttgagcccaggatttcaagacaagcctgggtaacatcgggagaccccatctctacaaaaaaattagctgagtgtggtggcatgcacctgtggtcccagctacttgggaggcagaggcaggaggatggcttcagcccaagaagttgaggctgcagtgagccatgatcgtgccactgctctccagcctgggcgacagagcaagaccctgtctcaaagaaaaaaaaaaagctggtgtcagacagaggtcagcacacccctcactggaccatgagccgagttaatggggtagactgggattttttaaatttatttatttttgagatggagtttcactcttgttgcccaggctggagtgcaatggtgtgatctcagctcactggaacctccgcctcccaggttcaagcaattctcttgcctcagcttcccgagtagctggaattacaggcgcccgccaccacgcccagctaactttttgtatttttagtagagatggggtttcaccatgttggtcaggctggtttcaaactctgacctcaggagatccacccacctcggcctcccaaagtgctggacttacaggcgtaagccactgcgcctggcctggattttaaacaaaatagaaaacattagagagtggcctcccaggaagggccagggtttcgtggactgctggtctcaggtgtgtgcgtgtggacaccgtcagacatgaagtgttctagatgggggacaggccaggtgtggcaggtgtgggagggggttggggtagcccaggacacctgtacaggagaggccgcctcctggcctctgacatccttgctcagggctccccgttcccaggagagtggggagccttgtctttgagccagacagacctggctaaatccccagcactgctacttactggccaggaggtgcttccatttcccacttagagcatgggggaaccacgttctccacctcagaggcttggttgcagatgacacggtttgcgctccagcccccggcacacactgatggcagctggtagatgactacacctgcgtctggcctggctgtactaggcagctccctcacccagcccgctgctccgagcttgaccaggcactacggttacctctcaggcaccaggtgccctcccggctgagctttcctggcccgaggaggctacttactccagcctctcacaaggggggatgcgtgcggagaccccagggaggcagagaggatgcagcccctggctgtgctggggtttttctacttacaaagctcctggtgcattcgcttcaggctctgtgccgaggcagcccgagctgggcaggaaccacagctgcaccgctctctggccgagagactttagtcatgaccgtttccctctctgagcaccggcttccttgtttagaacagaacagggatccacggtgaagacccctgctcccaggtgggatagcatcatgtacttcaaaccccatgggagcgtcctcgtttgcatgccagcaccagccagcagagcaagagcattaatgccccagggacgaccctttaccacagagatggagcccatccaggtgggacgccgggaggctgagccgagactgagcccaggcacccaccacagagctcgctcatcagggccactctccggctcccctcctccgggctcaccttcccatgtcctcactcaggtgtcctgggatcatctgcaacaaatgacatgtccccaagtccttgtctgctttcagggacccagactctgccagggttccacactgtctgcaggacttgagcaggtggtctctaccttctggacttgagtgtcctaatctgtaaaatggggacaaaagtcctaactcatgaagtcactaaaggagacacggcatgtgcacatgcaaagtgatgcacagtcaaaatgccaatcaattgcaaagggaaatgcaaatcgtgggaagaaaccggagctcgcctggctgaggaagggctgctggcagcctgtccagacacagcaagccactgccaagggagaccctggcggagtcagatcacttagcaatggaagaagagacaactgacaaaaaagataatgtgacagacggtttcaaagagaacaatttaagcactagaagatttacgaacccttaggaaaattaatgaggccctagaagatttctgctgatacgctataattttgtcgtaaaaattgtgtcacacgtacctaatctactgtggacttatttattcattgttgtttctaaaactcagtgtatacttgctattatagcttccttttctgggggaggggggttgggacagagtttttctctgtcacccaggctggagtgcagtggcatgatctcagctcactgcaacctctgcctgtcaggttcaagcgattctcagcctcagtctccccagtagctgggattacaggtgcccaccaccacgcccagctaatttttgtattttcagtagggacggagtttctccatattggccaggctggtctcaaactcctgacctcaggtcatccgcccgccacagcctcccaaagtgctgcgattacatgcgtgagccactgcactgggccacattttgttaaatatacatttggctggacatggtggctcacacttgtaatcccagcactttgggaggccgaagtgagcagattccttgaagccaggagttcaagaccagcctgggcaacatggagaaaccccgtttctacaaaaaatacaaaaatacaaaaattaactgggtgtggtggtgtgtgcctgtagtcccagctacttgggagtctaaggtgggaggattgcttgagccagggagggagagaatgcagtgagattgcaccattgcacttcagcctggacaacagagtgagaccctgtcttaaagcaaacaagcaaacaaaaaaggctacatttatttttcatatttttatttcatttttcaagatcaagtgccaagtaggccttttctccattatttctttcaaatacaggactctcttttaataaaatggccaattcccggtgctcatcatccctgctaaccccatggaccgtccctgcacgtcacagagtgggcgtgagctccacgtggggagtgacctcatcggatcacgctcactgaggcacacagctgggcacacagcaggaccagagaatatttgctgaatgagtgaatgcatcaggaagctatggtgctggtgttaccagctgttaaaacttcagacaagttaaatttgatggagtttaattggaaaaaaataaaaaagaaatgattcacaaatcgggcagcctccagaatcacagcagattcagagactctgggggttcctcgtggtcagaacaaatttatagacaaaaaagtaaagtgatgtacaggaattggaaatgaagtacagaaacagagattggttgcatctcggcgtttgccttagttgaacacagtttaaacactcagcagtctatgagtggttgaagtatggccgctgggattggccaacactcagccattgttataggtgcatactactaagttgggttttccatcttgtctgcctattaagccagcttatggttcatccacaaggactcaaatagagaggtagggagtcccttcttaggccatatttagtttgctttaacaattcccctcttttggtcagcctctcaatttagagagattgaccgaagctttaggcattgatgccactctctgtcaccatcctaaagacttatttggtctcagtgtggaattcacaagtcttctttagtttcagtatggagtctcacacatcttctttggtgttaacatggaattcacaagttgcagctttgtaccagctaaatgattctttatgttctttttgacctggttggaatgagaccattcaactctcaatggatggctgcatacaaaacatttaagacttgagaggatacagtgtatcagggtgacgattattatgactatcaagaggatactatcaaaatgccaaggcgtactccttaatgagagttcttatgaaatgaaccgaaccaaattagccaagtgaaggttcagacaatataggcagttcaacagtgttagggtccaattggtcattatcctcgtttagagtatgatagcgattaaggaccatggtttgctgtaaagtggcctgacttaaacagttactcattttcattgttacattggtaatacaagtcataataacttggaaacctactagaagaattataaggattagaagcccttggaaaacccaagcttgccatccacccttaggatgcctgcaaaccgttagttgcctattgtaaacatgtcatgggctcctttctcttgagagatgtctttaatgtatttggtggcagtgtctaaggaaacagcagtatcagcaccttttaaattaagcttcctgtaataacaaaatcaggtaagagataagtagtacaacattcagttttgtttaacaccaaacctaggcttccagcttgagcaaaaagatctgaggttgcacgatgttccagtaagtgtttttgctgaattcacgtgttgtcatctatcttttttttttttgagatggagtctcactctgttgcccaggctggagtgcaatggcattatcttggctcactgcaaccaccgcctcctgggttcaagcgattctactgcctcagcctcccaagtagctgggattacaggcatgagccaccatgcctggctaatttttgtatttttagtagagatggggtttcaccatgttggccaggctggtctcaaacttctgacctcaagagatctgcccgccttggcctcccaaatgccgggattacaggcgtgagccaccatgcccagccctgtcatctatctttctgagagcagcttctacccatctgaaaccctgggaggtctgattgattacaaaatccaagatttttcccaatttacaaattagctttaaattccatacaactgctatctcactaccaccaagagtgcacccccaggaatcccactggaatctttcctcagtagaaacgagcttatcctcaaatatttcaaggctagtgctaatttcagttattgatcattttggcctccaatcataagggccatcatgagaattttcaggggaagctatttgaaaggcaggagcaagccaggccacataacaagaacccaaccaatgaggaggcagaacaggatacgcagactcttcacagacccagtatagacccttggggattggaaaagagggccacctagttgcatttgagcagagatcagtcaggtttgttcgaccacaaatctgcatacctcctgaacaacgtccagtgggaaatttacttttctgtggcccctttatagcatgttgtaagggtatataaccatatctagtaaaaaagagaccctactggatttaatccagttacattatacaagcaatcacttgtatcaacataagtaattcccaaatcttgagtgcgtgatgtctggaagcacaatgtatcttttgctggcatcacttggatttttttttttgagacgaagtttcgctcttgttgcccaggctggagtggagtgtaatggcacgatcttggctcactgcaacctctgcctcccaggttcaagtgattctcctacctcagcctccccagtagctgggattataggcgcctaccaccatgcctggctaatttttgtatttttagtagagatggggttttaccatgttggccaggctggtctcaaactcctgacctcagttgatccacctgcctcagcctcccaaagtgctgggattacagacatgagccactgcacccagccttggattgtttttttatatttggtaatgatcgacttatcaattgaaaaagttagagtgttgtttttagtgagtgtaggaagcaagtagcagtgatgtttagcatatcaagaataactttctgttcttcccttagtttcaggtagctctcgctgggaacgcggaggggcactggcaccagtggaatcatttcctgatttttttttggcattagcccacaaacccaacaattactctggttttgtgctagagcataaacttgagctaaagccatccactgattatggtgccatgggtttgcctgtagggaaaaggacaagattagggcagaagatgaggaaaacagaaaaacacataaggctttcctgatgatagagaagtcttggtccatgatcttgggaaagctgtccaaaactaggatgctgtctgcttctgaagagagatttccttggtcagctttactttaaagtctccaacaggtgtacagttccaggactctgaaggggcccctttttgtttttttgagacggagtcttgctctgttgcccaggctggagtgcagtggcgcgatctcggctcactgcaagctctgcctcccgggttcacaccattctcctgcctcagtctcccgagtagctggtactacaggtgcctgccaccacgcccggctaatttttttgtattttttagtagagagggggtttcaccatgttagccaagatggtctcgatctcctgaccttgtgatccacccacctcggcctcccgaagggctgggattacagacgtgagccaccacgcccggccaaaaacatgcaaactattacaagaacatactgataccccattgcgcgtcacaactaaattaagtccatctgtaaatgctcaaattgttcatcaggtggtggaaatatatgacctgaagttttgattgtttttccaggattatgagtttgacaagtcaaacattgattataaaccattttagcaattttggaacagtcacccgaccagtattttttcataatttggatcattttgtctgttccatgatgagcggtggagtgcagcgttttcaacaatggaagcttcaaagactcaggaaggaccaggcggccgtctgggccctccgtgagtctgtgcatcacattaaatttacatccttttagataccaattttgcttttccaaatcaggtgcactgcactgtttactaagcaggtcatcataaggaagtgggctcggcttaatccaatggagttcattcagattgcatttcttaacagtttcagcactagctgatttagcataaaaatttgctaaagcatttccctgatatttgggttcagttctacaagtatgagcttcaatcttagtaacaacagtctacaatggtaacaggatagcagaaaggggctcatttacttggggtctatttttgatggaggtcccactagaggtgagaaaccctcatagtttccatatcacgccaaaatcatgtactactccgaaagcatatctactagctgtataaatatttactgacttgtcctcagctatatgacaaacttgggtaaggacaaaaagctctgcagttcgggctgacttaaattgaggaagcgtttccttctctattcactcattttggatggtaacagcatattctgcctggtattttccttctgagattttaggataggacctatcaacaaaaagtataaatccaggattatccactggagtatcttgtaaatcaacatgaggggccactatttctggcactacatttacacagttgtgttcttcaccatcgtcaggcaaaggtaacagagtagcagggttaagtagattacagcattttaaatgaagattaggagatagcagtaattcataaaatgttagtttacttactgaaaaatgctgggtttggttggaatttaacagactttccacagcatgtgaggtttgcaaattaagttcgcttcctaaaaccagatctgatgaagcttctaccagcttggcagctgctgctactgcttttaaacagttagaatatgccttagagtctgggcctaattgcaggctatcgtatgcaatggacctatgtttagcaccacgttcttgtgtaaggactcctaatgcctgattgtcacactcatgaacaaacaaggtgaaaggcttagggtaatttggaagtcctaaagctgggggctgttgtaaggccaacttcatttggctaaaagcctgctcatgactatcttcccaaggtaaaggctctggtacagcatttttagtgagttcatacaatggcgaacctattaaggaaaaatttggaacccaggatctgcaatatcctgtaagtccaagaaatcctcttaattgtcttttggtttcaggtcaaggaaaactttgaacagtttttatcctcccaggtgagaggaaatccctttggcagtcaagtcatgtcccaaatagtggaatttttcttttgaaaactgaagtttttccatttaagccttgtgatctttatatgcaagttgttgtaaaaggtaaactgagtcaatttcagagcactccttagtgggagaacaataagtcatctacatactgaatgagagtacaattttgaggaaattgtagtgttattaagtcctgatgcaatgcctgggaaaaatatgaagtggctttggtaaaccctagtggctttacagcccaggtgtattgcctatttttccaagtaaaggcaaacaagtattgacttttttttttctttggagacagagtttcgctgctgtcgcccaggctggaatgcaatggcatggtcttggctcattgcaacctctgcctcctgggttcaagcgattctcctgtctcagcctcctgagtagctgggattacttacaggtgcccgccaccatgcctgactactttttgtatttttagtagagatgggggtttcaccatgttggtcaggctgtcttgagctcctggcctcaggtgattcacctgcctcggccttccaaagtgctgggattacaggcgtgagccaccaaactttctttatgaactggaatgctaaagaaggctaagcagagatctattactgtggaccacttggaactaattggtacattagataataaagtatcaggatttggaactacaggaatcttggtattacaattttattaaatgcccgtaaatcttaaacaaatctccagccttgtccatttggttttttaactggtagtactggactgttacaagggctggtgcacgggattatgagtccttgtttaatgaaatcctctacaattggtgacagcccttgaattgcttcaggttttagaggatattggggtaatttaggcaaaggtttagaacgatctctttgtacttttataggttccaaacttttaattcttaccatatcagttggggaagaggcccaaaaacatttagatatttttgaaagatcaggggtattacaggcctgagtttcaatcttatagatttctgtctgtagacagcataacaattctagtccaggagaatcaggaaactctaaggttatttctcctgagaaaaattttatgtgcccttttagctttgaaagcaaatctcgccctaacaagtttactggagcagtataacatagtaaaaaagtgtttttctgaaaaggggcccaaagctaattggattggttcagatacgggaacctcttaaacttgatttgaaacccccaccacagaaatgacctttttactccaagggatttgttggcttattaaagtggggtttatggtagatagagtagcccccatatccccgaggactgtacacaactccccatttattttaacctgtttctccacgttgatttaaaggcacggagagcaatctactggagaatcccttggaacctcatcaaggttgattattatcaggaggcctaaggtctcttgggctccctctagtggtgaaacagtttggccgaaagggaggctcattggtggactgatagaaaagcggacaatcccttttccagtgccctggttgtttgcaatacaggcagacatcttggggcaaagaacttcttgttctaggacctcctgattgtgatttaaaatgagaaggaggcagagcgcagtggctcacgcctgtaatcccagcaatttgggaggccaaggcgggcggatcttttgaggtcaggagttcgagaccagcctggccaacatggtgaaaagctgtctctactaaaaatgcaaaaattagccgggcacggtggcacgcacctgtaatcccagctacctgggaggctgaggcatgagaatcgcttgaacgtgggaggtggaggttgcagtgagccgagatctcaccactgcactccagcctgggtgacagagtgaaactccgtctctaaataaatacataaaatgattaatcccttgggtcccggtccctgtaactgttatagctgaagggccataagcttgttagccttttgagttttttcttgctctagagtcctctcaaaatgtccagctaaggccaacaatttagtcatatctgtaacttcctatcccaactcatgtattttaattaaattgctgagttcgggatggagtccatttacaaatagagcacttaatgccgtttcagtccttgcaggaaatacttcttgttgtacttggatcccagaatgtttcacaaacagcatttctaagtgagttctgtaatctgaaactgaaatctttttttttgttatgtttacaagattgtatgatggaccagtccattttttgcggaaaaattttaggaattgaatttaaaaggttttcagcaatttttccagcgacttttggtccttcttgtgaggagcttttggaggggtctttaacatcctcctcaggtttgccccattctgctgctgccgtccatttccgagctttaccaggccccaatatcacgggaatacattagtgaaggtcaggaagtcctggatcataagctcctatgaggattctaaattcctcagtaaatttttgaggattttctcttggatcaggcaagtccctcacaatggctctaagctcagttttagaccatggagtgaaagtagttacagcaggcaggcatgactgatcagaaagtctcactttgtaaggtgcctgtctaacttattattatttttttaatcgtcttcagggtgaaagggtaatatatacatattttttattttttatttttttgagacagggtctcactctgtcacccaagctggagtgcagtggtatgatctcggctcactgcaacctctgcctcctgggttcaagcaattctcctgcctcagcctcccgagtggctgggattacaggcacgcagcaccacgcccagctaattttgtatttttagtagagacgaggtttcaccatattggccaggctggtctcaaactcctgatctcaggtgatccacccacctcggcctcccaaagtgctgggattataggcatgagccaccaagcctggcctgaaagggtaatttagcaaaaaggttagtggactcagagtatgtaggtagagaaggataaagagaaggaacagtcaggatgaggtcagtcacagtacagtcctctttcatcatgtcgttagtttgttgcttaagcttttcgtttgctttttgcaaagaatcttttaaggagtcaatttttgattcatttactcttttaggggcttctgcataccaataaaagaatacacatcccactgttttatggggtttttcattcccccttttctaatatgcctcataaataaacaattttatccaaattaaaacttccccattgcagccatcttaattctaagttttctttagttaggttaacccatttttctaaaaatgcacaagttctgggcccataatttttatgcataaaattagctggagtcccagaatgtggagtcccagactccttggattgagagggttgcatctgagctggttccagccttggagtaggggctgctgctggtcccaggctccatgctgggggcctggtggccagatggaaggttcagctttgcagcggtcacacctgctgggtgaatgggtgttctaagggtgctcgttggcacaggtggctgtgactcatatctgggaaagtgtgagggaagcgcacagagggcagccgtccctttggtgtcagggctccgtccccatgggcagtgctccttggaaaaagtcagctactcctttggatcctggggagcaaaaggcacctaaggcagtgagtagtccacagaggccaggtcagcctggtgaccaggaggtgtcctgcccagcagcaggacaggttctgtgtgaaactggaatctggaggtggcctgggctgacaggtgggtggagggtgtctggatggctttgtccactcccgtctgtaagtgcttagccactctgcaggtgagaccctaggaagggaagccctggttggtgccaggggttgattagaagatgcccttgcaggcatggtggctcatgcttgtaatcccagcactgtgggaggctgaggcagaaggactgcttgagctcaggagttcaagaccagcttgggcaagatggtgaaaccctgtctctataaaaaatttaaaaaattagcatgtgcttgtggtcccagctacttgagaggctgaggtggcaggatagcttgagtccatgagatcaaggctgcagtgagccaagatggcaccactgtactccagcctgggtcacagagtgagaccctgtcgtaaagcaaacaaacaaacaaacaaacaaaaaacccccccaaccccataaagttagcagatggaaggaaataataaagattagagcagagataaatgggatagaggagagaggagcactagaggaaatcagtgaaaacatgttccttccatgaaaggttaacaaaattgagaaacctttagctagttgactaagaaaaaaagagataagactcaaattactaaaatcagaaatgacagggtgacatcaccaatgaccccacggaaataaaaaggatttataaagagaatgctaggaacaattgtaggccaactagttggttaacgtaaatgaaatggacacattcctagaaacatacaaactaccacacctgagtcaagaaatggaaaatctaaacagacctgtcagagtgaggagattgagtcagtgatcagaaactttcccacaaagaaaagcccagaaccaggtgacttcactggcgtatcctcccagacatttaacatgtaacaccaatccttctcagacttctcaaaatcttcaatatgatacaccgtctccctagaatgaagggaaaaacccatcatcccaattcacgcagaaaaagcatttgacaaaatccaacactgtcatgataagagcactcaataaaagagaaatagaagggaacttcctcaacaggattaagagtacttacgaaaaactcacacctactgtgactcggtggtgaaaggctgagagctctctgcctcagatgaagaacgagacaaggatgcctgctttcaccacttcactccaacatcgtgatggaagtttgaccagagcaattaggcaagacaaagaaataaaggcactgaaattggaaagaaagaagtaaaagtatctctgttttttgttttgttttgttttgttttttgagatggagtctcgccctgtcgcccaggctggagtgcagtggcgcaatctcggctcactgcaacctctgcctcccaggttcaagtgactctcctgcctcagtctcccgagtagctgggattacagatgcgcaccaccacgcccagctaatttttgtattgttagtagagacggggtttcaccatgttggccaggctggtcttgaactcctgaccttgtggtccacccgcctcggcctcccaaagtgttgggattacaggcatgagccactgcgcctggccaagtatctctgtttattgatgacatgaacttatgtgtagaaaattctatggaataaaaataatcttagagttaatgaacaatttcagcaaagttgcagcagagatgaggaatacacatacagatcagtggaatacagttgagaatcaggagataaatccatacatgtatgtcaattgattttcaacatggctatcaggatcattcagtgaggcagaaacagtctcttccacaaatggtgccagcagaactggatatcctcaggcaaaagagggaagttggagccttacctaataccatataaaatattgacttaaaaggaattaaagacctaaatttgagaaatgaaactttaacactcggccgggtgtggtggctcatgcctgtaatcttagcactttgggaggctgaggcgtgtggaacgcctgtggccaggagttcgagaccagcctggccaacatggcaaaatctgtctctattaaaaatacaaaaaaaaaaaaaaaaaccagacatggtggcacatgcctgtaatcccagctactcgggtggctgaggcacgagaattgtttgaacaccggaggcggaggctgcagtgagccgaggtcacgccactgcactcactccagcctaggcagggggaagaaaaatgacactcttagagaaaagagcaaatctctatgccctttgatttggaaatggtttcttaaatatacaaaaagcacaaacaacagaagaaaaaaaacaggtaaattggacttcattgaaattaaaaccccttaagtacaccctgaaaagaatgaaaagcaaacccacaggatggtagaaaatatttgcaaattataaatctgacaacggttttatatccagaatatatacagactttttactgctcgacatcaaaacacaaataacctaattaaaaatgggtaaaagacttgcagagacatttcttcaaagcagatgtacaagtaagtggccagtagcacaggaaaagatgattcgcatcccgaggtgttggagaaatgtaaaccaaaaccacagtgagatcccactccacacccactaggtggccacattttacaaaatgagagtaacgacggctggagaggatgttgaggaaaccgaagcctcatattttgctggagtaagtgtaaaatggtgtagtggctggaaagcagtttggcagttccccagaaaattcagcatagtgctaccatttgactccgtgatttcttttttttttttttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccgtgatttctttcctaggtatatacccaaaagaattgaatacaagctgggtgtggtggctcatgcctataatgccagcactttgggaggatgaggtaggaggatcacctgaggccaggagtagctcaagatcagtctaggcaacacagtaagccctcatctctccaaaaaaaaaaaaaaaaaaaaaaaaaaaaaaaaaatttagtcgggtgtgatgacgtgtgcctgtaatcccaactactcaggagcctgaggtgagaggattgcttgaacctgggttgtcgaggctgcagtgagccatgattgtgccattgcactccagcctgggcaggcaacagagtgagaccctgtctcaaaaaaaaagtatggtctgtccatacagtggaatattatccagccataaggagggatgaggtattgatatatgctacaaagctgatgaaccttgaaaacatctaagtgcaagaaacccttcagcgaaggccacacgtgatatgatttcacttgtatgaaaaatccagagaaggtagacgaatagacgggtggcagattcgcggctgacagcagggggagctctaatgggagctcaggggccagctctggtgctagaggcgccgagtgggagatggggcgtgactacttaccaggggcagggtttccgtttggggtgatggaagtgtttagaactgagagtggtgatggtgcccaggatggtgaatgtagtgaataccactcagttgtacaattgggtacgttttaaaaggtaaactttaggccgggcgcggtggctcatgcctgtaatcccagcactttgggggccgaggcgggcggatcacgaggtcaggagttcaagaccagcctggccaacatggtgaacccccctgtctctactaaaaatacaaaaattagctgggcatggtggcaggcacctgtaatcccagctacgcgagagctgaggcgggagaattgcttgaactccggaggcggaggttgcagtgagctgagatcatgccattgcactccagcctgacgacagagaaatactccgtgtcaaaaaaaaaaaagtaacctttattttatatgaattttataacataaaatacaggtaactataaagtatatgaataaaagaaaaccaggcaggaaaaaaagaatgccttgacaggtgagggccatgaaggttctggtcctggggctggcactggctgtatcttgggagctgggactggagctggtgccagagctgattctagctgtggttctgggccagcgactggctctccctctggaggtgatggcagagtcgggtttgacgtgcagccggcactagccttagctgtgaggtggatgctggagtggctctaggtcaggaggtgatactacaggaggttctggacctgtatccgaaatgaaaactctcactggctgtctccttgaattggtgctggggcaggtcatagctctagagatggcaccagagttggcgttagagctgcctctatccctggagttgctgggagtggtggtgcttgagcgatttctggattggtgttggagctagagctcttgttgcagctggggttagctctagagatggtatccgagttgagagagctgcctctatctctggagttgctttggtgttggagctagagctcttgtttaggctctggaggcagcacaggctctagcttggagctagtgctagagttggctctggacctgacttcctctgaatctggtgctggccatagtatgagcctggcattgactctaattctgtaatcattttggagccggttcaagctctagagctggtgctagaactaccattgcagctagtgcagcaatttgtgataaaggtgcccaaactccggatttgatgttcaagttcgtactggagctagatctacctccgctgatggtgctagagctgtttctggagctgcttgtagctctgaagctagtgctggggccatctgtagctctgcagctggtgcgggagctgctgctggcccgggctctacctctggagctgatgcgagagccagtgctgccactggctcttcctctgaacttggcactgggtctagctccatgtctggtgctggctccaattctgaattggttggggagctcgttctggctctagatgaggactgtggggaccatcagcctccgctcaggctgggcatgctgcctggatggcccagaactggtcacttgtcaaaacagtcctgcaggagaggtccgtctgtacccagagaggcctgagtgaggggaccagggactgcccacctgcctggcaccccaggacgctcttgtacctgttgtcttgtccttgtccgggccgatgtggatgacgtggcgtcgcctacctgcaggttgtagagcagcgtgaggagctgtggctgcagagccctgagactgagaatttgaaggtgggtttagcagccgtggtgtgctggaggctgaagaggaggaggtgctgctggagtcggagttggtgccggaggtccctgcggatgacagcaaggtcgattcccagaactgaggggaatagcaagatcagcagaagcctggaccctgcagggcttctgaggccagcgtccccctctggggcttgttagcagctccattcagcagtcaggggtttgttgcttcttttttgggtgcagagtggggaacgcaggcaccggctgggaggggacatagaatgaaagagctgtcagggagaagggcaagcagtcgccttctttccctgccattagggggctccaggacaaagctgacattgatctccttcactttgcagctggaggagccggctgagtgcacgctgagtgcattggcaatgtcccggctgctgagggaggagctcacctgagctggtctcagggcttgagtggaagctgcctctggtcctgagctccctgctgggggcctggcggctggaagggcagcttcaccattgtcagatctgctggctgagtgggtgctctaggatgccccgggcatggatggcagtgacctgtactagaagggtgtcagggacatgctggtgggggggggggcagcacgtggggccaacagggctcggagcatggtggcagcacctgctggaaagggttagctggtcctctggttcccagggcacagaaggcaattatggcggtccactgaggccaggtcagcctggtgaccagcaggtgttttatccaacagaaggacagagcccctggagtctggggtggcctgggcttgcaggtggctggaaggtgcctgactggcctggtcccctccagtctgtaagtgcctagccagcagccagaccctggggagggcggccctgtggtgagtcagcacaggagatggctgagaggatgcccttgggaatctccagtcccttctgcttcatgcaaggagggccgagctgcctccacacctgacctgtgtccccttgctaagcgttgcttcttttggacaaagtcatagtcagcggtagagttcacggttgaaaacgtgttggcgttgtcaggggtcttcagcttggtggggaagggcagaaggatggtcagctgtgctcaagagggggccacaggccagacagagaactccacagggacagaaagcagatgagtggttgtcaggggtgaggggtggagagtgactgcttaatgggtacagggtgtctgttagtggtgatgaaaaaattctagaactagagagtggtgatggttataccacatagtaaatgcatttaatatccatgaattgtatagtttacaatgattaaagtttaaatttcatttcattgtgtataatttgttttagttttttgagacagagtattgctctgtcacccaggctggagtgcagtgacgagatctcggctcactgcaacctcaacctcccaggctcgagggaaacccccacctcagcctcccgaggagctgggactaccacttggctaattttttttttttttttttttgtagaaacagggtttcactatgtttcccaggctagtctcaaactcctgagctccagcgatccacctgcctcagcctcccaaagagctggaattataggcatgagccactgcacctgatctgtatataaaatttaaatcacaaaatataataaaccataaagaatatgaaatagaaacatactataaaaatgaaatgttgccagcccagggaggggccttaaagctctggcacaggagctggtgctgaaggtggtgcctgcctgaggctcccgcactggagctggagtggtggccgatgctcgagctgccgcgttctggctgtggaactggctcagtagcgggggcctgagccagggctggagctgcctctatcccaggcagtggtgctggagctagatctagaactggctcttattctggagctgattctaactctagcctggtgccagaaggggggcaagaaccgacactgaagatggctttagctctggagctggcccgagtgttggagctggaggtggctctagctctgtggctggcacaagaccttatgctagagcaggctctagctttgtagcctccactgctggctgtgggtgagatgctgtcccctctgttgggctgtgagctctcaggacagggatggtgtataggttcactgtcatattccagaggtctggggttcaccatcatattccaggtgtctggcgttcactttcatattccagttgtctggggttcatcgttgtattccaggtgtctagggtttaccattgtattccaggtttacggggttcactgtcatattccaggggcctggggttcaccaccatattccaggtgtctggggttcactgtcgtattccaggtgtctggggttcatcgttgtattccaggtgtctggagttcaccattgtattccaggtgtctggggctcactgtcgtattccaggtgtctggggttcactgtcatattccaggggcctggggttcaccaccatattccagaggtctggagttcaccatcatattccaggtgtctggcgttcactgtcgtattccaggtgtctggggttcaccattgtattccaggtgtctggggctcactgtcgtattccaggtgtctggggttcactgttgtattccaggtgtctggggttcactgtcatattccaggggcctggggttcaccatcatattccaggtgtctggcgttcactgtcgtattccaggtgttgggttcactgttgtattccaggtgtctggggctcactgtcgtattccaggtgtctggggttcactgtcatattctaggggcctggggttcaccaccatattccaggtgtctggggttcactgtcgtattccaggtgtctggggttcaccgtcatattccaggtgcttgggttcactgttatattccaggtgtctgggattcactgtcatattccaggtgtctggggttcactgtcatattccaggggcctggggttcaccaccatattccaggtgtctggggttcactgttgtattccaggtgtctggggttcactgtcatattccaggggcctggggttcaccatcatattccaggtgtctggcgttcactgtcgtattccaggtgtctggggttcaccattgtattccaggtgtctggggctcactgttgtattccaggtgtctggggttcactgttgtattccaggtgtctggggttcactgtcatattccaggggcctggggttcaccatcatattccaggtgtctggcgttcactgtcgtattccaggtgtcgggttcaccgttgtattccaggtgtctggggctcactgtcgtattccaggtgtctggggttcaccgtcatattccaggtgcctgggttcactgttatattccaggtgtctgggattcactgtcatattccaggtgtctggggttcactgctgtattccaggtgtctgggattcactctcatattccaggtgtctggggttcactgctgtattccaggtgtctgggctcaccatcgtattccaggggcctggggttcaccatcgtattccaggggcctggggtttatcatcgtattccaggggtctggcattcaccatcatattccaggggcctggggttcactgttatattccaggtgtttgaggctcactgtcatattccaggtgtctgcatacaacagggagcagcacacaggtgctgaatgcatgaatgactgaatgaatgaacccaagacttctttgtgtcgcaggattctttagagcaccccctcgaagggctgttgggaggattacactgattcattcatctatttattcagtaaacattaagcacctcctgtgtcaggctctgttctagaggcttgagagaattgctgtgaacaagtacggtccccactggtgtgaggctgcccgagcagggtttaaatgaggggaggcgggtctcaagcacgtggtccaagctcagtgggagcagctgccgggatcagtaggtcaggcacaagttcctgtcccgcagctcagggccagcctgggtggggcctgtggtggaggggatgtgggatccttgctccaaacggccatgccatgctatccatgattcccaatggctttcccctcactgggcctcagttttcccatctgtaaaatgggcatgtgaggatatccatttcctggttccataatgaagttgaccttgattctttaaggcaagcaaagaagagctctctgcagtttgtctgtcttcacgtgacctggaggcccagggttagagttcactgcaggacctgggctatgtgtccccacaggaggactggccaatatctctcttctggtcagtggttgagctgggccaggagctccggcctggcccatagtgaccatgatgacccaggtgttggggacatgctggtaaagcaatctcctaaggtgctggtaaaatccagctgggtgcctcaggcacagagcagtaagtgctagccctggtagcaactgggtttagccagagatctttccagagtgatacataaaaggctccctcctttcactttttcttattttctttcccaactacattgtattttgtcatgtggatggtcatcatttatttaaccggacccttgctggaggaaattgggttgtttctaatctttggctcttgagaggaaagctgcaatcaataactgtgaacacatgtcaagtgtagaagtgttaagtgggatgaattccctgtactgggactgataaatgaaagggtaaatacatttgtaattttgtggggtttttgttgttgttgttattgttttgagacagagcctctctctgttgcccaggctggagtgcagtggtgcgatctcggctcactgcaacctccacctcctgggttcaagtgcctcagcctcccaagtagctgggattacaggagcaccatcatgcccagctaatttttgtatctttttgtagagaaggggtttcaccatgttggccaggctggtctcgaactcctgacctcaagtgatccacctgctttggcctcccaaagtgctagtattacaagtgtgagccactgcacctggccaatttgtaactttgatagatatcgtcaaactgcatccattggcaggcaacttatatttctgttggcaatgaataaaagttcctatttctacacagcttcagagtatattttcaaacctttggattagacaattttgtatattatcattgagaatgaacatacgttcatatgcttaaaaccttttgtatttctttctgtaaagggtctcatactctcttttgctgatctttttcttatcaatttctaggagctctttacatattggggatgggagtcattttcctgagatgagttgcaggtatttgttcccagcgtattccttctttttcacattgtggggctccccctaccatgtattactgaattgagttctccccaaattgatctatagatgcaatacattctttatgaaatacaacagcagatattgctatgtggaatctgaggaaccaatttaaaaatttatgtagaaatacaaaggactaaaatagaaccagaagaatcttgaataagaacaaatttggaggacttatgctatgagatgttcagacttatgacgctacaggagtcaaggcagtgaggttgtagtgcacaaaacagacccacagagcaacaaaaacaaatggaggcccgcagggtggggtggctcacacttgtaatctcagcactttgggaggttgaggcaggcggatctcttgaggccaggagttctagaccagcctggccaacatagtgaaacccagtctctactaaaaatacaaaagttagccaggcatggtggcgcatgcctatattcccagctgcttgggaggctaaggcaggagaatcacttgaacctgggaggcggaggttgcagtaagccaagatcatgctactgcactccagcctggggaacagagtgagactctgtctcaaaaaaaaaaaaaaaaaaagaaagaatgaaagaaaaagaaagaaagaaagggaaaaaagagagaaagagagagaatggaggcaacccagaccgaaacatagacatttatgaatcccatgagctgaattcaggaagccagacacatgagagtatattctgaggatgaagcaacatatgaaccacgcagacacattagcagaacgaaagacaaaccccatggtaatgccaactgatgcagaaacagcatgtggccaagattcaacatcctttcacagtaaaaaaaaaaaaaaaacactccacacataggaagaggacggaactgcctcaacacaatgaaggtcgcttatgaaaagctcacttctaacatcatactcaatggtgacaggctgaacgcttttcctccgagagtgggaacaagcaagggtgctggctcttgtcttttctgttcaagtgagtattgaaactcataaccagatgagttaggcgaggaaaagaaagcaaaggcaccaaattggaaagaaagaagtaaaatcatccctgtatgcgggtgacatgatcttatacttagcaaacctcaaagttaccaaaaaagttagaaatgtaaacgaattcagccaagttgctgatacaaaatcagcgttcaaaagtcagttgcctttccatacaccaacaatcaacaatccaaaaggaattaagaaaataatttcaatacagtggcatcaaaaagaataaaatactagtggataaacctaccctacaagctcaaagacttgtacactgaaaactataaaatcttgctgaaagaaattagagaagacacaaataaatggaaagatatcttgtgttcttcaattcaaagactttaatattgtcaaatttccctaccacttgaagtgattcactgcaatttctatcaaaatccaaatggtatttgtttcataaatataaaaattcaccccaaaattcacatggaatctcaaaggaccccaaatagccaagacaatttggaaaaagaacaaagtggaggactcatacttcctgaattcaaaacatattactaaactacagtaatcaaaacagtgtggtactggccaaaggcaaagatatagaccaatggaataaaacagagaacccttgtgtacatatgttcaagcaatcctcaacaatggtgctgagacctgtcactggggaaaggacagtttctccaacaaatggtgctgggaaaaatgatattcatgtgcagaagcataaaggaagacccttgccttacaccacatccaaaaattaactagaaatgaaataaggacctaatggtaatacctgtaactgcacaacctctagaagaaaatacaggaaaatttgaaattgcatatctgacttttcagatatgacaccaaaaacacaggcaaaccaaagcaaaaacagacagacagaagtacatcaatcataaatactttcaggcatcaaaaaatgctaacagcaaagtgaaaaggtaacctacaagctgagagaaaatatttgcaaatcatatctctgatacagatttttatctagaataaataaaccctacaactcaacaagaaaacaattaaatactcccacttaaaaaaatgagtaaaaaaggtgctgaagaaaaaaaaaagaaaaaaatggtaaaggacttgagtagacatttttctaaaggtggttttcttttctttctttctttcttttcttttttttttttttttttgagatggagttttactcttgtcgttcagggtggaatgcaatggcgcgatctcggctcactgcaacccccgcctcccgggttcaagtgattctcctgcctcagccttccaagtagctgagattacaggggtctgccaccacacctggctaatttttgtatttttagtagagacagggtttcaccatgttggccaggctggtcttgaactcctgacctcaggcgatccgcctgccttggctccccaaagtgctgggattacaggcgtgagccaccacacccggccttaaagatggttttcaaatgaccaacaagcacacacaaacatgcttcacatcgctaattatcagagaatgcaaaccaagtccacaatgagataatatcctcacatccattaggacagcgactatcaataacaagtgttggcaaggatgtgaagttggaacacttgtgctccattggtgggaatgtaaatggtgcagcctatgtggaaaaaagtgtggaggttcctcacatcattaaaaatacgagtaccatatcatccagcaatcccactcctgcatgtattgccaaaacaattgaaaactgggtctggaaaagatacttccacatccatactcacagcagtactattcactgtagccaagaggtggaagcatcctaaatgtccatcaaaagatgaacagataagcaaatatggtatgtggtatgtatgtataagaaaatattggccaggcacagtggctcacgcctgtaatcccagcactttgggaggctgaggtgggtggatcatgaggtcagaagatcgagaccatcctggctaacatggtgaaaccccgtctctactaaaaatacaaaaaattagccaggcgtggtggcaggcacctgtagtcctagctactcgggaggctgaggccggagaatggcgtgaacctgggaggccgggcttgcagtgagccgagatggcgccactgcactccagcctgggcgacagagcaagactccatctcaaaaacaaaaacaaaacaaaaatacaaaaacaaaacttgtacaaaaacaaatgtgtgtagcagctccattcatcattgctagaaactggaaacaactcaaacaccttcaccatcaatagggcaaactgttgtacatccacgcaatgaaacttctcagcaattaaaaggagcaagctgttgatatgcttaacagcatggattaatatcaaaggcagtatgcggaatgagtgaagccagtctaaaaaggctgcatactatgcagttccatttatgtgatattctagagaagacacaactacagagatgcaagaaagattgaggtccccagaggtgaggggctgggggaggatttgactgtggagggtaagcagggggggttgctggggtggcagatctgctctgcctgttgacgacagtgatggttacacaaatctacacatgtggctgtgtgcggtggctcacgcctgtaatctgagcactttgggaggccgaggagggcaaatcacctgaggtcaggtgtttgagaccagcttggccaatatggtgaaaccctgtctctagtaaaaatacaaaaattagccaggcatggtggcaggcacctgcaatcccagctacttgggaggctgaggcaggagaatcgcttgaaccctcaaggcggaggttgcagtgaacagagatcgcgccactgcactccagcttgggcgacaggacgagactctgtttaaaaaaaaaaaaatctctgcacatgctaaaatccacagaactgtccatgaaaaaaaccactttttttctgtgtgaatttcaaaataaaataattaaaaaaatcagaaagagactcacgttaaaaaacaaagaatgaaaaggaaaatatattttccaaaagaagttgctgtgaaatatgaggagaaacatcaaatgtgaacacacaaagatgcttggtgctgataacaggaatgatcatccttagggaaaagaaaatcaccaccattgagctggccacaccaaaacaattgtaaattctaaatatatggagcaaaaactaattgaatttaaggagaacatgagaaatcaacaactgaagcgggattatttaacggagatattcagaaacaaatggatgaagtagagaaaaatatttgagagtgtaagatgtaagtaacatgatcagttaagttcatctaataggtgtttgtggaaatatgcaactaccaaaacccacaaattaagttcaagcacatgagaaatgtttgcaaaaacttttcagccatgtatcagaaaggaactatcaacagattcccatagacagtgtatactcttaggattacaaaggaacttatgaactactgagaaatgaataacagtgacagcaatctctatcaacatttgttggatgcagctaaaggtgtcctttgttgcactcagaaaattacagacataagcattagaaacataaaacatggaaatatggccgagcgcggtggctcacgcctgtaatctcagcactttgggaggtcgaggcaggtggatcacttcaggccaggagttcaagaccagcctggctaacatggtgaaatcctgcctctactaaaaaaaaaaaaatacaaaaattagccgggcatggtggtgggcacctgtaatcccagctactcaggaggctgacgcaggagaatctcttgaacccaggaagcagaggttgccgtgagccaagatcatgtcactgcactccagcctggggcgacagagcaagaccctgtctcaaaaaaaaaaaaaaaaaaaaaaaaaaaaaagaaacatataacatacaaataaatgaaccaagtgttcaaatcaatattaaaaataataacagagcagggcaggagcagtggctcatgcctgtaatcccagcactttgggaggctgaggcgggtggatcacttgaggtcaggagttcaagaccagcctggccaacatggtgaaactccgtctctactaaaaatacaaaaattaggcctggtgcagtggctcacgcctgtaatcccaagcactttgggaggccgaggcaggcggatcacaaggtcaggagttccagaccagcctggtcaacatggtgaaaccccatctctacttaaaatacaaaataaataaataaataaataaataaataagccgggcgtggtggtacttaaaatacaaaataaataaataaataaataagccgggcgtggtggcgggcacctgtaattccggttactcaggaggctgaggcaggagaatcgcttgaacctgggaggcggaggttgcagtgagcgagatggccccactgtattccagcccgggcgacagtgtgagactctgtctcaaaaaaaaaaacccacgaaaacaaaaattagccaagcgtggtggccctctcctgtagtcccagctacttgggaggctgagggaggagaatcacttgaacccgggaggcggaggttgcagtgagctgagatggcgcaccgcactccagcctgggggacagagtgagactccgtctcaataaacaaacgaacaaataacagagcaaaaccaaaatgccaagggaacgtgagacaggagtgcgagctgggagtcggcacacggagaggcagagacactcctcggaggcagaagctggttccttatagagatggaaagaaagaaatggactctggggagactggagaagaacagaaacacaggaggcagaaataaatactgcggatggaagcagagacaaaacaaaatgtaagctgctccaaatcggcggcggagcgagttctggaagagcggcggtgtgggaacctccggtgccttcctctcccagctgcagctgcgttcccaggcaggcctcccgggagccagggacggaggcccaggactccgccaggggtgggtccgttccccttcttggagggagtgtgacccacaggccccacggaaaggcagtgccactcccgtgacattccacaaggccccgctggccggcccctggcctgcccccagagaactgctcgcaggcaatgatgccctgcagcctgagacctgggcaccccggcctttgccccaaggaggctggggatagaagggcttcctccaggattctctgcaggagatgagcaaaacgtccgcagagccagtgactgcgggacccacgacaatctcaggtcacgcctgccgggagaagcagcacctggacctgagcccggggacgggcaaaggaacgcagctcgtgagtggcccagagagcgggaaccagagcgccccgacggcagcggaagccaccgcgggcgccaaaccagtaacgcgccccttgaggacaggaggccacggcgcaaaagcagactgggctcggaaacacgtgctttacaaatggggaaatgagtgagacgatgcaggagagaccgcaaccagacgtaaaaggtgaagaccaccgcgaagaggaagctctcagccagagctgagtgagagcccgcgggcgggagggggccgggcgcgcgggagccttccctgcaaaccccgggcgttccaggagcagggaggcacacggatggaggacaggagaccaagaatggcataaaatttctccgagcagaaggaacgccgcagagtgtgagcgtgagattgctagcgctcacaaattcaggcaaggcaggtgaggagagacacaggcctgcgcatcctggaaagctcttggacttaaaagatgaaaataaatgatcctggaaagatctcgaaagatcaagaatataaagcgcttttgtttgtttgtttttaataaaacgaacccctaaacgcacacagaaaggaagaacaagcatccatggattgttcggagaaaaaggttgatatccaagaatgcggtaccaggccaggaacggaagaaagtgaagtgacctggggggaggcgagcgctgatccgaggagaggagccaatgagaggcactcaccaggcaagcgggtgggcgggggcctggcgctgagcacagacaagtccaagggaagatgcataggagctgatcgtgcagagatggcagcaagtggcaacggaatccccctgcattgacaataaacctccaggaatccccctgcattgagagaataaacctcccggctctggttctgttccgtgtctgttagcggggtttaggggtgagttagggagagggcactgccaccagccctcggatatatttctcctgctgttcactatgtgtaatagacaaacaccaacaagaagagaagaggccaggcacagtcggtggctcatgactggaattcaggcactttgggaggccaaggtaggaggatcatctgagcctaggagtttgagaccagcctgagcaacgttgggagtttctgtctctaagaaaaaaaaaaattacctgggcatagtggtgcacacctgtagtggcagctactcaggaggctgagctactcaggattgcctgagcctgagatatcaaggctacagtgagctgtgattgtactactgcactccagcctaggcaacagagaaggacagtgtctcataaaagaaaaaaaaagaggagaaaagcttcccagacctgcccacaccatggtgtccaacaggtggctgggaccccatgtcctccggtcagctctcaccagggcctcatgggaccttcctgctgggggctgatctgaaatgccctgcttcttcagacggctgagggtttctgcccacccaacctttggcaatgccaggcgagacaggcacctgcagccccaccgtcactggcatcctctgggcaggtgctcagcgttccttagggcccaggagcaagccagacgccgcctttacttttgcaggcaaaatagaactttttaaacttctgcccatctctcttttgcacatacagtatgatagtcttgctaacctactgccagatgagtgaatctgcctatcaccaagcaacaggtgcactgtcccatgagagggatgggggtggacgtacagaactccagggttctctgggcaccctctggtgcttccaggcctgtgaattggcacagcaggaccacagacctccaaggtgcccacctgggggctcagaaccctggcggggaaggtcagtgctatcccaccggagaagagacctagtctagctgagcccctggccagcggcaaggaggaaaggatgaacatcagccacgcctggcactgactgccacagccagagcctcgcccagcccaagaatgtttctgttctaagacttttttcttttttgtattttagaaattatcacaggcaaatgtcaccttgaagacccggtggcagcaaagtgtgagctcagtgtggggcatgagtgttctgaagctgccaggggtggactgcagtgggtgccatgggggctgtcatagcccttggttcttgctattgcaggccacgctggccacgtttccaccgcagtgtcctcagctcctctctggaggggtcgtctttccacctaagccgccctgccctgcagcagcgggaagtgccaggaataagtgccccatggaagcatccccatcccgtgaccggctggagctggtctaaaacatggcagcgccagggactgagccccagttggtcgcaagtggtcaccttgatgctggacccttcaccagtggccttccctgctaacgtcacctccccaaccctacttaggagggtctcctgggaccacctcctaagtaaaccacttgagcttgcatctgcctcatctgcttctgggggactcacactagaaaaacaaaattaatatttttttgttatatggagtggtgtgatttgaaatccttctatggataatgaatgcttgcttatgtctttaaaaaaaatttttttttttgagacagagttttgctatgttgcccaggctggtctcaaactcctaggctcaagtgatcctcccatgtcagcatcctgaggagctgggactacaggtgcgcgccaccacgcccgactccagcatctttgttctcttaatattgagtccagacatggagttaggcaaccgcaggcatgcagattacactccccagcaagaaggctcatcattgacacacatgcagacttaggctgtaccaggcatgtataccaggggggtgcattgtgagtaggtaggtgtgtgtgcgggtgggagactgtgtgtatgtgtgagagagagcatgtggcagtgtgtgtgtaggtgtgtgtgcatgtgtgagagcatgtataggtgtgtgtaggggtgtgtgtgtgcgcacatatgtgtgttcatgtgtgagattgtgtgtagatgtgtgcccgttcctcacagcaaccctgctggtgagtgctcctgtggtcctctctttacgaacaaagaaacaggttaagcactttccggaaggctggtgacccacgagccctgtgtcacacttctcagtctgcctggggccctagctctcagcctggacacttggcccctggtgaacaagtcatgtcggagagaacccgtctggtgcgccatctccaggatacttgtgtccctttgtacatatatttaaaaattcattttgaaagaacaaaaaaatctccactgccctccttcacatctgcgatttcttgattttcaaacactgaaaggctcgttttgctcctggagagattctgctcggtgcctctgccatgcttgggttgggagtgaaagttttcctgacttatttgggatactgtcctcaaatatttcagatgttgggtgtctgcgagggtcccatggttatgagccatgggaagaggcttcgtgtgactcagtgattggagagtttgtgggtggaattggggggtgctgagcttggaaggggaagctgcatggggccagggctctcgggagcagaaatggatgatggttggggcccacgtccgccaggacagagcctcccacctcgagggctgcattcccagggctacaggtccctggtccacccatcatgaggtggccaggacattggatggatagggcagatgaatggacaaacagcccaggcaaggatgcagggagacccacagccgcccatgccaggccctccaagtgggcaggaacaggtttcccagcttcttatgtgcccacctcctgttcctgccagcatctccctgcacccacgctcagcgctctgcagtccaatctctgtctttcccaaggagaccctccccactgcttagatgtgtcaaaaatccttttccaccaggttaatatttttactatttacttattttttcttctttttacaaacagagatgaggtatcactgtgtttcccaggctgttctcgaacacctggcctcaagtgtcctttctcctcggcctcccaaaatgcttacagatgtgagccactgcacctggccaatttcatatatatgtattttttttaactttttaggttttctatccaatagcaaataaccaaccaatcttgaatttttacacatatcctaacctttctggaatctgcatggtagcacagggtgagggagatggcttactgctcacccatctttgtagggtgaggtctgccctgccctccacatgtggcccgtggacacccaggttggttccgcctcggctcgcctgggccctgctggcctggctcacttcaggaccaccctgtagcctcacccaagaatcatgtccaggtgggagaggaggagatgaggatgctggtctggcgggaggtgggcagtggttacttggtgtggccggggggagaggcggtcgctttgaaggctcagcccccaggaggcctgtccagcttgggtttgtggttcctggggcatgtttatcactgcggtgcagtggcctctcgtccctcactgtggtcggcctcctcatgtcccagcagccccagtgtctgcacagaccatggcccctggacaagccatgggaaggccagggtggggccaaggatctcggagaccagggtcggctctgccttgctctgggggtgatgatggaggcgccagtgtccctctctccagcgctcctctctccagtgctgccactgagcccaggctgctaaaatgggggagcttggaggatccctctgagacccctgaggcgggagccctgcggtggccccactgctgcagccctgacgccgtgtccccgctcctgtcctccccagtagctttccaaacgctcctgcccagggccctgcctgtcctaagctgaacctgagacctgagggcggctctgcaggaggcccctccaggacatcacgcagcccctcaggcctgttggacatcgtgcctcttgtggtttggcccttgctaggtccaacatctccccagcttcccttgtggctccccctcccagcagacctcccagggagcgggtgcaagcccctctgtccccacagataggcctgcccagagctgggggagaaggactttatttggagtcaggtgggtgggagcagggaagggtcatggctggagggtaggtccaggtggtccaggctctgtgtctggtggtagggtgggctctggaggtgcagacccgggggctgctgtgctgggaagaggagcagaggtcagggaggctgcagggtagggcagaggccagggccagagctccctccccaggctctgcagcccccacatcggccactgctgggcaacctcggggctccagagcgacctcagctcctccaatgactgggcaggcctctgagcatccttggtgggtggatggtggggagtggaccgcgtggggacaggtgcagggggcgatgggctgagctgacacctgagggagccggagggaggcctcgctgtggaaaggccgaggaggaccctcactcgggctggcaggtgcaggaatgataaaacaaaggacttcccgaatgtcccaggaactgtgggtgggcagactctgaggtgccaacctcgtgcctgaccctgggggggtctccctggctgtgtgggatgggaggggccagagcagatgtaccctcgaaccccgggaacccaggactctgggcttgtccagtgccctcctaaaggctcactcaccctagtgttcgggaacgcagcttcctgcagagaccaagaaaaacccagggattagaaggcgccctagaccagggcccagaccccatcgcagcccagagctcagagccccagagcccatcgcagcccagagcgcggagccccagaccccatcgcagcccagagcgcggagccccagaccccatcgcagcccagagcgcggagccccagaccccatcgcagcccagagcacagagcctccaatgaggaggacgctaaacagggcccgggagcccctgcgaggagactcggggcacacggggaatgcgggggacatgggaggacatgggggtcatgggacactggagatagcagacagacacagcagagggacacaggggactgggcacagccatcctcacccgtctgcaggggcgtgaaaatgtcctcctccgagagtcccttgcgctgcaccaatttcttaaattcttccagggcctcccggttggtatcagaattcctacctgcaggtgaggtggccaggtgagccgacgtggggacagcggcacggccctgcagggagcagatgccgaaaggagacgaccacggcccagcaccaggacagggggagaggcctgagagtggatcagagctcgggggtggggctggggacagaggagatggccactgcccagcaccaggacaaggggagagacccaagagtggaccagagctctggggtggggccggggacagaagagatggccatagcccagcaccggacaagcaggagaggagacttgagaatggatgagagctcaggggtgggactggggacagaggagacagtcactgcccagatgagaggtccccaggaagggggacagtggcggggactctccaagccactcggcaaccccaggggacctgggcagctcccaatgccaccctgcagggtcacagccctcacctggagggaccttgtctcccagaggcaccggccaccctcctgccctggagggtccctgccccatgaagagctctcttaggacgcttaaggtgaccctcccccttaaggtgaccctcctacacccgagaccccagaagtggcccttggcaggttcatgtcaccgagggccatgtctgtccctgcctggcccatcccattcccacttcaggtacttggaccggctgcccagcggtgcccggcacatgaaagccggcacagggggcttccttttcccccatgccagggcatggtggtgctggttccaccggcttccagaggcagagaccgtggggcaggacacgcagaccccagcaagcccctcacccacaagctttcccatgtggagcaggcccccatggtgctggtctttgcagtaaaagatgtagtggtccctcctgggcagctcctgcaggtacatgagcttcctgcccccatctgtagatgacagagaaaatgggtcattcccagagagaacactcggggccacatgaagaaacactcgggaatgtttcagcggtcacccaggtgccctggacagcctgagccaggcctggctgctccgcacagtgtggacccggacacggaggcaggagcctcctctcaggaaggtcccaatgcaagtaatggagccacaaggccagagcacgtccaggactagagtccggccttcccagctccagcagctgctcctgccccacttccctgtccctaaccctcatcttccccctcagcctccccatctctaatcctcagcttccgcagcactaaccctcggcctccccatccctaaccctcggcctcctcatccctaaccctcagcttcccgatccctaacccttggcccccgtccctaaccctcagcctccccatccttaaccctcagcttccccatccttaaccctcagcttccccatccctaaccctcagcctccccgtacctaatccttggcctccttgtcccaatcctcagcttcctcaatgtgtcaatggctagggcctcccagagggcaggcgtgatctggtccatctcgactgcggacaagcctgtcacacccggtgtctgatgtcagggccaccagccccccaggaaggagaggccagcccctccttggaggtgggcagagctggggccctggcaaaagggcagcctgggcactctctacctgtggaggctggtgcactggggttggcggtgggggagggtgggggtgggagtgggggaggggctcacaggcgctgtatttgccaggctcctccgtcttccgcatcaggattttcttctggatgcacctatcctccctcctggaaaacaggagacacgcgggcagcggctcccaggacacccatggcccatcctcagctcacctggtgcatggccctgacccggcaacctgaaaattccactgccccccaccccaccgagcttcaggatgcccaggctgtttccctccaaggcagggggtgactcttcccaacacccgaaacgtggatggggcaatgggcaccaggtggatctggggaggggagcgaaagtggcctgaggggccctgcagtgggcaacactcacatgaaggtgaacgtggcttccaacttcccaccgcccagggctgtcaccttcactggggacaccttcctgggcctcctgtcctccggaaagtccttatcgaccaccatggccttcacgtaccaggtccctgtgatctggagcaggccaaggccgtgagcccaccatgggtggcccagattctactctgaccctggcactcaggcctgcagctataaccagacacccatggtgcccggctgctgcccttaaaggcaggctgtgttcctgcaccttagttagagctcagctggagtgagttagagccagccccctgctcagggctcccagcccccagtggaaggagggcatgtctgcaccccatggacccccgggccccagcaccaggtgagccctccctccacagggcccaaccctgcgagaccttcgggcttcaggcgtcagtgcagcaggaacccctgagacgagcctgctccggccctgggcctcggggggccgtgtctgctggaggaacaataggacccctccaccaccaccccaggctgggagcacggggtcagaagccagccttcagtgacacctcctaaagcagggcccctggcactgccccctgcccaggagtccgcctggctcctccatccgcccacgccaacccagctcacatcctcctcctccagggtgaaggacagggcagcggccaggccgagcgtgacacccaggaacagggtcttcatctccagagctctgtgctgccgacctcggcaggtcactgggcgtctgaacaaggctgtgctggctcctctcgagatgttctttatagccccctggccagtgtcctgggagcacgtggcacggtgcacccctccccatggtggcaaccagtcctgcatccgggagggggagtgtcctcattgctggcatctggtgaacagcaagtcagtgccagccagagaagaaaagacacacgatgccatccagagtttgcaccacccgaacgcgcccactcagatgagcccagaggactcgagaggacagggcagggtggtgtccatctgcaccccaagccacagaggcagggcccacagcctcgggatactccctcaccaacccctgcaccctcccagggccacggctgggaccctgggcaagtcctctggggaactggccatctccctgctgagcagaaatggactgggctttagaaccagagagacgtggggctgctgccagctgagtcccgcacgccctagagcccaagcttccgcccactctgggacccactctgcattgattttccccacctggaccctgcactcgagcttcctaggggcagaggagggcactattgtgtggctcagggtcagtttatatacggcctcctcgggccatatgagggaccccgccgcctccccgaccccgcttcactccgtaccggagcctggctgtgctgtcctcagaacacgcgatctctctggattgtcctgtccatttcttcctgcacgtattcatcgaccatctccctgttagaatatacattcccctctctcgtcagctttgacggcccccagcccccaggacaggccttgaatctcatccctttagataaacaagtcgcatgaggcaccaagagtcacctgccagcctgtgctcagagttcgtggctgaggtcccttgggcacctggctctgctggcctcatccccagccaacctgagccagaactttgccttctccctcccggaccctgcatttcccaggtgtgtgtcatcttccctgggacccaaggctgacccacgctctgcaggcaggtgctggacccacacaatggcatctttgtgcctctctggcccaagatcagacactctcaagtacttactcaataatactaatgcacactctaataaaccctggggctgtaacgaacgggctggtgtgacccagtccctcacccctcccacggcaagtgctgccgagcagaaaccccccaccctcatccccccgggcaggaaagaatggggcctgggctcttcaggaccagagatgagcaaacaggctggagtctctacatcaacgggaaggtttctctgttctctgtgtttgttgactgtaccccaggcacctcgtatttcattggttgtttgtgaatcattgatctaagcaccttacaacactggtgctgctggctcaatccttgaagaaaatgctggaacgacatgcacagatgcttcagagaacagggctctcccatgaggtccacgctcagtgcgacgggtgctctccaggagtctcccatcatccacccatcttgccctgtgtcccagtctcattcgccaactgtgtccttttagatactggttgggttcaactggtgcagacaccgtcaggagatggtagggctggaggttgggggtcaacccatggcagacatgaggggtgagatctctggcccccagtgctttgtggcctggggcacttctctggatggctgtgttccttctgatggtggctcctgttgggctgccgctaccacacaactttctctctcaccacttccctcacgacccttttctttgaatctcacagtgatcacagcttttcagggctgctaattcctaggtgcttcactgaagtggacagtgtctgggctttactcgacacctgggcataagaaggtttagatggcaccaccaaacaagcacctagaccagagcatgtgctggctgggactgaggcacgccaagaaggagcagagtgggagcttacgatgaatctcagttaaggctgcaagaccaactgcacagtagggaccatcgcctgtgccaccaaccacctattttaattatttcagagacggtggctggccaccatgctgaagcatcagttacaaaatggacttgatttgctgtgtgagtgggtcagtgcagtgcaaggggtggctgaaggcactggtgacccacgctctcggcccacctgccacagttgtagatcgttcctggtgcacggacgtattcacagcttcccaccttaagtgcctgcaccttttcttctgtgcttcccctgacaccgatgaaacccagatgtgcaagtgaatcagcatcctcagtctgtagggatagtaactgatgggataaatggtctggactcttccttctaagtggaacaatcaaatatggttccaccctatttctcagatggtcctcagaaggactgagtcccagttgcccacaatggtaacatcattaacatattttgttggtttttctaccttccaaatctcacttgatctcagacttctggccaccagaatgtgagaaaataaatttttgttctaagccacccagttggtagtattttgttatagcaaccctataaaaataatacaaactctagcatgttaataattatattaaatgtaaatggtttaaatattaaatgacagtgattggcaaagtgaattaaaagccattatacaactatatgccgtctacaagaaacttacttcaaatgtaacaatagagacaggttgaaagtaaaaacatgaaaaaagatatataaacattaatcaaaagaaagcagaagcattatttcaataacaggtaaaatagactttagaacaaagactaattaacagagagggaaattatacaataataagtgggccattctgcaaagaagacatagtaatcctaaacgtgtgtgcaccaaacattagctgcacaatatgtgaagcaaaacagaactgaaaggagaaatttaaaaagccacaattatagttggagacttcaatacccttctctcagagcaactagacagaaaaccagcagggacatcaaagaactcggccacccatcaattaacataatcgaattgacatttgtagaacacaccacctggcaacagcactacacacattcttttcaagtgcaccagaatatataccaagatagaccatatcctggatgagaaaatgagcctcaagaaatttttaaaaatttaaatgatatagagggtagtctctgaccacatggaatctaactataaatcaatgccagaaagataatggaaaatctttcttcagaggcttggaaacaacacacctgtgaataatccacaggtcaaagaggaagcctgaaggtaaatttaaaaatatactaggctggatgaaaatgaaaatacaacatatcagctgggcgtggtggcttgtgcctataattccagcactttgggaggcccaggcgggtggatcacttgcgatcaggaattcgagaccagcctggccaacatggcgaaaacccatctctaccaaaaatgcaaaaactagctgagtgtggtggtgcacgcctgtaatcccagctaatcgggaggctgaggcaggagaatcacttgaacccgggaggcggaggttgcagtgggctatcatgccactgcactccagcctgggtgacagagcaagactccatctcaaaaaaaacaaaaacaggctgggcacagtggcttatgcctataatctcagtgctttggagccccacgtgggcagatcacttgaggtcaggagttcgagaccagcctggacagcatgacaaaacctcatctctactaaaaatacaaaaataaataaataaataaattgctgggcatggtggcgtatacctgtaatcccagctacttagggggctgaagcaggagaattacttcaacccaggaggtggaggttgcagtgagccaagatagtgccactgcactccagcctgggatacagagcgagactctacctcaaaaacaaacaaacaaaaacatatcaaaatttgtgagacacagctaaatcagtgctgagaggcattaaatgcatatattagaaaagagaagtccaaaatcaactatctaagctcccacttcaagaacctagaaaaagaagagcaaaataaacccaaagcaagaagaaaagaaataacaaagataagagcagcaattaataaatcaaaagcagaaagcagaaaaaatcgaaagcagaaaaacaacagagaaaaacaatgaaacaagggctagttctctggaaaaattaataaaattgaggcagttctagaaagactgacaaacaaaaaaagaaagaaagacacaaataaccaacatctggaacaaaacagagactatcactacagaccctgcagacatcaaaggataataagggaatactacgaagagaccttcccacatatatttgacaacataggtgaaatgaaccaatttctcaaaaaacacaatgccaatataagatagataactttaatagctctatgacaattaaagttaacattttaattttaaaagcttccaaaaataattcttcatgtccatatggtttcattagaaaattctaccaaccatttaaaaaataaataacaccaactctgcataatctcagaagatgagagaatatctcccaaccaaaacctgacaacacaaaaaggaaagctgcagaacaatatacctcatgaatatagatacagaaatcctttacaaaatattagcaaataataatatataaaattaattctacaccatgaccaaaagcagtttattccagggatggaaacctggtacaatactcaaaaatcaaccatattaatatgttaagaagaaaaattacatgatcatatcgatcaatgcagaaaaagtatttgactaaattcatcacgcattcaggaaaacaactctcagaaaagtaggaatagaagagaacctccttaacttgacaaagagcatctacaaaaaacctatggctaacatcatttctcatggtgaaagactgatgtgtaactggctcaagtccagctgctcgctgctcagaagtcaaggcatgagaagtgaagtgtggtgaaaggaaagcagcattattcaaatgctagcagtagaggaatggccaggcccatgcctttaaaagaccattcaaactttctggactgagcgaaggggtttaaggaggaaaaggtgtgggaaatatgtgggaatggtgcaggaggatgttggtctgcatcttgttccaatggttatcatgagtcattaatcgtctgtccagaggtctggtttgagtcatcctgatttcagccgggaagtggtaggctacctgtaactccccctaagagggaggattctgcagctgggtctctctgcctggtttgtttcaaaattggcccctggaatttctaagtaagcacataattagataagcgagcactgctcacagaagtgcctggtgggaaagggagaaataaagagtttcgaagtatgtttcaaggctgaaagcaagaaaggaaaaaagtttttaagcacattttgaggctgggatactcagttacaaacgctttctccttaacatcagggacaaggcaaggatgtccactttcaccacttgtatttaacatagtacagaaagttctagtcagagcaataaaggttttttaaaaaggaaattaaagacatacaaattggaaaggaaggaagaaaactgtctgcatctgcagatgacatgattgtctctgtagaaaatcccaagaaactgaaaaacaaaacaaaagaaaacaatacacctcctagaactattaagcgagttcagcaaggttgcaggatacaagataaatatacaaagatcaattgtgtgtctacatactagtaacggaccctaaacttaaaaacacaatactacttatagtggctaaaaaaaagagatacctaggcataagtttaacaacccatatgctggatttgtatgctgaaaataatgcaatgattataaaataaatcaaagaagatctaaacaaatggagagatgtgctatatccatggattaggagactcaacataataaaagcgtcatttctctcaaataatataaagatttaacacaatttctatcaaaattccagaaggaatttttgtagacatagacaagattattctaacatttatatggaaaggcagaggaactagaataactaaaacttttttttttaagaataaagtgggaggaatcaggctaccctttctttccttttcttcttctttcttttttttagagacagagtcttgctctgtcacccaggctggagtgcagtagcacaatctcgactcattgcaacctccacctcccagattcaagtgattctcctgcctccgcctcccaagtagctgggattacagatgcacaccaccatacccagctacaggctaccctttcaagactcattgtatagctagcagatggacagatgcatagatcaatgggacagacaataaagaatcctcaaacagacctgcacgcatatacccagttaagtttttacaaagatgcaaaagcaattcaatggaagatagcttttgtagcaaatgggctggattaactggacatccacagacaaaaccaccaaacaaaaagaagaaccacaaccttggtctcacaccctgcaagaaaattaactcaaaatggatcatagacttaaacataaaacttaaaactataaaagctttagaaaacagaaagaaaatctttgggatatggagctgggtcaggagattttagatgtgtcaccaaaaatatgatccataaaaggaaaaattgttaaaatagacttcatcaaaataaaaaccttttgctctgtaagagaccctgttaacagaataaaaagacaagccaaagactgaaagaaaatattgacaaactacatattcaacaaagaattagtttctatactttataaagaatttttcaaaactcaacagtttcaaaaatagaacgtaaacaaaagacatgaagggacacttgactagagaggatatacagatggcaaataaacacatgaaaagatgctcaacaccattagtcatcagtgaaatgcaaataaaagccatgatatatcagtacatacctattaaggtggctgagataagatcatagtgatcacactgaagcctggtgaggatgcatggaaactggacagtttctggaaaatggcttgacaggtttaaaaaaaaaaaaccctgcaacaagcatagaaccccgcaatagaacccctgggcctttgtcccagaaaaatgaaaactgatgtccatgcaaaaacctgtacatgtgtcatagcccaaatctataaacacagacatcctccaacaggtgaatagttaaacagactgtggtacatccataccatagagcactactcagaagtaaaatggaataaactattgataaatgcaacaatgggatgaatctccagagaatgatgctgcacaggaaaaaaaaaagccaatcccacaattttatgattgcaatagacgacattcttgcaatgagcagatttcaggagtggagaacaggtctgtcattgctggggttggggctggagcaagccaggtgaagatacacatgatagctctgtgtggctttttacaactgcatgggaatctacaatgtctcagggttaaatgtttaatttaaaaaccacaataagcataaatgcttaaaaaaaaaaaacctagagccaaagactcagcaactccactcagaagcatcatttcaacagatacactcccacacatgaaccagcagaagggttcaattgttacttacaaatcttggaaatgcctcaaatttccatcaaaataacaatgactgaataaaggttcatttttatgtttgatttttgcagactttctagatgcctctcattctttggggcacaaggaatacatcgatcaatgaaacaaatgtcctgtgctcggggggcttatattctaggtgcaggggacttaaaatgaacacaataaataagtgaattgcagtgccagctatcaatgtcttgcctccagctccacacgtacccttcatggccggttccgaggcaatggagctggagccagcaggcgcttctcttgtgcacctggtgcaatgctaagctttgttggttgaggcgtagggagaagcgcctcctagcatgggtccaggatgactggttccagatgcttccatttcttcctttttctttctcttcctatgcaaatggcagtggcacaagtcggggacgtctggcggcacacaccacattgaattcaggggaccgcccccagatggcttcctattgagattcagtggcatctgcacctgtgggttcccagtgactcttgcaggcttcccagccccagcccacctgccttgggtggggagagaggcttcctgcttgccagacccagcctacatttccctgcctgctggcctctgccctgaccgtgggccagctgtggctgggacaacccagcaaacttctccagcttcccttgggagaaccacaccttctcccgtgaggtctgaacccagacttgtggaaaggatccccacccctgtttatttcttccttaactgccctcgtgcaatcctgagccattctttgtggttctctttaaacctctagagctgattgttcattgtgcaagcaatccctgttcaatctattgtctctggatcctgatgggtcactggttcatacgttattttaaatggtgatcagtgctatggaaaaagcaaagtggacaagttggacaggagtgtcaggacaaggggttatttgtcctttaaatgaattgatgaggaacagccccgccaaggtggcattcaaacaccgaatttaagacatgaaggaagcaagccatgagctcgtcagctggaagaggagtccaggtggcaggagcatccagtgccagcctggaggtgggagaacgctggcagtttccgggaacacacagcagagcagccacagcaaatgatccagggagaccggccacacatgaggctggggagtgggtggaactgccatgtagggattaaggaccaccacgaggacttcagcttctgctctgagtgaaagaccctggagagctctgacaaaggcaagctgtgacttacgtatttaaggggtcactccagttgctgcattgagcacagatttggaggccgaatatagaagcagagaaagcagttagaaaagacgcggcaataacccaggatggtgcactgatttctacctgggcatccaggagaacaggggatggacctaactgtcccaccacaaacagagggaaactggcccccaggtgcaaaacgcttgtgtttagaaactggacacagacagcgcaggctgtgatccctgagaatgggagctaacgagctcagctggatcatggcagctttatgcctggagggaatttcaatccaccacagagagaggaacccaacagagcaaggagtcagacggcgtggacgggacacagattggactctaggcatcgcagacgactagaatgtgggagacaaggaaagagataggagagccctctgcagaggaagagctccagaaacatgcagagtggtcctcaagaccatagctaaataccagtccatgcagacagagggtggaactccacagggccagagaaaatgatgtttgggtaaagaaggattccaaggaactgaagaaaatcaacaccccacaaacacaggtgcaagaattagttgagatgccaagataagaactgtcttcaacaaatggctctgggacaactggatgtccacatgcaaaagactgaggtgggacctcacgccacacacaagctttcaaccagaatggatcaaagacctcaacgtaagagctaaaactgtacaactctaagaagatgtgtaaatctctgtgactttggctttgacaatgaattcttctctatacacccaaatagcatgcaaccaaaggaacagacaaattggacttcatcaaaattaaaaacttttgtacgtcagtggacactgtcaaggaaatgaaaagacaagatacagaacgtgagaaaatacttgcaaatcacatatctgacaagagtcgagtctagtatcaacaatatataaaatacacttataactcaacataaaaacacaactagcccaattttaaaaagggaaatgaatagactttcttcagagaagatataaaaatgaccaataaacacctgaaaatatgctcaatgtcattagtcattagggaaatgcaaatcaaaactacagcgaaataccacttcacactcattaggatggctagaatcacaaagccagataataacaagggttggcaaggatgtggagcaattagaaccctcatgcaccactggtgggaatgtaaaatggcacagctgctcagaaaaacatagtttggcagtttatccaacagttacacatagaattatttaataccatatgacccagcagttccactcccaggtatacacccaggagaaatgaaaacatatgttcccatgaaaacatttatgcacaaatgtccctagcaacattacaaaacccaagaagtagaaacaactcaaatgtctaccaatggatgaatggataaaaaaggtggtattatccacacaatgaaatattattctgtcataaaaagaaaataccgacccatgctaccacatgagcaaacgttgaaacattatgctaagggaaagaaaccaggcataagaaacacatatatatgattccatttctatgaagtgtccagaacaggcaagttcatgcagacgggaagtcgatgagaggttctggggcgtggagggaagaatgggggtgagagcagacgggcatagggacctttgtaagatgatgaagatctcctggaattagatagtggtgatggtttcacagccttgtgaatttactgaaacccactgaattgggcacttttaaagagtgagtatgatggcatgtggaatatatatcaaataaaaattttaaaaaccacctccccagagaagcctctccaggctacacaatggaagatgcagcccctcctctctctgtcacttccctgagctgcgctccattaggacacatcactccccggagacaccctgttcatttacttgcagtcctattgattgccagttccccccatgggcagactgaataatggtcccctgaagatgtccgcatcctcatccctggccctgtggatgtgtgtatgtggtagactgaataatggtcccctgaagatgtccacatcctcatccctggccctgtggatgtgtgtatgtggtagactgaataatggtcccctaaagatgtccacatcctcatccctggccctgtgtcccccatgtgtagacggaataatggtcccctaaagatgtccacatcctcatccctggccctgtggatgtgtgcatggtaaaacggacttcacagatataattcagtgaaggatctgagatgaacaattaccccagattatctgggtgggcccactgttatcacaggggcccttataggagagaggctggggagcgagggagggagagagaggagggtgaggagagagaatatttatgaacagaagtagaagaggctgtgctgctggctttgaaggtggaggaggggccacaagccaaggcatgtggaggcctctggaagctggaaatggcagggacagactcctgcccaagagcctccagaaggaaccagccctgccaaccttcgttttagccccgtgaaacatactgaaaagaagagctggaatgaagcatctgaagttgtctcagcaaaacctgcatgctcggttgtggttgtgggttttttgaccaacaaatgaaagcgttctaagaccccatgcaccatcggctgaaggggagcatgaatatctattcccagtcccagcctcacaaccagaggatgcgtttcctcacggttttctcctgcagctcaaggagggaaagcatttggaattatttgacttctccccctcactcagtggaactttggagtcgttcttcccacccttgtcaaccacagggctttctcaggtctacaggcgcgtgtgcagattgcttgggtgtgcacagatgcagggagggcatctcgtcgatagaaaatgggatactcttgggcacggcatgaagtgacaccacaattccctaaattgtttgctgtggttgctcattgggacgtggcacccactggaaccaagactttgggaagccaactggctgctgtgcttggccacagacgtggtaatgacttcagggagaatggggcggggactgcctgactgatctagggctttcagaaaggaaatgccaaggtctgagcttcagtaacaggcaagacaatggagatgttccatcctggccttagaataatatttcattcttgcagccacagagcagaaatggctgaaaatcagactccatatttaatagtgtggattgcatggtgagttggattcaaaagtcgccaagtgttttatgtgaaagttgggtcactgcttaaggagtgggaccatgacacacagaactgggacatttatgtgatctcagatggaagtgagaatcttgatcccctccccaatctccctgaacctgccggggcagaatcaccccctcctcccctacccaatccccctgaacctgcctgggcagaatcatcccctcctcctttgcgtgaggagatgagacttccctttctcagacatcttaccccgaggcagttgtgtaggggtggattctaggggctttacaccaggagaaccgcgctccaatgtggacccaagctgagtgtgtcagtgcgtatgtgctgagtgtgtcagtgcgtatgtactgagcacggcagagctctcagcatggatcggctccgcccaagcccctgcaccaggagacaggagatcgccaagctctcatggcatccaacagcaggaggcgcatccctggggtggccccagcgccctaaatgcttgcctgagagctcggcactgcaggtgaatttgctgtgtgtcctggccagcacccagctgccccttcttagagcttttgctaaaaagggcttacacctgtgactccttcctctgccactttgagaagtctgtgtttctcctacaatgcagaagtgtatttctcaggctggctgcagtggctcacatccgtaatcccagcactttgggaggcataggtgggtggatcaattgaggtcaggagttcaagatcagcctggccaacatggtgaaaccctgtctttactaaaagtacaaaaattagccgggcgtggaggcacgtgcctgtaatcccagctactcgggaggctgaggcaggagaattgcttgaacccgggaagcagaagaggttgcagtaagccgagatcgtgccactgcgctccagcctgtgtgacagagcaagactccaaaacaaaaaaaaagtgtcattctcagggacctgagagccattccttagaaatgtgaccttcaggaagaatgggcctccttcttccagactctgttgggggacagagtcctccttccataactgccacacagctggtcccactgcactgaccctgaccagcactctgtaactcttcaccggagcccccactccctcccgcacccccaaccactctcccttcagaacaccccttctcccctgcacaaagtggcatggaaccagtctgttcctggctctgagaagttgctgaataaaacctgtcctcaccgctttaactagcattcagcttggctcactggtgacgacgtatccaaaatgccgtatttaacacattggcttgagcggtagagcagctctcagatggcttccaggactggctgagctggtgttgaggcctcattcacaggggctgggacgccaggatggccccacataacatggagaaaggactctgtgctgcaggtgattgaagggttcccagggtttgctttaggctggtgggggaagacacagccataggaatgactgtgggacggaggcttattacacttaggcccctagaaacaggaggggcggggcctcacggaagcaccagggcctgtctggaggcaccgggcggagcctgcactgcggttcccacgtttcccacgggaaggaacggaggaagcagggtaaacaggctcagggcgggctggtttcaataatgtcccgggccctggggtgtgggggctggctgtccctagctgtctggtccctgccctggggagggtgtgggctctggactggttggtttgcatatggaaggcacacttacagatggtccctgccctggggagggtgtaggctctggactggttaccggtttgcatatggaaggcacacttacagacaagtcatctgctatttctagaaattagccaactcctggagaagcactttctccagggttagcaaggccccagatgtcaaagtgtccaaattcagaaagtaaaggccatggttcacacagagagggtgtcggagacaggtcgcgcagtcatttgaagagcaaattactgtaaagaatccccagctggtaacaggagaggggctaccaacgggtaaagaggactctcaaaccacagaaataacagaaatgggagccagctctaccccagggctgaggctgcacaccggggtaggaacaacctggaaggtgctcaggcctctgtggagagggtcttgctctgtcccccaggctggagtgcagtgacatgatcatagctcattgcagcctcgacctcctgggctcaagcaatcctcccacttcagcctcccaagtatctgggattacaggtgtgcaccagcaagcctggctaatttttgggttttttttggtagagctggggtctcgctatgttgcccaggctggtctccaactcatagcttcaagtgattctctcacctcagcctcccaaagtgctgggaacacaggcataagccaccatgcctggccagaattgagttttttttaatatatatatacacatatatatacacacacacacacatacacacatatatacacacatatatgtatatatatacacatacacatatatatatacatatatacacatatatatatttttattatactttaagttctagggtacatgtgcacaacatgcaggtttgttacatatgtatacatgtgcaatgttggtgtgctgtacccattagctcgtcatttacatgaggtatttatcctaatgctatccctccccctaccccccactccacgacaggccccggtgtgtgatgttccccttcctgtgtccaagtgttctcattgttcaattcccacctatgagtgagaacatgcggtgtttggttttttgtccttgtgatagtttgctgagaatgatggtttccagcttcatccatgtccctacaaaggacatgaactcatcattttttatggctgcagagtattccatggtgtatctgtgccacattttcttaatccagtctatcattgttggacatttgggttggttccaagtctttgctattgtgagtagtgccgcaataaacataccccagggcttcttgaagcgccactgagccccagggctggattttctcaaatgtcctctaaagttgttcgctcaccctaatcgctccctggagagcaggtttctgcagcaaaaggaagcacaggcgagtcaggagaccccaggaatgcagtcaggaccggggcccctcatcagccaccaactccaccaccccaggaaggacaaagccagaattagacacagtacagttacgcgcccgtgcaatgcagctctgctgacgtccccatgcggggacatggggggctctgcagggccatgcctcctaccgctctgcctggggatgaggatgctctccgtgctgagtccacgggctcctgcagctttctcaaagtcctccaaggcttccaggttgttctcggggtctctgcctgtgggtgccaggacgagatgcgggtgctcaaggcagcactgggcagacggcaccccgtcccagcctggaggcctgagctagcctggggagagggaccttgcccacggtggggggacttgaacccagaggtcctcaggctggcaaagtgggaccagggtgccgtgcacggctgagaaggctcccgcagcagcagaaccgggagaacgggaagggctctccgtccatccccaagcatctcccggagtgagaatggactgcgggacaggcccgccctggaggaagcgcctctcccctcgggggcaccagggcaccgcctgtcccattcctctgtcattcacacacccctggctccagggagaactcaggagccttcacgggcctcgtcctccgacagggacggcactgatgcgccaccgtctgtgggagccaccgcgtctggaattcaaccccgggagctggaacgttctttccacgcagactcctgctcacatccccattcctctcccctgctggacaccccacaggaacgcgctcaaggatgacactgcagggagctgccccgggggaaggcctgggccactctgggacacgtgtgacctttgagcccctgtgccgacagctgtggctccttcctgcctctgttgcagagaccgaggccggggcatcccaaatcctgaactccagggtgggaattggggcctttatcaggaaaactcatcctaaggaaactgcagtgtgttcctgggtcccagtggcttctcccatggggaagagggtgcaggaagccgagggaggagggagggtgggtggaggcatgggttgcagggtgggggtacgggacccacccacgagcttcgcccctcggatcggcttcccgtgcagctcaccctcacagtaaaagatgtagtggtccttcatgtgcgacctgatgatgtatgccacgtgcttgcccctgtctgcagaaggacagcagcatagtcctgaattagccaccggggccttcagagaggatcccgggacagtgtgcgttgccaggccctgcaagccccgcagctcctgcacccttccagcctcccagagctccctgacccaggttccccactgggcctgagccctaggccatgggacccccacttcccaggaacctgatgcacccgagaggtggccacatctcaaaccagtgagtcacggggggttcctccgggtgtgaggtctgcggaggtgggagttggggtacagccccccgcagccaaatatgactctgctcctggccctgccagagccgcagctagggctacagggaaagcccagagggtccacccagggacaaacccgtcacacctggtgtttggggtcaggtgttcacatttctaaagcaaattgaccagtgggagaggaaagtgggcttttagtggagtcaggggcagcaggccaaaaggccaccccaaaaaggcactggctacccccccacatccagcgtgtgtttgagtttaggctctggcttaggctccgggactcactggccgtgtattttcccggctcgtcagttttctccaggatgaccttcacctcctggcactggccacttatcctggaaaacagaagccccctggcaaagcggccctgacctgtgcctcccccggccctggagcagccacgctacaatgccctgcaaaggtggccctgagtctgccacaggcccatggaggaggatgcttctctgcatctcagacccaggcaccagcagcccctccgggtcacacatggcagttcccggggtctcctgaggtggccaggagctctgcatcgctcctcctggtggctgccttcccaacccccccgcccccaacacatttcctgccagatgcacccgggctgcctggtttgtaggcagtgtctgtggcgtgggcctgagcctcatcccaccagctgcattcttccttttagagacattcagggacaggccccatacccatcatcatctggcccagagagggaaaggttcagtgaggggcttttggggaaaaaaaaaaatcagggtcattgccagggtcagtgacttcctaagggtcagcccccaggaccggagcacaggcactgcatgccactcaggtgggagccacgcgggtgaaatcacacaggtgggaagtcacagatgtgagccacgcggatggaagcagcacaggtgagagccgcacaggtgagcgctacacagggacttcaagggggtcttctccatggtgtcctatgccccctcttggtcattctgcaagccccatccctgcgcttctccaaagcagaaatttactgccaagactacaagtctagagtctgtaagccctgcctgctggctctgactctgatcgggggtaaacaccttttcccaaaggggcctgcacggcaccacacattccctagtcggaggaggtggtgggtggtacccagcactgcccctgatagcccacaggggcctctactccctcaggtcccctctagctgaggcacctcactggcacagtttgccctcaagcattgcctgagcaggcagggctgagagaggcctcccagcaggtctgcccacctccccagcaccagagctctcctgggtggggaaagggaaggccctagaccaggttgcaggctgcccggccggctggcagacactcacagcatggtggccttagcttccaggttgcccccttccaggattgtgagggtcatgggtgtcaccgattccagattcatctcagggagctccctgtccaccgtcatggccttcagataccacgtccctgacacctggagaaagttcctctctatcaggctcaggctgaccgctccagagcctcccccttccctggcctgcagcccccagactctaccgcaccccaagggctggagatggggaacattccccaatctaatccacccagaaaacacccagcaccctcgccaggtccacccgaaggctccagcccccgcaagttggccaggaccacaggagccctcacccccaggagagaagtgaagtcagccagacccccaccctcctagccctgcccttctgcaccccggccccctcccagcccagactcctgctgtcccatctcaccatctttcagggcagggctttaatgcccaacctgaaaatgagggtctccttggatgggggagggatgtggtctccatccagcagtctcagcctcgccccttgccccctccagcccagccttcccatccgggcctcacatcctgaatctcctcgtctgaggccaggaggtggtgggcctgcagggcagcaatgaggctgaggctgatggccaggagcaggggcttcatctctggtgtctgagttcacggccgcctgacagttcacttgctggggctgggagagggtgtgccactcccacagccgccctttttacagctgggctcaggatcccctggggacctagcacaggtgactgaccaatcccttcctggatgtaaaccacggccagttctgcaacggagcagataacgtgccattgttgctggaggctggtgaataacagcttgttaattccagaggatcatccggacaggaccaggtccagaggagcgggtttgcagatttcacctgggaggaaactgaagggagtgaagggcgtgcaggcctcctggggacatgtgcggcagtaacaggcgccccccagccatcccacatgcgctgatgtgcacaccgtcaagggggtttggggttggagtccgagggccgtgggcctggggctcggctgagcttcctgcatctctgggcaggttacttggcctcagattcatcatggaaaaaaagggaccctcctgtgtgaacacgataccgtgtgcatttaaggacggtgtccactgtcctgagcaaggtgtgcagtaacgaccctctctgctccacacacagagcagcaataggtcagacagacagaagaccaagacaggtgtgtgtgtgtgtatgcaggtgtgtacatatatacatgcacacacatgcacaaacacacacacactcacataaaaccaggaatggaggagaagcacaggctggtgatggggcagaggcaggggcctgtcagttccaagtcccaaggcaggcagagagggcctagatccagctcctgggagtgatgggaggggcttccctgactccagaaaggaggctgagaaactctccttgacacatcccagggctgtaacttcttataacttagtggagcactgtgggcataggaaggcaagaggacatcgacacagcctcaagggcagaagctgagacaagccgtcctcagaaagggtgactttatctgtgacatcctccacatcactgcagagcagaagcctgggacccggggcagaggctacgaaacactgctagacagaggacagtgacaacaagatgtcggagaaaggcagaaatgcagagactcaatatccttgccttgaaataagctagaaaggccaggttccaaattacccaaggcaacaccacaccaagaaaggcaggctaaaaatgagcaattggtacaggaacttacaccagctaaggaaagtctgacacacactttaaaactgcaggagtatgatcaagatgcctagcattttaaaaatatataaagtataaaattagaactggccagaatataagaaacaaggagagatgaaatagaaataattacaaatcttgaagatgaataacaaagtgaataaaaaaactcaatagacaggttaaattccagacttgacatagtagaaaagagacttagtgtcatggaagatagtaccaacaaaatcaatgaagacagaaaaattagaaagagaaattgaggtgttacagatagattcagtctccatcctggagctagtaataaaatgagtggaggaaaccatccagagtgcagcagctctgaaaacacaacacacacagatatacacacacacatgcacacacacatgcacacacacgcacatgtgcacacatacaaatgcacaccccccatacacatgcacacatacatgcacacacacagacatacacacgtacacacacaccatgcatgcatgcatacatacatgcacatacatgcacacatacgtacacacatgcacattcacacacatacacacatgcacaaagttaacacacgtggagaatagatcaggaggctccaatataaacagaataggagttccgaaagaaaaacattttctaaaatggcaacaaagcaacggaatagctcagaatttttcagaattgaaaagacatgagatcccagatctaaattaccaaggaatgataaaaattgagaaatccactcctagaatattacagtgaagtgcagatcacccaggaaaggagaaaaaaagtcaaaacgaccagaaagaagagccacactacataccataaaagcggatgtggactgatggcagacttctcaatagcaacgctgccttccggaagacagtggagtgacatctttaactgacccgggagaaatcacatttacctgtgaatgttattctcagtgcaactttcataaaatattgaaggcaaaataaagacatctcggacattaaaaaacaactgaggcccagcgtggtggctcacacctgtaataccagcactttgggaagccaagacgaggtcaaaagttcgagaccagcctgaccaacatggtgaaaccccatcttgactaaaaatacaaaaattagccaggcatggtggcgtgcacctgtaatcccagctactcaggaggcaaaggcaggagaattgcttgaacctgggaggcagaggttgcaatgagctgagatcatgccactgcactccagcctgggcaacagagcaagactccatctcgaaaaaataaaaataaaaattgaacaacaacaacaactgagagtgtctaccactcactggtctccatcaaagggagtttgaaagggagaattttagcaagtctataggagaccgaggtcgggggtataaatgatgtcagcaaggcaaactacctgctggctgtacaaacatgaatggtgcagactttgatggtgggggaaaggttctgttttagtgcatatttaaagagtgctaaatgcacacaaaacacacttgtgcccacacgcatgggttcatacgaacaagaatgcacacaaaacacacttgtgcccacacgcatgggttcatacgaacaagaatgcacacaaaacacacttgtgcccacacgcatgggttcatacgaacaagaatgcacacaaaacacacttgtgcccacatgcatgggttcatatgaacaaaagatgcacgttaagcacgggagaatagtgatccatggagagggaagtggaaaggggtgggcagggataataaattttcaaaatacataaagaagcctgttagacaaaagcatgatttacttttcatcagtatagatgaaaaggcagccaacatgaaaacaattaaaagcacaatcacaagaagacgaatgttcatgaatgtgaaggcatactgcatcgaaatacaagaagccaaaacagactgaagaacaaaggggtcaaatacacagttggaaggggagatgtcagaacttctgcattagaaacagagggcgagggtgttaaaagttcacacccatgtcgaaatttggaaccaacattgtaaagtatacaaagacactgcctcaaaaggtaaacaattatattgttataattgttacaatgaacaattcttaattgctaattcttattaaatacacatggaatagttttaaaataggccacataccaggcaatatggggaacttcacagaactaacgcagcagagcctgccctttgtagctacaatgcaataaactagaatcaacaatgaacagagtgttacataaagagaaatataaacttgaagtctgcagccttaaacgcaactattatacaataaagacgtcaggacagaagtcctagctgtgaaaagttctcggtcatgaacacgcacgaatgcccggccagctctgcgctccttcgtcaggacagaagtcctctctgtgtgaaaagttctcggtcatgaacacgcacgaatgcccggccagctctgcagtcctttggtggtcacctcgcaaaggagaattgatcggagctgctgcttacggggtgacacccgtggcagcatcactacacgcacatcgtgacggcaaccgcgtgtgtcatgcagcccccaaccgatgatgagaaaccaacctgaacctcacgtcagagggaaggctgttatctttccattctctttaagaaaaattattttaacacgaagcaataatcaaggggtagcagccaagagatatagaaaaaataagtttgacagaggtatcccagggagtaactaatcaaatcttgtttttttcttccatttgatgatgtttagtgcacctatcagctttttcatgtgcgagccttgtgattgttttatcacttcaaataaatatttattttcatatctaatttggattcatattgctattattatttaaagtaacccctaaagtttacatatattttaagccccacaaaatccatctactcctgcctatatctgtgagtttaatttccttttaaaataatctgaatatataccaatgagattttcttttttttaatttttatatatatatttttttattatactttaagttctagggtacatgtgcacaacgtgcaggtttgttacatatgtatacatgtgccatgttggtgtgctgcacccattaactcgtcatttacattaggtatatctcctaatgctatccctcccccctccccccacccgatgacaggccccggtgtgtgatgttccccttcctgtgtccaagtgttctccttgttcagttcccacctacgagtgagaacatgcggtgtttggtttttttgtccttgggatagtttgctgaactagaaataccatttgatccagcaatcccattactgggtatatacccaaaggattataaatcatgcttccatagagacacatgctcacgtatgtttattgcagcactattcacaatagcaaagacttgaaaccaacccaaatgtccatcaatgatagactggattaagaaaatgtggcacatatacaccatggaatactacgcagccatagaaaacgatgagttcatgtcctttgtagggacacggatgaagctggaaaccatcattctcaccaacaatgagattttctaatgccgggcatggatgataggtgtttttgttcttggcttgctccctgggtgctgaaatagtcaggattaggacagcggaccatggagaaagtgcccagatgtgctggtacctgcagctcaggacaaagggaggcagcgtgaatgacacgttcttttatttgggttcttgctgctcccacgttactgtcacaatattttctgtggagttgaaaagcaaatgccccaaggcaagcacagagggtgcaggggttggggtgtcccgagggtggggctgtgggcgggcctggaccccctgcactgcggctcctcctctgtccctggggttccgtcctccttggtggcctgcagggcctctgtccactgccgggccaccaactaggctacagagacacggtgacggtcaggtttctcaggtcccccgggctaaggaacacgtgagcctttcagccaccacgttgaccacacatgcgacaaaggcagaggggccgcctggtcacggaggacgagcagccctttgccccgtctcctggaggctggcgctcaaatgagtaaacccagggagtcctgagattcttcctgctcagacacaatgccctagtgaggtcgcttcctgacacgagtttaaaggatgcacacgtgttataaatcttagaaagctggaagaggggagaaaatcacttccaatcccacctccccagtgactcactcgcgagttggaacagtttccttcctgtcttttttctaacagagcatcttacgtggatgcagtgacaaagatgcgtcatccgcctgcgaccgaaggaagctgcgggaagaacacccaagggccttgtggcatctctcctgcgccctgcacttccctggggccaatgccaagggcaaggccagccgtggcgggcagcagcccctctgctggacacggcgcctgccccaaggccaaggctccaaactcggccccctactgagcatctgatttcctgagtccccctccgagggctccaggatttgacctcacatttcccgcccgcctaagtctgtgtgcttttaggcctgtgtggccttccctgtctgtgccctcagtctacctggacgctgccatccttcaaaacccagcccagtcccacctcctgaaggatgaaggggccctgcccgcctggcctccagggcgtcttgggccagggcagccgcagtggtccctgcatgtccccgtcacagagggtgcctgtcctgaaggagtgcagtcatcccaacaggcctcggccctctctggccaccgaggctccctcgcccttccgggttgggctcagcagaggctcttggggctcaactggagtgaaccgagtcgcggatggtggaagtgaggggtacttggccatggaggcccagggcttggcaggggggcccagggcgcattcctggaggggccgcttcccgggaaaggtcgcgctgtgtttgtgttccggctctttcctccgcctgagttcctccgaggccctggcttatctgaacacaggaccctgtgtgccacggcatgcaccatgtcacggtgaatgtcacacaaacaggaacgtgcctggaggccgcctggacctgtcctcccgcccatcagctgccaaggtgatgctgtggacatggccgtccccacttgcttccccacttatggagctcctcatgggctcaacacccccttccagaaggctggccccaggaggggagtcgccggcatctggaagcctggcaggcctccgcagcgtggccagcatggggtccatgagtcagggggtggaagaggccccgtgacatggggaacacactaagctcctagcccagctcttctcctggaggaccggatgccctcgctctgccgctggggaaggagtgcgcagggggcttgaggccagcaaaggaactgccccccaaatcttactccgggatcggcactttcctggaagaccccaggagtaaggagaaggaagagcagcggggagggagggagtcccaagccaggtgccacagagatggggcagcgtgaccctgtccaggtcacctcctgggaaactgaggcccagccaggcagaactgggtctcctggttccagccaccacccaccactcaggcagctgccacctgggaggcaggagatgtctgaggtggggtcttcataccacgagccacatggagggaggccacgatctccgtcctcccacctgcacacacaccctcccccaggtgagcactaggaagccctctctggggtgggggtggatgctaatgttctgtgcagctctttggttcagtgagtcctttttggtgaaagggctcagagatgcggctaaagcctgtgccagccttgcactcccatgaggttgctgttaccctcatgccactttcttgggagaggaaggtgaggctggaaatggtaaggggctgagctcactcagaggctagcacgaccccaggctcacacctgccagcaatgttaagaggcactgggagctgagaagggctgagggtgccacgctggggttggccaggtccaacctgccccctcctttgaggccctctccttccttcctgtgctggcctttggagcccacggtttcagcatccatcacggaccccaccgcacacccaagcgctgctgaggactttaactcctgctttggaattttcagtgcttctgattattcgtagactcaaaatcagaagaggctacttgccctaaacagaacatggtatatttgcattgcagatcattttacatttttaagaaaaaatgcagtttctctacaaagtcatccccctccaaaaacaaaacaaaacaaaaaacctccctagggattttgacagggctgccatcaggcgtgtgactgatttggggataattcccccatccctttgctttccattaccctgtggcccccgcgtccttcagggcaggtggccttgccttgtgagcatcctgcccgtttgggggcatttcctgggcacctggtagagccgtaggtgagaatggccccagtggtactgggcagatgtgagcacagggacaatgttagtgcaggaagtcaggggcccgtcagggctgttggtggctgacgcggcatccattcccctccccgcatccccccaacacacccgcaccctcatggatggtgactgcactccccactccagggcttgtctgattgatctaatggggcgccgtccctctggtctgtgattgctctggaatgagccacggagcccagagaaggaacatgcagagggcatctgagaactgcagcaggggacccagttgggatgaggcagccctggggaccttgaggagagaggcaggaagtgcccagtccttgacaccatccccgaagcctgccccacgcctggactccagccaaggcatgtaaggccaggtggactcagcagtgtgaggcaaagcacggtgcccggcttggatgccacatgtgttgagccagctgtgctgtggacagggcgctgtggacagggcacagcagacaggcgggggatgtaggcatcgggagggggagtcatggctggtgagagcacccctggagcgggaagtgctgggcagcgagaggtcagggaggcatgggggcttgggacggccaccagccacatcagagcagcactgctgctgattcccagcaacatggaatgaggccccttggcaaagtaacagaacgtatctttgaaatggcagcagctgatctttaaaacagaggcaagccgttcctgtctcaaaacgtttaaatcctcaccccaaaccattatgcggctcactgcacccgtggaaagccaacatcaatacctgcgtgcatgctggcctccctggcatgggcattctttgaggttgctggctcaaagcccccagcactgccagagggggaaaccggcaaacccaggaactccaaggctcagctcaacagccacacccttccgtaggccaaaggaagcaagagctttttctttctcactgttctcagggattcattgtttttgtttctgttttttgttttgttttgtgttttgggaaggggaccacgtcacaggttactatagaaacaacgcctgaactagatggatgacgaagctgttattcctcggggaggctcttcaacttgaaccaattgtggggccattctttagaaaacggctgtttttgctctgggaacatttttaaattatttcttcttcctttgcctcagatgggaggagcatcgcgctactggatcacctctaatcattttttcctttttttcttttttttatccaaagcccagctggcccatcacagggtcatgtgtgaaaagagggctccatgcaggtgttcagaagaatgttttcagtttgtactcatctcagaaaatgcttctgaaatgatgttaataaagaaaacaagatgccaatgtgcacattcagcctgggcctcacgcagcctggggaaaatgtgccaaaatgtcagcatggaaaggattcacagtgatctctaatttctttctcagacctttatcaagttcttactatttatgtgtttgtttatggagatggggtctcactttgttacccaggctggtcttgaactcctgggctcaagcgatcctcccgcctccacctcctaaagcgttgggattaaaggtgtgagcctccatgccgggcattactttttaagagcatatataacttagccacgagaaaaacagcagcatttttcagcaacaacaaaagggagagagatgagagaaaggcccccagagctgggcagggttgggggaagaaccgtgggcagtgggagcagcgaccccaaattcagccccgggccccgcctccaggccagctcctggcagggtggccccaccagggtgaagggcggctgtccgcggcctccaggtcaccagcagggcctggcttatgatctatgaacccccggccgatctagaggttagggctctagatggggcggggattcggttagagagggcagggtggaggggaggatagacaggaaccagggaggtccaggcccagtgggggctgagctgagcgggggaggcggggccgagaagggcggggcagaggagtgggatgagcgtggttggggcagggccagtggggcagggtcaaggctgtgttgaggggtagagtgggcgtggtcggagcggagccggtgggcgggacccggcggtgtggagctgcacccggagtttgtaaggatcaggaaagctgcctggagctgggcagacaggctgacccagggaccctgaccacctacctgagcttccacccagcttcaaggctgtggggatcgtttcttagccaaggtgaaaggccctgagccctccagtgggctctgagggtttgaatgtttattctaaatgggctccaacacggagtgcgcgtgcgctcaaggaccagctggctaggagcgccttctctccccgaggggatctggaatgttcatccgcggtcttcccagtggtcctctcctgagcaccctgggcatggggttgggaagtgggcacacttcttcagtgcgtggtactttctgtccctcccaatgacattggtctcttccaaattccccaggcataggaacagccacaagagccaactcacatttcccaaagccctctgggggcacggcagcgccctgggcagaggagagaactgcccagctcagcggggagaaatcccagtggtgctttccgttccccccaggctcgatgactgccatacttaccagctgggggcgctggtgagcactgccagtctccagcgcccgcccttaccccggggcagtgctgcttacagcacggcgactcctaaaggcaaggagttaaaggcacacggatcctagcactttggggaggctgaggtgggcggatcacttgaggtcaggagttcgagatcaccctgaccaacatggtgaaacctcgtctctactaaaaacacaaaaaagtagctgggtgtggtggcgggcgcctgtaatcccagctacattggaggctgaggcaggagaagcgcttgaacccgggaggtggaggttgcagtgagccgagatagcaccactgcactccagcctggcaacagggcgagactccctcaaaacaacaacaacaaaaacaaaacaaaaccaggcacacagagcaagcggcgggaaagccagatggaagcgaaatgggactttgcccttccgagcctcctgtggataaaatgtcaaagctgggcactcccccttgactcaacggggctgccgccccgagcccctttcatcatcctccccacagccctgaaagttctgtaactccactttagggatcagggattcccgactcaggccctgagctgtttctggagctttcactctgggcggtgtgggggagggggcccctgcggccttcaggtctgggcactgtccaggacaccagggctagccctgagtccggccacctgagattctgaggctgccctctcttgagcccacggtgctgactgggggtccctcgtctggcaaactcagctatgggcacaaagtcgggacaacaaaatggtgtgcacagaatgactcatttcatgtttttaaaaaccttttggccgggcgcggtggctcatgcctgtaatcccagcactttgggaggccgaggcaggtggatcatgagatcaggagactgaaaccatcctggctaacacggtgaaatcccgtctctactaaacacacacagacacacagacacacacacacacacacacaattagccccgcgtggtggtgggtgtctgtagttccagctactcgggaggctaaggcaggagaatggcgtgaacccgggaggcggagcttgcagtgagccgagatcgcgccactgcactgggcgacagagcgagactctgtcaaaaaatgaaaaataaaataaaccgttttacagctgcgcatgtgtgtaaaaacaggacacagcacttctgccgccccacgtgccagtaatgctccgactcctttactcctcattcccaggcccaggggcaggctctactgtcctctccattttacaggcaaggaaactcaggcttggggttagagagcagagatggcctgtagtgagttggacaggagcctgggacctttggctccagggtgccacactcccccaacctactgtcccaggtagaggagcttttgggggtgggtggttactttctgctcatctccttccttttttatgtttatgttaattttattttattttattttattttgggacatggtttggctgggtcccccaggctggaatgcagtggcctgatcacagctcattgtagcctccaactcccaggctcaagtgaacctcccacctcaccctcccgagtaattgggactacaggagagcgccaccatgcctaatttttttttttttgcattatttgtagagatggggtttcgttatgttccccaggctggtctcaaactcctgagctccagtgatccacccatcttggcctcccaaagtgctgagattacaggcatgagccaccacacccagcctgtctgcttctatatgactttatttttctcccatgaccatttattactcttttaatcatgaagaaaaagaggcttccttgttggagtccggtcaagcaagaaggaagcatgaaggaggaaagcatagctggggagcagtgtgtgaagttcagtgaccacccagtgagcaggggcgccccagccaggcagttgctcagaagcacagcttcagacacagggacccattctttctagaaccttcccagaggcctgctgcttccaccaggaggtacttgtgatttgtatgagatgtgagttgtccatttcctattcctcgtgaccaaatgtgtcttttcaattacggtcatttaaaaatgaaatgtgagtgaagacgatgattctagggcaatggttgtcaactgtggctgctctgtagaatcatcggaacttcaaaagatactgatgccagccgggcgcagtggctcacgcctatattcccagcactttgggagcctgaggcaggagatcccttgagcctagaagttaagagaccagcctgggcaacatagtaagactccatctctacaaacactttttaaaaattaaccaggcatggtggcacgtgtcagtagtcccagctactcaagaggttgaggtcggaggatctcttgaacccaggagttcagcgctacagtgcgctatgattacgccactgcattctagcctgggcaacagagaaagacccccatctcttaaaaaaaatattgacacctgggccaggcaaataatcacaacgttcaagtgtggcgcctggcaaagggaattttaaaagcaccctaggtgactctaacatgcagccaagattaaaaccattgttttctagagagagggggacatgcggagagggtagcaggaaagagaacagatgtgtttcgcttgttctttcagtatttctttaggctcattaatcaggagtgcttggacacgaagaagggaacaacagataatggggcctacttgagagtgaagcgtgggagtagggaaaggatcaaaaataaatacctatcgggtactatgcttattacctgggtgactaaataacctgtacaccaaacccccgagacacggagtttacctatataacaatcccgcacacgatcccctaaacctaagataaaagttttttcaaatcaggaatacttagcctagtccattttcatcccgaatattgcagttcatttttcatattctacatttccacagatctttaaataaaaacagagcaagaaacaggcacctcaagggatggtcactgttacagcgttcgcctgagacagccacttccgttgagaagtcacagaaacctccacccaggcaggtaccgaggacagcagacccagtgatgatgcgctgaggggcagctccagaggctgcagaatctctttcaacccctgagcgggagcccaagtcaccaccctcagctgacacaggaggaaaacgacgctcagaaggtccagtggcccaggcagcagcaaagctgcgatttcgaggccgacttggttccaaagcccaagcttttaaccgtcacgctataggacaccatgcagtcctccagattcgttatattttttattatttatttatttatattttttcagaattgaataattttatttttgccttaagaaactctaagaaccggcagtggctcacacgtgtaatcccagcactttgggaggccgaggcgggcggatcacgaggtcaagagattgagaccatcctgtccaacagggtgaaaccacacctctactaaaaatacaaaaaatagctgggcgtggtggcgcacgcctgtagtcccagctacttgggaggctgaggcaggagaatcgcttgaacccgggaggcggaggttgcagtgtgccgagatggggccactgcactccagcctgggcgacagagtgagactccatctcaaaaaaaaaaaaaaaaaaaaaagaagaagctctgagaactaacatcaggaatggttaatgaaacgtagaagttaaagtcatgacagggaagattgtagaagtatgaacatcacaacactgggagaaatgaacgaggtttcctatggttgaccagccaggaagccagtgctgctgagttggcatttaactctttagaatatgcacgcgttgacaatacaaaataccttgattaatgtttaccatctttatctttttggtacaataggggaaaatgtggcgtcatttcttcacagcggttgtgtgtgggggatcgttaccaccaaaatcataataatcatttatagtatattttaaagttagtcttgcaagatcgttatggcattttaaaatctctgtagtttgaacattttcattttatcatttcttttaacaaatactatttcaaatagttcctatccagaatatttacaggtaatttagcatagaagcaaatttgaagctaacttcaaagaagaaaaaaaagttcaatagccagagagctaaggataagatagaaaaaccacatagtaattttaaacagcattttgctgcagatttccaatccaatgaataccaggaatgaaggatttttttctcccaaagaagtatttcacatgaactctgaaccttggatatggaaacttctagaaaaactgaagaccctgagacacatgcaagtaagagtcttctggcaaaaatacaatttaattttccagtttccctcctctcaaaaaactccagaggatacctttagtaggcacagagtataatgtcatgttcaaaatttacaaaggacagcagcagcaaataattacgtccctatcattcagaatggatagtttttcattacagaattagctcctggtttgtcataataggcttgtagaaactgccaagttttattatgcaaactaattgacctagtagttgagtctgaaagatctggaagctctgtgcgcatcagtgtcatttacactggtagaagtaattatgtctaactagtgaaatagcattaatgaaactcaaacaaatttccactgataacatttcagagtgcacgctatagtcaaacagcaatgttataaatacctacgcagaaaagaaacagatagggtgattccagagaccacagagtcttaagttataaggtaatttcaaatttcccaagggttggtttacaaaatggtttgaaagtctaaacttacagaacagaaaacagataaatgcacatcactctaccccttggcaagcaaaggatatatatttttttgtcttattgcatgaactgatgcctgataccctcagctaccaacttaagtaacgctgaaacccctaccttcaaatccagcttaccgtcagatgaactatgtatacgtgggaaattatgattaaagctttacgttcaaagtcaagtaatagactatttttaaaaatacatggtaaggagaaaaaagtgtctatgttgaacaactgagaaacacttaagcgaggttacaaatgactaataactatgcacaacaatcttttccaggatcaactttttcctttgcaaaaaaaaatcatttacagacattcaacaagttaattctgttataaatgataggccatatgtatgttccaacctgcttccttttagtactaggacagtgtagtaccggcacttcagtaagtgttaactttattttctaagtgtttaaatatgttttgttttgttttatgaggcggagtcttgctctgtcgcccaggctggagtgcagtggcgcgatctccgctcactgcaagctccacctcccaggttcacgccattctcctgcctcagcctcccgagtaactgggactacaggcacctgccaccatgccctgctaatttttttgtatttataatagagacggggtttcaccatgttaaccagattgtctggatctcctgacctcgtgatccgcccacctcggcctcccaaagggctgggattacaggagtgagccaccacgcctggcctaaatatgtgtcattttcaaaagaagaaatgtgatatttattgttgttaagataaatgggaactgacaagcctatataacattccttacgtagtttctgatcgctataacattgccacaatttgcagatgaaataaaacttatttttgaaggggtaaaaacctaacagatcttgctgaaaggaaaatactagaacacggattcaactatttcaaataaagacttcctattggagattctaagtaatatgaacatttaaaaatatatgccagtaggctcccacctgaaatacataaaagtctcacctatggaatctatcatttacaaggatttatacataaagattcatttggtggctttcaaattccaaatttgaacattttcatgggaatatttccaaccctaagaagcaaaagggaaatctccattcaattccattctctatcatgtgacagccacagaattaaaaatacgtgcaaccggtgaaacccagtctctactaaaaatacaaaaaattagccgggcatgttggcaggcgtccgtagtcccagctactccggaggctgaggcaggagaatggcgtgaacccaggaggcggagcttgcttgcagtgagccgagatcgcgccactgcactccagcctgggggacagagcgagactgtctcaaaaaaacaaaaaacaaaaaacaaaaaacaaaaaaaaaaaacacgtgcaacagaacttttcacatcctcctgtctgcattacagatatttgttttttacccacggagaccgtattgcaaaggtataaagtggtctacccaacaaagtattttacagatgatggcgatgaaagcaaggattaattctaattagctaaatctaattcgttcttcagaggagagacttgtctgcaaggttgcaagggagggtagcaggaagttgctgtccacttggactagcagaatacacaactcaagtggagatttattctgacattttccagaacaactctaaaacttcttatttactctttatgccatctacaagacacaacacacatttattgtctcaatgttaagaaaactgagaagccagcactaaagtgctaacatggaagggaaagttgtaagaggtactagggtatgctaataactccagttttctactctccatgcctgcttcagagagccactgcttctccttctcgggccacagggaaggctgggagtcccccagcaacaacaagggcactccccggcgattctgtcccttccttaaacttcgctccagtcttggtcgacgtggacgcagccgccgcctcattatattttttaaaacacatgaaaagtcatgtcatattctagccatataacaaatgaaccgtttcggatcacaaatcccaaacccagtcaaaagcgtgtagccattgtcttaaattccaagtcattggttcagatgaaacctgtgaagctaaaaatctactaaatccatttttaggaagaagaaaaaaccaccctgccacaaaccagcaaactaatcgcacctgtatgttcacagggatgggatgcgcaaagcaaaccctgccgtgtgaaggcagctgagacaaagagctggccaggtaggtccctgcccggccatcccccgtcacagtacctgctgaggctgcagagcaggggcccaacacgcagacacccaacgtgcaggccacgggcggggcttctgcccaaaaccagctgtaccaggcgccatcctgacacctgcccgcccgggagagcagaacacagtgggagatccaggggcttcttcggaagagcaccgagagatcccgtctcctctgcaggctccctctctccgggccaggcctgcccttcacagcacagagttcacccttagtgtccccaaggccctggacttcttgggtgtgctggtgtctctctgactttctccctttggactttctggtaactctggccctccagggcagctctggtacttgggaagcctctagaaagacttgggcagaggcagcgatggcctaggcccactcaacccagagagctctgaagacacgccctgccttctgggagaactgcctggtgcctcctcaagcagatcctggggggccctgtgtgggggtcagttccctgtcctcaaggagctcactttgactctggggcaaacctagtgtgggtggtcggcatcagccattgtccatgtggggagactgaggatcagaggggcacatccagcctgggaaagccagaccacgcgcagctcttggcattgtcttcacctgctccgtcagcaacaccaccccctggggggcagctgggtgacccccatctcacagcaggggagacagggcttcgaaaagcccctgtgcaaagcagagctgggacttgaggccaccggatttggtgcagaggagacagcttggatccagggacaagctctgccagcagggaggacaggactgggtgatgggagcttagttttggaataaaaaaatctgcaaaggagcctatctgtccagtaagcaccacagaaacagagttcccagtggcagccaccattccttgagggcctcccctgtgtctagcactttccagagttttctctctgattcctccactcagacctagtagggacaactgcagggcctgggctgcaatggtggggctgggctgcagtggtgggctgggctgcagtggtgtgtctgggctgcaatggtgggctgggctgcagtggtcgggctgagctacagtggtggggctggggtgcagtggtgggctgagctgcagtgggtgcagtggtgtgtctgggctgcagtgatgggcctcagctgcagtcgtgtgtctgggctgcagtggtttttctgggctgcagtggtgaggctgtgctgcggtgatggggctgggctagcgcttcacgtgtgggtctctcacgcctggtaaaccaaatgccctgcagcaaggagtccacacaggagcctgccaggggcggctgctgatggctccggcttctgcaccacttgcccggggatgtgggggctccgtataccctagtattgttaccagaaaggagtcccagtccaaaccccaagacagggttcttggatctcagctgagtatacttatactgatttctggattataggctcaacaacaggtggattgtttgtgagttttccaagaaaggggaggggatttttctgaactgagggtccctctcctttttagaccatatggggtaacttctggacgttgccatggcatttgtaaactgttgtggcacaggtgggagtgtcttttagcagctaatgtattataattagcgcataatgagcagtgaggacaactggaggttccttttgtcgccatcttggttttggtgggttttggctggcttctttactgcatcccatttgatcagcagggtcttggtgacttgtatcttgtgatactaatcctgccaacctcctatcttatcctgtgactaagaatgcctaaccccctgagaatgcagtgcagaaggttcagcctcattttacccagtccctattcaacatggagtcgctctagttcactcgcctctgacagtgatgatctatcctttactggggctcagccttcacccactgaggggccctggatggaagcatgtgtttgcttggtggggatgacaagtcgaatttcccagcccctgtgatccagaggctcttccaagacaccgggactggagaggagtggggggcctagatgggggtgggcacgagaggctggtgatggcttcaagaggggaggggcacacttgccaggaagaggctgagtgcagcagagagcagcgggactgacatttgaggcaagggtcctgtggagggaggagggaagaagttggagagtgatgcctggaggccaaggtggcaccactgggcccttccgcagctcctggggggaaactgggttgggcccaggtgagcaggagggaagggagggttcaccctgggagtgcaggatgggtgctggtttagggtgaggacctggggaagcaggagaggttaggagaacgaccacgctgaaagtgaaaccgcctttgcaaaaactctatcaattagaaaaattgtaagagtgagctgagctaacccgcccctcatctttcctttcccttaatgattcctgggcttttgggctgagctaaccttgggagacatttaatttatagtttaaataacagcaggcctcccccaaaactcttctgcctgtgtaaacctaatgaaaagctatgaggcgagagggagaagctaaggtgtagacctctctagcaaaatacacaatttccccaactgtagattggtcttttgagatatcttttcaggttttttgcaggtctgatacccatggctctacctggaacccccaacctcactcctgtgacacccccctaagaagcgatttagcctgcaggaggacagctttgaccctccatgagttcatgtctgccccagccaatcagtacctgttacttggccacccctgaccccccaaactgccttgagaaacccctagctatgagcctttgatgagatgatttgagtacaaactctctctaccatgtggttggcctcatgtctattaaactctttctttactggaatgcatggtctttatttagaaagggagcaggaggaaccccttgggtggttacagagggcaggatgaaatccctttgaaatgagcagtacagaactccaaaggaagagatggggtctgtgtgtttcttctgccacctgaaataattgaaaggttcaaaatccaatgttatagagtttattcgaactctaagtttgacgaccaccactcaaaaaacacagactctaaaggaatgggctcagtgctctgaggtggagggattagggcttcacttaaatgggaaaatacaaggaggtttagcatgattacattttccacataagattggcttatgagttgcagcaatttgtttggttatatcctgttcccttcgggaaaagtatatttaacatactgtcttatggaatttgataggcatggggtcttttgtaccatctggtctgagttgggtgcaagaaaagaaagaagttaattcgtaacaaaaggtcagtaactaagaaagggaaggggtcttacatctggtgccatttagtctttcataacattttacaaatcaagaaaggaagagcgttaatctataattggagaagcaaagttcacagcgacttgctgcttgactagggtgtcagaatcacattctttcaaggctcgaagtaatttaaagttccaacagctttaatctgatgagcttattgtcgacaaaaagagtcaaactctgaaaaatatttgaagagatttattctgagccgaatctgagtgaccaatggcccgagacagagacctcaggagggcctgagaacatgtgcccagggtgatctgggcacagcctaattgtatacattttagggagacatgagacatcaatcaaatacatgcaagatccacattgcttctgtccagaaaggtaggacaactcgaaggtggagcggggaggttccaggttataggtagattcaaaatttttttattggcaattggttgaaagagttattatcactagaaaggagtgtctaggttatgataaggggttgtggagaccaaagttttatcatgcaaaggaagactccaggtagcacgcttcagagagtatagattgtaaatgccactaatcagacttaaggtctgtgttaatgttcatgctggtcagctttgctgaattccaaaagggaggaggacataaatgaggcatgtccactccaccttctcttcacagcctgaaccggtttttcaggttaactttggagtgccctggccaagaggaggggtccattccgatggctgggggagtgggcttagaattttatctttggtttacactactttcaagctgcgaacatcataagccaccttctgccaggtgtggccctggggaggggtcccttaacatgtgataggaggtgccaccacggctaggcagctacttgtcatcaggacacagaagagcctcttggacctggggaaggacctgtgagactgtgaagaggaaaagtcagttttgaatcaaacccattttataaataagaaaaattacaaaacgcttctcagaaggcggcggggtggggggcggtgaggagggggacccagggcacctaaaggctaattcttgctagagtcatttaaattttaacttaaattttctaatgttgctaatagacttaattatctgttcacaccttttaaaaatggctaaacatggctgagcgtggtggctcatggcaaaatcccagcactttgggaggacgaggagggtggatcacttgaggatatgagtttgagaccagcctggccaacatggtgaaactccatctctactaaaaaatacaaaacttagtcaggtgtggtggcaggcacttgtaatcccaactactcaggaggctgaggcaggagaatcacttgaacctgggaggtggaggttgcagtgagcccacatttcacgactgcactccagcctgggtgacagagggagacccgtctcaaaaaataaaaaataaaaaaaggaatggctaaacataaacattacttttacaatcaaaaccatttcaaaggccttacttcactggattctcagccagtgctgcccccagagcagaaggcagctgtggcaagcagaggggcggccccacctccacctggaagattcctgctcagatcctgggtcacctgcccaactgatgatgccccagctgctcctgctgcgaagctgaacccagaacccactcaggtctggtccccactccgcccccagcacccctagtgcggccacgcgggaggatggggcccgaggctgcaggggaggaagcgggtggatcaaggcaagcctcgcctcgcctcgcctcacccatgggtgttggtttttgttttttaaaccaaacagagcagagaggggcaaggaagcaaaaatgactcaagcccacagaggcagcagctctccctgtgctgggcacatgcccaaggctggctttggggacaaagaataatcaaagatgacactttggggctgccctctccccagccctcctgggcaaagtcggtgcgtcccaggagtcagcctggacttgaacctctgacacccgattgctgctggcctggtgcagggacccgaggggcccgaggacacaggaaagggcctggagggagagagcagccggactccgcccaagcaatttaggcgcctgcctcatctgtggtcccccacacccccagctcaccaagcagcaggacaacccctggaaatcccccagggaggcggggcgcagggattgcagtgaggccctgtgcccaggctggctgtgccctacctgcgggaagagtcactccagtccctctgggctggtccaggtgcaaccacagtaggacacaggtcaactccagtgaaatgtggagggaggaagggtgtgcctgcctgctccttcccctcccttgcagggaggggcggttgccctcagcaacagaatgcccacgtgggatactggaagcttcagcttaccccaccccacccctccaggcccggtttgtcctgggcgcaaggggctacttcagagctgccaggcctccacagcaacacattaaatgttctggaaactaggagatgtggcactgctgtacaacggtcaggaatagccatcctgtcctcctgacccggtgaaaaccagcttctgctgggaaggagcatggggtggcgcctggcttttggagtcaggaagaaccaggcttaagtaatagaactgcctgacctccagcttgtctcttcagctcccaggtctgtgctcgatttgggattattgggtggggcacataagaagctgcgttctgtgctctcagggtgctggacgctgtttcaggtaccagtacacaccagagggaagagagtgcctgatggcatggtgattgattttagtggagacagctagacactaaaccaggagttctgtcatgccagttggtgataaattgatttcttgaagatttttccacttccaagcaaggtagaatagatgcacctgtccccacgccctacactaaggacagttaaaatctctgtatatttccctgggtattacacatacatatataactacatacataaacgtatgtatatcaaacactaaaaggtggagagaagaaggcagaccatgtagggaccttgggacctgaggaatgacatgacaggagttccctgggttttctttctgcctcatatatctgtgactgtgtgctggaaaagccagcaacacgaaacaccaaaagacacagacaaaaaccaacaacaacaaacccaacaagttggccctcagccaaaataattaggcaagaggaagaaataaaaggtatccaaattggaaaggaagaacttaaattgtccctgtttacagatgacatgatcttatagaaaaccctaaagattccaccaataagatgttagaataaatgaaatcagtaaagttgcaggatataaaattaacatacaacaatctgtagcatttctataccctaacaaagaaatcaagaaaacaatgtcatttacaatagctacaaaaaatacttgcaaataaatccaaccaaggaagtgaaagatctgtatgctgaaaactataaaacatttgtgaaagaaattgaagatacaaataattagaaagctgtcccatatctgagatcaggtgccaaaaaaaagacatcccatgttcatgaattggaagaattaatattgttaaaatgtccatacaaccccaaacaatctacagattcaatgcaatccctatcaaaatttcattgacatttttcactgaaataaataaaataatcctaaaattcgtatgagggagtaacacctgctccacagtggcacaaagcactgtcaggtgccacacacagcctgttgggacatgtgggccacagtacttccccacctaaagtactgtagaggcccaggagacatgagccagggccattttaactgtcagtaatggccacaaagacccctaaatagccaaagcaatcttaagcaaaaagaacaaagctggagacaatacactacctaacttcaagatatactataaagctataataatcaaaacatcatggtattggcataaaaacaaacagaccaatgaaacagaatagagagcccggaagtgaatccatgcatttacggtcaactgatttttgacagaaatgccaagaaacacaatgtggaaacgacagtctgttcaataaatgatgttggggccaggtgcagtggctcatgcttataatcctagcactttgggatgccgaggtggaaggaccacttgaggcctccctccaggctccggaagagacctcctccatgatcccttgtctaaggggaaggttcctcaggaccttaccgtgggggctgaaggtggccacccctccaggaacttatgccccaggcgctgaatttgggctgcctaagtctgtgtgcgtgagtctgtgtttgtgtgcatgtctgcatgtctgtgtgtttgcatgcatgtctgtgtgtctgtgtggtctatgtgtctgtgtgtacacttctgtatgtctttctctgtgcatttttgcatgtgtctccatgtgtctctgtgcatgtctgtgtgtctatatgtctgtgtctttgtatctgtgtatctgtgtctgtgtgtctttgcgtgtctggtgtatgtctgtgtgtgtgtgtatgtctgtgtatgtaacggtgtgtctctgtggcggggggtgtgtgtgtgattgtgtgtgtgtgtgtgtctgtgtatgtaatggtgtgtctctgtggcggggaggggctgtgtgtgtctttctgtgtatgtgtgtgtaacggtgtgtctctatggccgggagggggtatctgtgattgtgtgtctgtgtgtgtctgtgtatgtaatggtgtgtctctgtggcggggaggggctgtgtgtgattgtgtgtctgtgtgtgtctgtgtatgtaatggtgtgtctctgtggcggggagggtgtgtgtgtgattttgtgtctgtgtgtgtctttctgtgtgtgtctgtgtatgtaatggtgtgtctctgtggcggggaggggctgcgtgtgattgtgtgtctgtgtgtgtctttctgtgtatgtgtgtgtaatggtgtgtttctgtggccggaagggcgtatctgcgattgcgtgtctgtgtatgtaatggtgtgtctctgtggcggggagggtgtgtgtgtgattttgtgtctgtgtctttctgtgtgtgtctgtgtatgtaatggtgtctctgtggcggggagggtgtgtgtgtgattttgtgtctgtgtgtgtctttctgtgtgtgtctgtgtatgtaatggtgtctctgtggtggggagggggtgtgtgtgatttgaggtggggacggggcctaggcttcagttactcacaacaggacggacaaaggaaacagagtttacccgttctgctaaaaccaagggcgggagggggacggggctgccggcagccctcccagagcccctggcagccgctcacgggttccggaccgcctggtggttcttgggcaccgcagtgaacctcagcttcctcaggacggcgggccagcccagcagctgctggtcccacaagtactcgggggagagcaccttggtgggtttgtggcgcagcaggtacttgttcaggtggctctcgtcgtgccacacggcctcgatgccgttggcctggtcgaccatcatggcctggtggcaggccctggtgagccgctgcacctcttgcaccgaccccccgaagaacccccccaggtagtagaaatcgccctcgtccttggggatgtaggcctgggactggggccggcgctcgtaggtgaaggcctcccggctgcttccgtagaagccggggtgcagggtgccgaacagcggagtcaggatctccacgcccacgtggtcgcggaactccatgtccacgtccacgcacaccaggtaatccacctcgctgaggaagcgccgctcgcagaagtcactgatcatctccatgcggcgcatggacacgtcctgccagcgcttgtaggcgcgcacctccagcactgacagctgccgaccggtccccagcgtcacgcggggcaccgcggccggctggtcggtgaagacatagtagtggacacggtggcccaccatgaagtgcttctccgccgtctccaggaacagcttcaggaaagccacgtatctgcaaggcaggcggacgggggctgggggagccgccggccgtgcacccctgggctgcaggaggcccgtcctgcacccgcccgccagcggccattggaaggcttagagcagcagatgcaccacgttctcctgccctgtcctgagcgagtcctcgggctgcgattcacttcatcctcttcccagcgatgggggaccaccagcaccccctcttactaaggagggctgagggcaggtggctggaggctggtagcaggccgcaggctggcgtctgctcactccccctcagcctggcctgagccacgcctccccacgcagctgcccctcttatggccaggccggccacgtgctccctcattataagctgcacgcgaggcctccacacacccgcctctgcaccctagagcttcctccctccaggcttgaactgcacctattcctaagagtaagtcattcctggcctccgccactgtcgctggcccagctgcccacagctgccgagaagtcaagtatgtgtctgcggttgcctggctagctccctctctggcctggcccagagtcccagggccttgtgggtcagccacttcctttggtgtctggggccaactgctttgcctgccccacctacatctgacagagaagtgaccacggctctgccagcatcctctttctagggtccaaggacagcaaacaggtgtccccctcctgctatctctggtcagtgagcaggaaacatctggagccttgtattgagggggtggctcagcatgacggccggccacagttacagagaggagggggcagcagaagccaccatccctgggtgagacgcagcctctggagaaggagctgggttttaccgacctggcgagcccacgagcccacgagcccacatgagctcagtaagatgctgcatgaatgacctttcccatctaccctctgggaggacaaggctggccgccaccccactctgtcttgaacacaaggagagacctcaatgtccacagtcactcgccactgcctgggtctctaccctcggccacc

SEQ ID NO: 598 - DNA, 221167 bp, Homo sapiens
gacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttacaaagtcaaccttgttgagtgttggaggggaccacaccagggctggaggtcattggcagaggtggtgggggagcatcttggagactgtccatcacaggagacaaggaccagaatggagagcttcaaggtccagtgttttatctggttatctgtgtctgctgtaacaattcactacaaattttgtggcttaaaacatttgttcttaggttctggaggtcagaagtctgaaatcggttttctggtctggaatcaaggtatgagcagagctaccctccctaccaaggttctagggtagaatgtttcctcgtcttttccagctgtgagaggtacagaccttctattccttgcctcatggccctttgcctgtcttcaaagcctgcattgtagcatgttgcttcagtgatcatattgccttatgtcttctatagtcatagctccctttgtctacctcttataaagacacttgtgattgcatttagggcccacctggataatccaggataatttttctgtttgaaaatcctaatcacatctgcacagttccttttaccatatatagtaatattcacaggttctaggaactaggacctggatatccttggaggccattatatatctcagtctaccatagccaggctgagaggagccatccagtattcagtgatgagaaggagccattcacgtgttttaagcaggactggcatagggttgaaaaaatccacttatgcattaggggctggtgggaagggagatactggcagctcaactaaggcagtgggaaaaagagaggagtggttaggcccagtgaccaggtgttggctgatgctggggtgaaaagaatatgtaaaggagaaacatcagagcacagccccaccccttcaggctccagaagtgcaagacaagagggaaggctgcagggatctgatgtagggcagaaagaacatcatgagacaacaaggagtgggcttctgctagaattccaagaaggaagccaagaggaggcatgaaggacttgtatgatgccactgagaattctcatggcttggacagaccagtactcagtggacgtggtgtctaggctgtcaccagtgactcttgcagaatgggtgatgatgggaggtgggggcaggaggcacgggaagcacaaatcaaaattggtgggcattctgagtggaggaaagcgaagacacagagacaggagcagagacctcagttcccaaccaaaggcatctttctgtatgtttcctattagagccacctgctacctgtactaaaatttctttcttattttttaatctactcatgtttttcttaaaaggaaatgtccttttaaaattgaagtatttggggcctggtgcagtggctcatgcctgtaatcccagcactttgagaggccacagcagatggatcacttcaggttaggagttcaagaccagcctggccaacgtggtgcaaccccatctctactaaaagtacaaaaattagctgggtttggtggcacatgcctgtaatcccagttatttgggaagctgaggtgggagaatcacatgaaccagggagatggaggtcgcagtgaaccgagattgcaccactgcactgcagcctggtcaacagagtgaggccctgtctcaaaataaaaaataaaaaaattgaagtatttagtatatgtggttttgttttgttttttaacctagcagcaacactggtggtgtatagttttgatttttcatttccctgatgactaatgatgttgaacatcttttcatgtacttatttgccatttgtgtatcttcttttatatattcttcaaagaaataactatacagattctttgcctattttaactgggttgtctttttattactgagttgtatgtgttcattacatattctagatacaagtctcttatcagatatgtgattcccaattattatctcccattctgtgagttgtcttttcactttcttgctaatgtcctttgaactacaaaagtttttgttttgatgaagtccaattgattacatttagttgcttatccttttggtttcatatctaagaatcccttgccaaatccaaggttacaaagatttatctctctgttttcctctaagagttttatagttttagctcttacttttaatttaatttaatttttttttttttgagatggagtctcactgtgtcgcccaggctggagtgcaatggcatgatctcggctcactgcaacctctgcctcctgggttcaagcaattctcctgcctcagcctcccaagtagctgggactacaggagcacgctgccacgcccggctaatttttgatattttagtagagatggtgtttcaccatgttgcccaggctagtcacgaactcctgagctcaggcaatccactcgtctcagcctcccaaagtgctgggattacaggcgtgagccactgcgcccagcctcttacatttatggctttgtttctattttattttatttcttttttttctcttcttttttttttctttgagacaggatgtcactctggttgcttaggctggagtgcggtggcatgatcttggcttgctgcaacctccactttccagactcaagcactcctcctacatcagcctcccaagtagctgggactacaggcagcctggctaatttttttcaaattttttttgtagaggcagggttttaccatgttgcccaggccagtcttgatctcctggactcgagtgatctgcctgcctcagcctcacaaagtgctgggattacaagcatgagccactctgcccagccagcctaatttgttttgagttaatttttatatatgatataagatagaagtctgtgttagtttgaatgtgtctcccaaatttcatgtgttgatagtatttgaaggtggcgacttttgggagaaatttaggattagataaggttatcaggattggactcccttgatgggactagtggctttagaaggagagagagacctgagctggcacactcttgccctctcgccatgtgatgccctccaccatcttatgtcataacaagaaggccctcaccagatgccagtaccatgatattagacttcccagccttcagaactgtaagaaataaactcttttttttttttttttttgagtcggagtctcactctgttgcccaggctggagtgcagtggcgcaatcttgactcactgcaagctctgcctcccgggttcacaccattctcctgcctcagcctcccatgtagctggaactacagacgcccaccaccacgctcggctaattttttgtatttttagtagagacagggtttcatcgtgttagccaggatggtctcgatctcctgacctcgtgatctgcccgcctcggcctcccaaagtgctgggattacaggcatgagccaccgctcccagcccacaaataaactgtcttcatcaaagttattgaaagagagagagagaaaaaaagcaactttctttataaattacttcgtccttaggaggacaaggcgagaggatcacttgaggtcaggagttcgacaccagcctggccaacatggagaaaccctgtctctactaaaaaatacaaaaattagctgggtgtggtggcgtgcacctgtagtcctagctactcaggaggctgagccaggagaatcaactgaatccgggaggcagaggttgcagtgagccaagattgtgccactgcactccagcctgattgacagagtgagactcccatctcgagaaaaaaaaaataataaattattcagtctgtgatattctgttacagcaacagaaaatatgctgggacagggactatctttactcttttccatgtggctatccagatgtcctgtaggaagtgtttgtaaaccacttaatcattatacagcccccaaggggtgatgctttgttgacatggaaactgggaagcaaagatgcttcttggggacgaagtgactgagccaagactctgatccagaaatatctggctttcaagcatggctgcagaagggctttgtttatgggacacattttaggtaatgttgcatcaacttataaaaatcagaatttttcacgtaaaggccaggcgcggcggctcccgcctgtaatcccagcactttgggaggccgaggcgggtggatcacttgaggctaggggttcgagaccaacctggccaacatggtaaaaccccatctctactaaaaatacaaaaattagccgggcgtggtggtgcgctcctgtagtcccagctactacggaggctggggcaggagaatcacttgaacctgggaggcagaggttgcagtaagtggaggtggcaccactgcactccagcctgggtgacagagcaagactctacctcaaaaagaaaaataatttttcacataaaaatctgacctaattttcagcttctcttcagagatgagcagttctgacaaagggacctgtattttcccgtaatcagtgagttctgagtccctgctgctccttcagacagggtccatgctccccatcacctccagtcccaccactcataggtaagtgtccttgtgggctcttaaactggcccacttctgtcatgtgagcctgccttgccctgaaagcaggcgaatttctgaccccagccctgtgtgcttctcttttcaggaaggatggtgaacctgtttttttgttttttttttttgagatggagtctcactctgtcgcctcagctggagtgcagtggtgtcttggctcactgcaacctccacctcctgggctcaagcgattctgctgcctcagcttcccaagtagctgggattacaggcatgtggcccagccaatttcactttgtatctaagtattagtgagtgtattagttagctgctgtgtaacactgtcctaaaacagtatctgttttacttaaaacagtaactgtttctttagctcacaaacctgcaaataagtggtttaggccagtctctgctggtaccctcgtctgtcttgttagatgtaggtcagctctgcctggcgttgttgatcttggtgagtcctctcacatgtcctcactgtacaacccacacctatgtgtagtggcctaataggtgcccagtgagacctgactcccatcattcataacgtgcagtctctcgtgacacaggcctgcctgttttctccttttccattcttcctctgccagaaagcactgatggagatagtccagctgattgagaatgtgtgtgatgtttcaggaaccagtgaccttccgggatgtggctgtggactttacccaggaggaatgggggcagctggaccctacccagaggatcctctaccgtgacgtgatgctggagacctttggtcacctgctctccataggtaagccctgcttcgcaaggtgtgatagctgattctctctgggttataagtcatggggcctctggtgtgaggacctgaccttgggtcctcactccctatggggagtgcatgaagagggaggtctgcccttttccatcaccatgcagagcttcaccatgttgtgaggtgcccacgtgtcctcacagtcgggagtctggtctggagcctgggcttgttgtttctctcctgagcagcccctcacctcctgtgtttttccccatttccaggtcctgagcttccgaagcctgaagtcatctcccagctggagcaagggaccgagctatgggtggctgagagaggaaccacccagggctgccatccaggtgagaacccactatgtgggagcagctaatgggagcagcctagcaggtcactggagatgcacttcatggaaagggtggtggttggtggtcctgaagaccaccccattcactaggagtatacaggactcagcatagagtcatgctgacagctctcagtataatgagaccaacaaaggggaaaggcgcgtggggataagttcagaggaagccaggcatgagcctccagagtcccctcactgtggagtcattcaggatgtgccaggctcccccagcactcaggtgtgacacctcatgagacatgagctctaccagggaatcttgttaagagactcagtgctaggagttttgactgaggctgccacatagacactctctgcctagcacagaccaaggttccagactaccaggagaaagccagtgtttggaataaaccacatagtgtgtgcagtgtgggtgtagtaaaccactctcatcagttagggttgtgggaaccatccccaaatccaaattctcagttgcagccaaaggctaaccttgtgaataggcttctcctaagaatgctggtttcaggcctgccctgttaaatcttttctgcacagtgctccatagccttctcacctgtgctccccatcttctaagctcagaggtcatcacctgtgctccagtgctgagaatcccaccccttcctccctctctgcttcatcttcccttataggttccaggtcattccctctctcaccatccttctcagcatgtcctttctgtggcatcatttctaatatgtgaacctgcccttcatcttctccatttcattcttgcatgtccagattctttgtgttttgttttgtttttaagacagggtctcactctatcgcctaggctggagtgcagtggcgtaatcacggttcactgcagccttgacctccctagttcaaatgatcctcccacctcaccctcccgagtagctgggattacagacatgcaccaccacgccctggtaatttttgtatttttagtagagatgggattttgccatcttgccaggctgggctcgaactcctgggctcaagcaatccacctactttggcctcccaaagtgctgggactacaggcgtgagccaccatgcccagcttttttttttttttttttgagaccgtctctgttgcataagctggagtggcagcagtgtgatcatggctcagtgcagcctcagccttcctgtcacaaatgatcctcctgcttcagcctcttgagtagctgggactacaggtgtgtacccccacacctggctaattttctttttaaatttttttgtagagacacagttgcactgtgttgcccaggctggtctcaaactcctgggctcaagcaatcctcctgtcttggcctctcaaagtgctgggattacaggtatcagccactgcacctggcctttttttttttttttttttttttgagacagtctcactccgttgcacaggctggagtacagttgcattatcttagtctcctaggctcaagtgttccacctacctcagtctccctagtagctgttactacaggtgtgtaccaccatgtccagctgatttttttgatttttttctttttcttttttaaaaattattttactttttttctttttttttctttctttcttccttttttttttttttttagagatggggtctcgccatcttgtccaggctgcaggctgctcaaactaactcctgggctcaagcaatcctgcctcaacctcctaagtgctgggattataggcgtaagccactatgcctgactttttgtttgtttgtgtgtccttttttttttttttttaatagagatgagatctttctacactgcccaggctggtctcaaactcctgagctcaaacagtcctcctgcctcagccactgaaagtgctgggattacaggtgtgagccactgtacctggtcacatgtctagattctgtaaacttgttccccacacccttctttattctcttatgaggaagaattgtgtttagctataaataccctaaaaccaggttggagcagctcaaaataaagaagcatttttcttgtaaaacaggagccctgagtctgctggtactgtcttggcatctcagaggtgccagggctgattgttctgtgattttcccaggctgtccttgggattacagtgcagctgcagcagctccagccatcacagttgtgctccatgcaggaaggaggggaagaggtaggaagaattctgccagccacatctgtccccttttggcagaactctagatgtcacctgctggggtctctttagccagaactaggtcacctcctcttgcactgaccctagttgctagagaggctggaaagctaggggtgtctagattgtcataattggcttgggcgagtcatggtccccttgctgtggcttgtgtgttggtaccctgaccacattctagagtaaatagcatctggccatgggatgtacaaccagcaatgcctgcagattagcctcccacccaaatacttctgatgccacccagggctttctgattctgcagaaaaacacatatgcccccatgatagcgtatgacctatcaactgggagtcgggtgaatctgctgcagaccctgttttcctgcccctttcatcggttgtcactgctgttacttcagacatgtatgtcggaagcaaattctcatcaccctggacatatgcctgtcactcacaagtcttatgccataaccaaatccaggatctaaaacgtgtgcccataaatactaagcaaaatgttgtgcttgcatggattaggagtatggggtcaaaatcatgatggacagtttcaataacttaatacctagacagttataaatactccagaagcagaaggttttcaaggctttatgttaagacagaaacatattttccatgtaatgctttgtattagtttcctgttgctcctgtaacaaagtaccacaatctaggtggcttgaaaaagcaccgatttggctggacgcagtggctcacccctatcattccagcactttgggaggccagggcagacggatcacttgagtccaggagttcgagactagcctggccaacatggcacaacaccgtttctactaaaaatacaaaaattatccaggtgtggtggtgcatgcctgtaatcccagctactcaggaggctgaggcacaagaatctcttaaacccaggaggtggaggttgcagtgagctgagatcatgccactgcactccagcctgggcgacagagcaaaactctgtctcaaagaaaaaaaaaaaaaaaaaggacagatttattttcttatagttgtggaggtcagaagttcaaaatggttcatcagggctagttcctctgacggcgcccagagagaatgcatttctgtctttctcagcagctggaggctgcccagactccttggttcatagacccttcctccatcttcagagtgcttcactctgacccatttccattatcacaaccgcttccctgactcagacccttctgcttccctcctatatggactctttggtcagatttagggccccaggataatctcccatttcaagattctttttttttttttgagacagagtctcgctctgtcacaaggctggagtgcagtggtgtgatctcggctcactgcagcctccgccttcccaggttcaagcgatcctcctgcctccacctcccaagtagctgagactacaggccgtgccaccatgcccagctaattttttgtatttttagtagagatgggatttcaccatgttggccaggatggtctcaatctcttgaccttgtgatccgcccgcctcagcctcccaaagtgctgggattaaaggcgtgagccaccgcgcctggcccatttcaagattctttttttttttttttttttttttgagacggagtctcgctctcttccccagactggactgcagtggcgcaatctcggctcattgcaagctccgcctcccgggttcacgccattctgccttagcctcccgagtagctgggactacaggtgcccgccactgcacccggctaattttttttttgtatttttagtagagacggggtttcaccgtgttggccaggatggtctctatctcctgacctcgtgatccgcccgccttggcctcccaaagtgctgggattacagacgtgagccaccgcgcccggccatcaagattcttaatcacagctacaatatcccttttgccacataaggttccagggattgggatggggacatctttgaggggccgttattcagcataccacatgattaaaatagagagtaaattttttttttattatttttaaggaaaagaagcctagtcaatagaagaagaccgcgtctctacaaaaaaatttaaaaattacctggcatggtggtgtgttcttgtagtcctagctacttaggaggctgagcggggaggattgcttaagcccaggagttcaaggctacagtgagctacaatttgcaccactgcactccaggctgagcaacagagcattaaaaaataaaggaaaagaggccaggcatggtggcttacgcctgtaatcccagaattttgggaggccgaggcgggtggttcgcttgagtccaagagttcaagaccagcctgggcaacctggcaaaaccacatctctacaaaaaatgcaaaaaaattagctgggtgtggtggtgcatgcctgtggtctcagctgttcaggaggctgagcccaggaggttgcagtgagctgagatcatgccactgcacttcagtctgggtgacagagtaagaccttatttcaaatataaaataaaataatggtgaagaatccctgtccaggcagatcccactcccagtgcactcacaggggtttgtgggctcagggatggctgggcgatctcaagcccctccttggcccctgtcactcgtctggcatcattccttactggttccctcttgcggttgctcagcttcacctgctgcaggtcacctcctggctgactacagtcccagctcttctcccatttcctctcttcatcaactgctcaccctctctctcggagactccatggcttcccatgtgccaggatcagtgagttgttctgggcagccaggagtcaggctggagttggagcctgtctcaacctcagtgctctttgctgttcctggccaggccagttcactagtgttctcaagtccccctcctccggatgttcttccgcactctcccagcaggcagcgttagtcttggctggggtcacagtgttgtctttagtctctgtgttttcgtccgtgttgtctctcaggcagtctcccagctcacgagcctgttccatggatgttcctgaggacctgccatgtgctgctgtttgtgctgtggatgcagcaaagaatgacaggaaaggctgagccctcactcagcatctgggagatggaagtcttgagagatggatgccagtgccaggcagtgatgaggccgtaaaggaaatgcacctggggagggcaagatggggtgctcatgccccgggactggcagggaggcctctctgagaaagtgactcaaactggggcacagggagcaaggtgggcagatgtctggggatgagggttcttggcagagggagcagcaggtgcaaagggccccaggaaggagtatgggggatgcattagagggatgtgaggagccatgtggagcagagtgggcgtggggcaagagtcaggaggtgagacgagccagggcatggtggagaagggcacagggtcgtgtccatcctcagaagtgactgcagagtgaatggaggagtgaccagggctggcttgcagtggggaggagggtgggtctgtttggttttgcataatagctttatcaagataaaattgacataccataagttcacctattaaaatgtaccactcagcggttttgagtatattctcagattgtgtgcagctatctttactatctaactccagaacatttcatcaccatcttagtcagcttggggtaccgtgacaaaataccaccgcctgggtgtcttgtacaacagacatttatttctcacggttctgtaggctggaattctaagagcacagtgccagctgattcgggccctggtaagggccccttcctcaattgcagaaggccgccttctctctgtgcccttatatggcagagagaggaagcaagccctgtggtatttcttcttataagatcactaatctcattcttaaaggccccaccctcgtgacctaatcacctcccaaaggcctcatctccaaataccctcacaatggggattagggtttcaacataggaattttgctatcgacattcagtccatagcagtcactctccgtctttcccatcccctgccaaccagtaacctactttctctctctatggatttgcctgttctagatattccatacgaatggaatcttacaatttgtgacctttgtatctggcttctttcactcagcagaatgttttccggcttatccatgttgtagcgtatgtcagtactttgttcttttttgtggctgcataatatcccgtcgtatggatagaccatattttgtttatgcatttgttgaggggcatttgggttgtttctacttttggctattaattaatagtgccactatgaacattagtgtataaatttttgtgtgaagtgacttatattttagaataaacctctgggtgctatgtagagagtcagtttttttttttttttgagacagagtctctgcttggtcgccgaggcgggagtgcagtggtgtgattttggctcactgcaaccttcgcctcccaggttcaagcgattctcatgccttaggctcctgagtggctgggactacaggtgtataacaccacacccgaataatttttgtatttttagtagagacagggttggccaggctggtcttgaactcctgacctcaagtgatcctccagcctcggcttcccaaagtgctaggattacaggcatgagccaccgggcctagccagagagtcatatttgggggccagaggtgacagagcaggaagcctggcacctggccagcctcagctcctccattatctctcccgttgtcaagctctcattcattcattccctcgatacgttccttcagcattcactgagagatatttttgagcttctactacttgtcatttctaggcactggctgtgaacattctagtgcggtgaggtgtacccagaatgaatgaacacatgacctgtattttggtcaggacaagagcagatgagggggcttgaagagggcttggggaaagcgggaagcctggcttataacagagtccctgtcctaatccccagaactggttatcttggatactgggtgagcaagagggtcagaatcagacaaggagatgtgacagcagaagcagaggtgagtgagagagatctgaagatgctgtgctcagctctagaggtgaaggaaagggccaggaatgcaggcagcctctaggaacgggaagatgcaaggattttccccagaacctcccgaagagaaaccagccctgccaacaccttgattttaggacttctgtgttccagaactataagataataagtgtgttttaagttacagcagcaaacagggaactcatataccttgacttcattgccagtgcatggcccacagcaggtgctcaataaatgtttgttgaatgagtggagccgtgtctgagggcacttgatgttaaaataagaggagaatcaggggacttgccagggcagctggttaggaccccatttcaatatcaggcctatggtgttggaggcctgtcccccttccgtttttttctcccaacagctcagagatctttgggttttctttcagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaaggctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggagcaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcaaaaaaaatcaatatgcggccccattttgtaaaggatcattaaaatgaaagtaatttatggtagagtaaattgtagagtaacgtgtactgacttggtgcagtatttctccttgtcactgtgggcccaattttgccaggagacctagggcaatagcctgttgcttgtggactggtagagggtatgatgttgaccatggcaatactgtgaggggccttcccatgtggaacgtgaccttccaaagtagtgactaactcttggaaaagtttttaacaacataatatgctattgcatttctgggaaattctgggtaaattccaagcatgcagcaattagtttgtgcttatgtgtgaagtccagttaggttctcagttcataccctgaaaactgcttattccacatctgttgatgtggtccactgggggcagttctgttcctcaccatcttggcagcatgcatggctcctgcccacatttcaaccacacccccaacccaattacgtgaccagcccccacgaaatttcacagcattccgtgcaggggagtgtcacagctcctcttgaaaaacatctggtgttgctatgagccagaagttcttttttttgttttttgtctgagatggagtctcgctccgtcacccaggctggagtgcaatggcgcagtctgctcaccacaacctccgcctcccaggttaaagcaattctcctgccttagtcccccgagtagctgggattacacgcacctgccaccacgcccagctaatttttgtatttttggtagaaatggggtgttggccaggctgatctcaaactcctgacctcgtgatccacccacctcggcctcccaaagtgctgggtttacaggcatgagccactatgcccagctgagccagaggttcttaactggtggtgcttttgcctccagggcacatttggtgacatctagggacatttttggttgctgtgcctggaggaagggtgccgccgtcatgtagtgggtagaggccagggacgctgctcaacatcctttagtgcccgggacagctcctcaacaaaggattctctagctcaaatgtcaatagtgccaaggtggagaagccacctgggtataaacccagcccagaaatgtagctgacatttttaaaacttgcagccagctgtggtggctcacgcttgtgatcccagcactgtgggaggctgaggagggcggatcctttgaggtcaggagtttgagactagcctgggcccatggcgaaaccccatctctactaaaaatacacaaattagccaagtgtggtgacatgcgcctgtaattctagctacctgggggaggctgaggcacgagaatcgcttgaacctgggaggcagaggtttcagtgaaccgagattgcaccactgcactccagcctgggtgacagagcaagactctgtctcagaaaaaaaaaagaaaagaaaaaaaaccttcaaattgattaatcagggctggactagactagaaatcatataagcttgattttaacagatggcatcattagctagtttatacatgatgtactttttagtacatcctttacggttttgcagcattcataattgatgtgaaataaggaagataatcctttttttttttttgagacagagtctcactcttttgcccaggctggagtcagtgttgtaatcactgctcacttggcagcctcgacctcctgggctcaagtgatcctcccaccccagcctcccaagtagctgggaccacaggcatgtgccaccattcctgattttttttattttttgcagagacagggtctcactgtgttgcctaggctggtctcgaaccttggcgtcccaaagtgttgagattataggcatgagccactgtgcccagccacttatttttctgagtaacctttaaggatgtattgtggacattttcaaacatgagtcatatatttttgctggtactcccatctacctccccaccattctccttccctggatatatatataaccatgtttgtccactgggacaaaaccattttcacaatcatactaagctgtcatttcacatttttgctgtgcactgatagtgtgaaagcaatggcaggtaaaactgctgagcctgagttcaaagcagggcagtagccctgaggttggttgttcatattcttctccactgggaaatgcagtaaagaaaaagaaaagctaatttcacttaatttcttttcttttcttttttttttttttcttttgagacggagtctcgctctgtcgcccaggctggagtgcaatggcgtgatctcggctcactgcaacctccacctccacggttcacgccattctcctgcctcagcctcccgagtagctgggactacaggtgtgcgccatcttgcccagctacttttttgtatttttagtagagatggggtttcaccatgttagacaggatggtgtcgatcttctgacctcataatccgcccacctcggcctcccaaagtgctgggattacaggcatgagccactgcgcctggccctctttttctttttgagatggagtattgctctgtcgcccaggctggagtgcagtggcacaatcttggctcactgcaacctccgcctcccgggttcaagcagttctcatgcttcagccctctaagtagctgggatgacaggtgtgcgctaccacacccggctaatttttgtatttttagtagagatggggttttaccatgttggccaggctggtctcaaactcatgacctcaagtaatctgcccgcctcagtctcccaaaatgctggcattacaggcatgagccaccgtgcctggcctactttcactgaatttctgtgatgaaacgggaaaaattaattttgttaaatctcaagtagaactatattgtcattatcacatctaaacagatatcatcaaatacctagtgttcagatgttctgggttgcctcataaattttgttttctatttgtttcatagtaatcataatctaaacaagatccacacagtgcatttggttggaatttttcttttttctttttcttttttttttttgtgatggagacttgctctgtcacgtggttcactgcaacctcccaggttcaagcaattctcctgcctcagccgcccctgtagctgggactgcaggcatgcaccaccacactcagcagatttcttaattgtttgtagagatggggttttactacattgcctaggccagtttcaaactgggctcaagcgatcctcccaccttggccatccaaagtgctaggattacaggtgtgagccaatgcaccctgccaaacagcaattttttttttttttgagacagagtctcgctgtgtcacccaggctggagtgcagtggtgcgatctcggctcactgcaagctccgcctcccaggttcatgccattctcctgcctcagcctcccgagtagctgggactacaggcgcccgccaccacgcccggcaaattttttgcgtttttagtagagacggggtttcaccctgttagccaggatggtctcaatctcctgacctcgtgatccacctgcctcggcctcccaaagtgctggggttacaggagtgagccaccgcgcctggccccaaaacagcaatttgaataaccatgttggaatggttgagcattggaacgcattagcatcagaacttcccgtgtcaggccaggcgcggtggctcacgcctgtaatcccagcactttcggaggccgagatgggcagatcacgaggtcaggagatcgagaccagcctggctaacacggtgaaaccctgtctctactaaaaatacaaaaaattagcctggcgtggtggcgggcgcctgtagtcccagctactcgggaggctgaggcgggagaatggcgtgaacctgggaggcagagcttgcagtgagctgagatagtgcctctgcactccagcctgggtgacagagctagactccatctcgaaaaaaataaaagaacttcccgtgtccgtttttgctttttggatgctgggagtgtcacaactcagctatccaatcaaggcagagctggcctccaggatgccagagccagagctttgtggttcatctctagaggttcaacaggaccctgtggatggcccaagttcgtttctctgcacttacctcttcggggttgtcctcaaaacgttgccgtgtcagctctcacttttcacagcaactctggcctcctaccttggactgcgccacttctgtctccttagataacctccattcgcatagctaaatgctgcaccctccgacactgccacaataatagttctgtgagttagtaccattttatagataggcaaaatttggcacaggacaaaagttagtggtaactagaacaaaagtaaccagcccaagctaggaagtggtggagttagaatttgatgtcagcacccagctgaccatggcttaaacagatgaggctttgttcaaaggctgtcttttcagtggctcagctgtgtcacagtcgatgttttctgcaatctctcaacctttccattgtggtcatgaggagactcctatggctccagccattgcatccacagtgaagactgaaagaagggggaatgggcaggccaacacttaccgctgatggtgtttaaaggaaaaacattcccagaagcctgcagcacatgccccccttagtctcactggccacagatgggtcagggggccacccctaataacaacggggcttagaaacctcgtatttacctttctaacctctgtggtggagacaggtgggagagaaaagtcctgggaagtggatgatggaggcagctagccgtagctgctgcttttctcttcaagctcttgggagaattgcttgtgctccctattcccttggtggatgatggaggcagctagccgtatctgctgcttttctccttcaagctcttgggagaatcgcttgtgctccctattcccttggtggcagctcacacctcagacctgctgtccgcccccactgcttcacagaacccactgcaaccactgtccaaggtactacctctggtgtcgtctctcttcatccccaggactgtgaagcctgctaacctctttgcagagctccatctccttgcattgtggggttccttctaactcttcagggacttctcaacctcccgtcacccttcctaaatgctggggtcctagagtccaccttgtgctccacgccctccccaggtgtcatctacatccctagctttgtgctgctcaccaccaaatcagtctggtgcttctgagatttgggcttcagacccaaacaactgctgtgtgctactgggcaactccccgaggtgtgccgaaagctccccaaacccagcctaccccaaacaaaactcattttccacccagactagtctctgcttccctgatccctttcctggaggctgtttccacttgccatcccatcatggaagccagaaaaccagtcttcttgacctctccccttccccactccatggagttagaggtcctgttgattttgccatgtaaacatttcggatttgcttacttcatccccactgccaccaacagtgcaggatggccctaagaggagaagtaatgtgctaccaagtggcccagccagagtgtgaaccaaacagtctggtaccaaaaccctattctggatcattcctcctttctgctccaccagcagtttggggcacaggcttgggaatccagacaggaaagctcctcccctctgaagcagtgggaccaaaaatgacagcatggttctagacagctctggaagtcaggcctgtgattgcctcattccctccaccttggcccccaaaatggccagtcctgaaggggtcacagttgatacttctctgagggggcatggggttggctgaggttatagcagccccacagggtggtaagctgggatgaagcaatcaactggaactcaacaagccttgagttctcaaagggggtgtgggaaggttcttatacatcttctatgaagggcagtttatcagtcactaaattacaaatacataaaccctttgtctcaccaaacctgctgggaatgaatcctacatatatatttatatgtgtgcaggctacatggttttcattatgctattgattttaaaagtaaaaatttggaaagaacctccatgtccaccatggggaactggctaagtcatttatggtggaatggtgatcataaaaattcattaaaaatgaagactctatatacagcttgaatattccttatcgaaatgcttgggaccagaagtgtttcagatctttgcatattttctgtttctcatttcagttcacattttctaagcatgatattcctactgatttccttgtagatattttgaaacagataagaaactcctccgtggaaattactgttaactagggaaaagacatgtttttttctgttcataaaagtaatgcgagttctttgtagcaaaacttggaaaatgcataaaagtaaaaaaaaaatgaaaacttgtgtaaaattcctcatactttagccatccatagatggtccttaccattaggattttactaattttccttgcagctttttcttaaaatatacacgtgtgtctacacatacatagtgtacactaaattttacatacacacagaggaatatatatgtgtatagttatcttgtgtttagaaatttggaatcccttctagttgtcttgtaacatgtgcttactctattttgaggattttctctatgaatttcatgtagctctttaaattaactttcaggaggattgtaacaatgtgctctccacccagtattttaccagccttgagttttctcaaagggggcattggaggggttcttatacatttacagtgggaatgtgaattgatacaacttctgtggagggcagtttatcagccactatctaaattacacatacataaaccctttgtctaagcaaacttgctgggaataaatcctacacatatatttgtatgtgtgcagactgtttgtacatggttttcattatgctattgattttaaaagtcagaatttggaaacaaccctccatgtccaccatggggaactggctaagtcatttatggtggaatggagatcatagccttaaaaatgaagactctttatatacaggttgagtatcccttatccaaaatgctcaggaccagaagtgtttcagatttcagatttttgaattagggatcctcaaactatactaatgtgagaaagagctctaagatagttaagtagataaaagcaaggtgtcaaactgtagagtatgtttccatttatgtaaagaagaaacaggctaggcaaggtgactcacgcctgtaatcccagcactttgggaggccgaggcgggtggatcacctgaggtccggagttcaagaccagcctgaccaacacggtgaaaccccatctctactaaaaatacaaaagctgggtgtggtggtgcacacttctaatcccagctactccgtaggctaaggcaggagaatcgcttgaacccaggaagtggaggttgcagtgagccaatattgtgccattgcactccagcttgggcaacaagagcgaaactccatctcaaaaataaataaataaataagaaacatttgtttatatgtacacacataatctctgaaagggtaaaagtggcatactggttggccagaagaattgggaggacagtgatgaggaataattttcactctttatcattttatatttttggaattttgaaacatgtaaaattattaccagttcaaaaaataaatttaaacaaaaatcttaactgtttcaaattaaagtaagtttgataatttctttcattgtttactgtctgcatcccccatacagtgttcacatgagcagagagtgtgtgtcttggtcatattcatacttgttctatatatactcgtgtgtgtgtgtgtgttcagttgacagaaacagttgagtgtaaaacagcttcaactcgatgataccaaagatacaagataaaggtccctggagggtggctgtagcgcacacatacatttccaagttactttgttaaatttcctgtatcaatgagccccaattatgagagccccctacatacaagttttagccaatagccaagtcccccatttccagtgttatcttcatgtcctccaaggtattcaagttgtttctgcaatgggtaactgggaagaaatcagcatccagtctgaaaagcagtctcccataggtcttttgtaaggagatccaacatggacatcttccagaatgcactgtacaacatggtagccactagtcatgtatagctatttagatgtaaatttttttaattaaaaaaatttttcatttatagcaacagggactcactgtgttgcccaggttggtctcgaattcctgggctttagtggttctcccactgtggcctcccaaagtgctgggattacaggcgtgagccaccatgcccggcccagagctgatagaatttttaaagtccccctgtgatgatctgactgtggtaggagtagggaggtgtaacccgagtcagtatgcacattgggagcctcctccactaggtcatacaggccttctgcgtgtagatggaattatcatgtcccacactgtaccccggcacctccctcgattaaggtgatttgcatcatgcagggcctgcctgttatcagagagtctcctggacatacagaaataggaatgtacagggactgcatacacctgttgctcaatttctagctaaatggctggaggtgggggataaagaaatggcattcatacggtgtaatactagccatgtttcagaaagttttcaaaaaatgtttagtggagaaatgtgcagggtcagtggaagaaaacctgtaaaattatattatgattgttttatactctatacggacaagcctaaattggagggcattttggaaaactcgcttggatacatgaaaactgccaagatcattataaagaaacaacaggatccattctagattgaaagcaacttgaaatgagacagtagagtgtaatgcgtgtttagtttgtgcttgaataaaagacgaaaactacgtaagacattgggacaactggagaaattagcatatgggctggggattgggtacaggcttcaatgtcgttacttgggtgagttgaagaatgtacgtgttcttaggggacatctgcttaaggatatacaaggttcaggggggaaaaatatctccaaacgatatacttttatatctatgtgtgtacatgtgtgcgcgtagagaaagaaaaaagtacatacgctgtatatttcaaagaacatataaaaccatggatgtcaatatacttcccttccggtgcgctgcctgcgcagaaccgagaggttctgacgatccgcagctcccacgctccccttccggccccgcagcgctgtgaactccatttcccagaaggccttgtatcccgtgcatggccgtttccaggcaggaaggcgaagggccttctgggaggtgaggtcctgggcggccgctggccaccaggcggaagtgcgtaccggaagtgccggcggcagtgtgtaagacgctcacgggcgcgcggactatcgggcggctaggctctctgaggaggctgccacagtggtgagtggtgtgtggaggagaggcgagggtgattgtgagggatggagaggcgcccgtggcctaagtgtgctgatggtgggagtgaatgagtggacgggtgggacctgtgaggggaacgcgaccccgggtcggcgcgggcagagaggcgcgcggtgcgtgagggcgcgacctgccatgtcctgccgggtgtcaccgcttatgcgcccgtgggaggggagcattctgtgttggaggcagaaggaatgagggtcgtgaccaactcattataccactggaggctctatgagcaaaccgcaaactgttctcatgaaagcaggatgttggtaaactgacaaactgcgtctgccgccagaaggaatgctgggggcagtcatgtcccaggtcccctgctccttgaggttatctacaggaacatctggaacctgctgaacaaagaaagcagtcatgtgggcctgtgttaaatcaaatagctgaccgtcagttaccctttcctccctattcagtctacctaacaaatatgaagggctgtaaaagctcagggccctgttccctagaatctaggagccccctgaccccttctttcaaacagatccttttgtctttgtcttcatttctgccttcgttctccttcgtttggtccagaagcaaccgtgacaagtggtgcccgaccagggacctgaacgaggaaggtctgccagagcagagaaagtgaaactgatcagacgaactacgaacccctggacgggagagtctgccggcggagaatataaggtcagttccctgagaaggtatcgggagcgggaggtttctgaatcagggtaacatggggcagaatctgtctgttgaggagcaacattatgtgcagctgcttaaagttttacttaaacaatctggtgctcgggttagttctcaaacattaagcttctgcaggaggttattacacataacccatggtttctgcagacaggtactcttgctgtggaaaattgagactgagtaggagaaagattgaaacgagctcatcagaaagttcttaaagtggatccttctattttctctgcttggggtttggtctgtactgtcctcctgccattgtcctcttcttattctgccagacagcaggtgctatgttctgaatctcaaaaattgaaagaatcttttgtctcaccagcagcgcccattgaaaatgataaacaggagagggaggatgagaactggcctgtactgtcccctccagtagcagaaatagagaccccagtacaaaaaattctacatgctgtggccatagctggcgagccactaggaccttgcacttttcctattaccttaaggcctgatccaaataatccacagcagtttattcatgaacacactccagtaaaatttaaattattgaaagaattaaaagctagtgtggttaataatggaatacagagcccatttactttaggattgttagaatctgtattcagcactatgcgcctcccacccttggatataaagcatttagcttgcacttgtttctctgctagtgcatatttgacatggaatttaaattggcaagaaatgtgtgcagaccaggctagacagaatctcaccgctggacatgggaacattacagaggaaatgctattgggtagtgactcttattcagatctggtgcaacaattgacacttccagatgctgcttaccatcagtgcgcctggccgctaagcgtgcctgggccaccattcctgagaaaggggtctcaataaaatcttttccgcatatcatgcaaaaatcacaggagccctttgcacaatttattgcacagttacaacagtcagtgaggcatcagattcctcatactgctcctgcgaaaatgcttactttgaccctagcttttgaaaatgcaaatgcagattgtaaatgtgcattagcacccgtgagatgtacaaacagcttgggaaattttctcaaagcctgtcaggatgtgggaactgaactccatcgttcaactgtgttagctcaagtaatagctaatttagtagtgaacaaatctgaaaagggccaagggttgagccctaaagtgggaaaatgttataattgtggaaaaattggacatttcaaaaaagaataccatcagacctctgggcagaagggatcttacaatgcaataccgcccccccctccccgccccgctccccccaacacacacacacagaaaaaaaaacaccaggactttgccctcgccgtaataaaggaaatcattgggctaatcagtgttgctcaaaatttcatcagaatggcaccccgctctcaggaaatgagaatggggcctgggcccctcaaacaatgagggcattccccatccaggccacaaccctgctacaggggtgggttcctggaggaacattgactccctctcctctggaacaccggggagtgcaggattagatcgctcagtcagagaatgggtcacgttagttggaggagacaaacccaccagaattcccacaggcatttgggaacctttgccaacaggatatacaggattaattttaggccaaagccatctgaacttacagggcattactgtgatccctggattgttgactctgattatgaaggagaaattcaagtaattgtaatgtcacaagatctttgggtttttaaacctgggaaatatattgctcagctattgcttattattattctctgcaaattacacccttcttcacgaaaggagaaaagaggaaatcaagaatttgggagtacaactacacaggaaatttacctatcccaacccatagcttctaattgacccacctgtgcagtgcaaattaaaggaaagaagtgttgtgggtgtatggacacaggagcagatgtttcagtaatatccaaaaacaattggcccctgctactaacctctgcatccttagtgggagtaggaacagctcaaagtgtttaacagagtgctgaaattttactttgtgtcagtccagatggacagccatgtacttttcaaccttatgttgcaaatatacgtgttaatctctggggctgagatttacttacagcatgggatgtgagacttacaaatgaaaaggttgataatccaggatttaaaatattgaaggaaatgggatatcagagtgggaaaggcttgggaaagttcctacagggaaaccccggtccggtatcggtaactgggcaaacagataggaaagggctaggtcatcaggatttctgataggggtcattgatacttcttctccacccactgccttgctgctagagtggctgactgataaacctgtgtgggtggatcaatggcccctatcacaggagaaaactgactcaactccatcagctggtaagaaagcaattggatgcaggacatataaaagtatcagttagtgcttggaattcaccagtatttgtgacccccaaaacgtcaggaaaatggcaactgctgcataatttgagagctgttaatgcacaaattaaaccagtgggtgcattacagcaaggtctgccatccccggcaaccattccaagagattagcctcttgtagtaatagatcttaaagactgttttttcactataccattacacaagaaggacaagcctcaattcgccttctctgtgccttctattaatcagagagagcctgtctcttgtgatcaatgaaaagttttattaccccaggcatgctcaacagtcctacgttatgtcagcattttgtaggaaaagcattgaaggagcctcggaatatgttttccaccacctacatcattcattatatggataatattgttttggccactcctacagatcaagtattataccagttattcagagaaataaaatgggctttaactaaatggaatctcaaaatagctcctgaaaaggtacaaacaacctcctcataccaatacttagatactactgttactgaaaaaagtattcagcctcagaaagtagctcttcgtaagaacaaattacaaactctgaataacttaggggatattaattggctgcgcccaatgctaggtattgcttcttatcaactcactcatgtttatcaaaccctccaaggagattcttcattagattcccctcggcaacttactaaggaggcagaagctgaattacagcttgtagaaagatgcttcagcaacgacatgcctcctggctacaaccacaaaagtctttggttttgtttattcttcctaccccccattctccatcaggacttttagctcaattcatagacaaaactataatggtaatagaatggctttttttatccagtcaaacagtaaaatctttgcaagtttatcttgctttagtcacacaacttataacaataggcaggcatagatcaaaaatgcttacaggatatgatcctgataaaattattgttaccttggattcccaacaacaggctgcggcctgggagatgtccactgcatggcaaatcactttcgcagattttgtagaaataatagataaccattatccatcagacaaaattttgcagttttataaaattcacccttttattccccctgtgattgctcatcacaaacccatttcaggtggacagacctattttaccgatggctcttccaaaagccacacagccatttatggacctaaatatacttaaataataaagacccctagagtttcagctcaacactctgaattaatggcagttattcaagttttaaagctcacagctttatttcctattaatattgtctgtaattcagcctatgtcgtaaatgtagctagttgcattaaaactgccactatcaagagtgtacggaccagccccacagggtcggtgggtctctccctgtgtgcggcgacgagagagtgtagaaataaagacacaagacaaagagataaaaggcagctgggcctgggggaccactaccaccaatgcgcggagaccggtagtggccccgaatgtctggctgcgctcttatttattggatacaaagcaaaaggggcagggtaaagagtgtgagtcatctccaatgataggtaaggtcacgtgggtcatgtgtccactggtcagggggcccttccctgcctggcagccgaggcagagagggagaggagacagagagaaagacagcttacgccattatttctgcatatcagggactattagtactttcactaatttactactgctatctagaaggcagagccaggtgtacaggatggaacatgaaggcggactaggagcgtgaccactgaagcacagaatcacagggagacggttaggcctccggataactgtgggcgagcctgactaatgtcaggccctccacaagaggtggaggagcagagtcttctctaacctcccccagggaaagggagaccgccccccaccctttcccggtctgctaagtagcgggtgttgttccttgacacttttcgctaccgctagaccacggtcttcccaaacgctggcgtcaccactagaccaaggagccctctggtggccctgtctgggcataacagaaggctcgcactcttgtcttctggtcacacctcactatgtcccctcagctcctatctctgtatggcctggtttttcctaggctatgattatagagcaaggattattgtaatattggaataaaaagtaattgctacaaactaatgattaatgatattcatatataatcatatctaagatctatatctggtataactattcttgttttatattttattatactggaacagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatttgcccatatgggggtccctaaacaatttaaaactgacagtggactcgcttatgttagtcatgctttcccaattttttacaattgtgggcaatcaatcataaaacaggaattccatacaatccctgagggccaggcattattgagcgggtacatcaaacactacaacgcatgctgaaaaaacaaaaagggagaataggggaccaattaccacttcaaacaaaattacatttagccttgtttactttaaattgtttgactcctggtacggatggcaagaccccagcagaacgacactggcaactgctagaggaaaagaggcaagtttatccaaaagtgttatggaaatccccagaagaaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatggggacagatcaagaaaacgacacaagaagctgagaaactactggagcgccagggtcaggcaaaaacccctgactccatgttcttggccatgctagctgtagtgtcctgtgcggtatgtttcccctgtgtagaggcaaaaacatattgggcatatgttcctaacccactggtagtacgactggtactctggagcgacactcctcctgagatatattatgatcagggagcgtgggcaccaggacccctaactccgtctgacacagagcaatagcatcaattacaccggcccattggaaggactccctttatgtatcaccatggatacgtcactcaactgcagctgtcttgcagtccaatctcaggcatggttaagtcaccatggaaaaattatgtatttattaggcctcagctttattaatgttactggcgtgttcaccaatcactcctagccccatcactcaaattgtatggattatatggaatgggctccctttgatatttctcacccccctccttggacccagtgtcttggccccttggccagacaacagtctatgttaatgggaaacattgactggggtccccgtggccatttagaggggagagatgaaaatcagacctcttggcacaaacttcactggcactggtggtggaccttcaacacctcttcatcacatcacactgggattcagtcccccagttggctgcacaacttgcttggtataggacaggctttaacccgcccttacctcagtgacgtcatctaggaaacagaggcccaattcaggaatcgatatggaaggcaacactcccatttatgaataacagcatctgggtcagaacattatccaacaatagtaatattactcaacacagttttaatatcacctttgtaaaaaatattaccactcaatttacggtttgtgggttttttgttgttgttgttaactgtttgagatggagtctcactctgtcgcccaggctggagtgcagtggcgcaatctcgggtcactgcaacctttgcctcccgggttcaagcaattgtctgcctcagcctcccgagtagctgggattacaggcacccgccaccgtgccaggctattttttgttttttgtatttttaatagaaacgggatttcaccttcttggccaggctgctcttgaattcctgacctcgtgatccacccgccttggcttcccaaagtgctgggattacaggcgtgagccaccatgcccggccagtttgtgtttttaatccctatgtttttctagcatctaagaaggaccaactccacgtaaacatcacccagttgacttgtgactcttgtcaactgtatcactgcctcaatcatagcacaatacaaacacacaacatatccactctaataattctgggtcgtatccctggattatggatccctgtcaatttgtgcaaaccttgggctgccacccctgctttacattttgtaaaactccttcttacccagctcactcatcgtgcacgtaaagccttaaacatagtaatttttactgtaatctccttagtcacactaataacctcggttgtagtgtcctcagtagcactacatagttctattcaaacagcccaatatgtagaaaattggacatgtacagccaaccaggcatggatgcttcaaaataaaattaataccgaattacaaacaaaggtagcaatgttaaaggctactgttctgtggctgggaaagcaggtacaaagtttgcaattgtagcagcaattgcactgtcatttcaatcatattcatatttgtgtgaccaatttggaatagaaccaaagtgaatatccatggaaccttgtaaaagctcatttgcagggagcttttacatccaatattacttttgatatcagtaacttacagagtaaaattcttaacttgaataagcaaactcaaaaataacagccctttttagaagcttaaacagaattccagcagggcttagaaagcctcaaccctggccgggtgcggtggctcacgcctataatcccagcactttgggaggccgaggcaggcagatcacgaggtcagaagatcgagaccatcctggctaaaacagtgaaaccccatctctactaaaaatacaaaaaaattagctgggtgtggtggcgggcacctgtagtcccagctaatcaggaggctgaggtgggagaatgacgtgaacccgggaggcagagcttgcagtgagccaagatggcgccactgcactccagcctgggtgacagagcgagactccatctcaaaaaaaaaaaaaaaaaaaaaaaagcctcaacccttggacctaccttaaacataacttcaatgtctcttttataataattacaagaataatgttgttatgtctctgtttttttgctcatagtctataggatcgggtgaaccaccaaccggcaattgaaagctgcacagcctgaaattacctttattcaattaatgcaaaaacaaaaggggagatgttggaggccgaaggaatgagggtcgtgaccaactcagtataccactggaggctctgtgagcaaacagcaaactgttctcatgaaagcaggatgttggcgaactgacaaactctgtctgccgccagaaggaatgctgggggcagtcatgtcccaggtcccgtgctccttgaggttatccacaggaacatccagaacctgttgaacaaagaaaggaatcatgtgggcctgtgttaaatcaaatagctgaccgacagttatcccttcctccctattcactctacctaataaatatgaagggctgtaaaagctcaggtccctgttccctaatatcaaggagccccctgaccccttctttcaaacagatccttttgtctgtctcatttctgcattcgtcgtccttcgttcggtccagaagcaaccgcgacagtcctgcatgtgttgatgccacctgtatgtgcaggtgtgacctcaggtgtgtgagtatccctcataccccttatcatcactgcctattcgctcttcctccagcctctggcaaccactaatccacgttatatgtctagatttgcctcttctggacacttcatataaatggagtcatacaatatgtggtttcttgtgtctggctttttaccactgaacgttttcagagttcatccatgttgtagcatgtatcagtttttcattcctctttatggctgaataatactgcattgtatggatataccacagtttgtttactcattagttcatagacattggggttgtttccaactctctgatattataaatgctactgctgtgaaaattcatgtacaggtgtttgtgtggatgtatatttttaatttgggaaggggaggccatgggtgggacctaggcttgtgaagagcctggcctgggtgtatctgtttgtccgaggagtgcctgtatgcatggccatgaccacacccactccttgctgcctgtgctcattagccatacttcattttccagaatcccaggcctgggcccctgaagtcaaagccaggagcctagagccacactgatgtgtaggatcaaagagaaggcggcagtggccctggaaacaaacctgtctctgcaagagtcactagcaacctgggacctctgcccaggactgagacctcgggtgccccctaccctgtagctgctgaggccaagcaatgtggagacagagagagggtgaggtgatggagcctgaggtgccgagtgaggtagatggtggggtggcagtcacagtggcacaggaggcaggtacagggctagatgttttcagaaaccagatatccctctaaaacacaccctgcttctgctgccttcattccactgccctgccttcctcagcctgctctacaccactacctcctcatggttctcctgcctcccgttgcccccttcatcactctccactcagcattgggtagagagggtcttttacccctgactgatgaggccacccctctctttaaaccctccatcactgcccaggccatcagagtatggttggcaaactcttctgtaaaacacaagcagcaggctgggcgcagtggctcatgcctgtaatcccagcattttgggaggctgaggcaggcctgaggttgggcctatgagaccagcctggccaacatggtgaaaccctgtctctactaaaaatacaaaaaattagctgggcgtggtgatgcatgcctgtaatcccagctactcgggaggctgaggcaggtgaatcgcttgttcccaggacatagagattgtggtgagccaagatcgtgcctttgcactccagcctgggcaacgagcgaaactctgtctcaaaaaccaaacaaaaaacacacaagcagcaaatgtcagctttgtaggctcagagagaaaaccaagaatgttacaaaggtacctatctaacaagagaaaaacatgtccatacattttattaataaaatccaaaactttgttaaatgtaattcattccttaatgagcaaaaagcttttcacaggaggttccattttatagataggaaacagaccccaagggaggtgagcagcccagaattacagcagagagtggtgaagatttgatcctagatctgacagcctctaccatcatacttgccattctcagcttaggaataagatggggaggaaggtgtgggtaatgggcaaatcagggcccaaatagtctgttcagtactcttgtctcgtgggaaggaacaaaaggccccacatctgcccttcctcctgggagtctctgttaggacctgaattcagtacagcaggaatgatcaatttttctctttagagcactcacccacttgacatctcactttgttctcacatagtcctcatagaggtatcctgtggctgctgtccttgaagcctgatagcatggagctgaggcctcagactataacagggcacataattttcatgaagttcaagaagaggctgggctgggcgcggtggctcatgcctgtagtcctagcactttgggaggccaaggagggtagatcacctgaggtcaggaattcgagaccagcctggctgacgtggcaaaaccctgtctctactaaaaatacaaaaattatcctggcatggtggcaggtgcctataatcccagctactcgggaggctgaggcaggagaagcgcttgaatccggggggcagagcttccaatgagccaagattgcactatttcaccccagcctggacaaaagaggaaaactacgtcttaaaaaaaaaaaaaaaaaattaggctgggacacctttcctggaagggctacttactacaggggagctgtctaaggtgctgaaatgtcctagccctgcgctgtccaatatggtagttatgattaaattcaaataaaattacaagttccatgtcccagtcacaccagctatgtttccagtactcaggagctacctgacactgatggtgccatattggacagcacaactccagaacttttccatcctcacagaacattctagaatttaatttgaatgctagttacacagggctgtgcatttaccaaattcactaagctgagcacttgtaattctgtaaaacatgtatatgtatttttgaaagcacaaagtttcacgtccccgcctgccagtcactttaccaaacaacctttggtttaacttctctgtgccccagtttcccaacctgtaaaagagagtaatgatacctcccctttgattggttgagagtaccaccaaaggtgtttgctgggtggcctgacctgcaggaggtgctcaggaaaggggagctgctgctgtcatttggtggaagtgggtccccttatctggctagcagatgccttgagttatggtgagtatgatggggacagactcccaggaggatggaatggcatcactctgtggaaagactgtgaaacagaacacgaacacctcatggcatctttgctgcctagagccatgccacttgcacaccctccttctgctcctgactcccaggaaggcaagggggtcactgggcttggggctccacagaaagaggcttcctgatttgatgcttaagagctgtgcctcagacgcctgcctctaaaacagaaagccgtccacacagacaccccacctcatctgggtacctcctctggacctaggctgggtccccacaggcagccacagccatctatgctgctgcccccacactgcctctggctgtgggcttctcgagggcttgctgtgtgatgctgagttccttaacgtggagacaatgtgttggagtgtggcagtgttcaggccctgctagccaaataaggggacccacttccaccaaatgacagcagcagctcccctttcctgagcacctcctgcaggtcaggctgctcagcaaacacctttgatggtactctcaaccaatcaaaggggagctatcatcattaccctcttttacaggttgggaaactggggcacagaaaagttaaaccaaaggttgtttggtaagtgactggcaggcagagatgtgaaactttgtgctttcaaaaatacatgtatattttttacagacgtacatgtgctcagcttagtgaggaaactaggaaacaggcccagagctgggatatggtcagtcagtggcatgaagagccgagagtggagcctggcaggaatttccagctggcatccatttgttactgaatatcagggcactcccccagagacacaagccacccctaaccacattctggaaaacgatctcacgtgtgtttccgtcctagatcgggggtgctcctgccaaggagagggtgtatgtggggaggcctgcagctgtttcccagaccttaatcagccacaaggagtccacgctggggagggtgtactgccatgtagtgggtgggaagatacctttggcaagaacacgtgccttgtgagctatcagcagattcccaacaaaaggagaccctgtacgtgcgaagagtgtggcaaggcctttggacagagaagtcaccttgttcagcacaccagtgagaagctgtatgcatgccaggaatgtgggtgtaccttcagcaacaattcatctctagtcaagcactggcacgtccacacaggcgagaagccctacatgtgtggccactgtggcaagtgcttccgagagagctcatcccttgccaagcaccagcgtgtgcacacaggtgagaagccatacgtgtgtggtgagtgtggacgcaccttcagcgagagcacacaccttgtacagcactggtgattccacaccggggaaaagccatttgcctgccaagagcagcaaagcctttgctgacttctcggccctccttgcatgccacggaacctacacgggtgagaggccctacgagtgccgggtatgctgcaaggcattcagccccagcttgtccctggctgagcacatacgctgccacacgggagagaagctgtatgcgtgtcaggaatgtgggaaagctttcagccacagctcatccctcagcaagcaccagcaggtacacacaggtgagtggccctatgtgtgtgcagaatgtggaaaggccttcagccaggggtcctacctgacccagcacctcaagatccacagcggtgagaagccgtacatacgtggtgagtaaaggaagccattcggtgactcctcagccctggtcctacaccagcgggtgcacacaggcgagcatccttatgcatgtggaaaatgtgggaagactttcagccacagcaagtttctcacccagcatgagcaagtccgcatgggagagaagcccttcatgtgtggtgactgtggaagagccttcatgcaaacctcatccctcgccctccatcagaggactcacaatggggagaagccctacaagtggaatgagtgtggcaagtcctgcatccagatgtcacacctcaccgagtattaccaggtacacgctggggaacgaccctttcagccgtggcacacacctcacgcagcaccagcatgtgcatgcatgtaccaagccattcatatgccatatatgtcagaaaaccttccaggaggccacaactcttgtactacatgagaggattccctggagagaagcccttttgagtgttgtgagtgtggcaaagccttccgccaaagcagattcctggcccagcaccagagaattcattcccagggaaaaccatgtgaatacatggatatcagaaagccctcagtgacgctttggttcttgtatgtcagtgaactgggcatgtgccaaatatggcagagatcttcccatctatccttggtgtgttgtcctttgcaccggggtggcaggtgaagagggactgtgagtgtgaggaaatcagggtcagtgtgagaagcccctattatacatttctcccttcagggtcaccggggcgggtgaggaagctgggagtgggcctaggatatgtctttcagatgtcacatggagatacttctccataattatcaaggggcacaatggccacttccactttaattagattcccatggatgctaaccaagtggtaggaggtacacaggtatgaacaggtttcctctcagcagtcctagaagactttatttcagtttttgccaagacaaaaatgaaatttaaaaaatgtgggtttttttgttttttgtttttttgtttttttgagacggagtcttgctttgtcgcccaggctagagtgcagtggcgcaatctcggctcactgccaacctccgcctcctgggttcaagtgattctcctgcctcatcctcccgagtagctgggattacaggcccccgccaccaaacccagctttttgtatttttagtagagatggggtttcaccatcttggccaggctgatcttgaactcctgacctcgtgatccacccacctcggcctcccaaagtgttgggattacaggcatgagccactgcgcccgcccaaaaaaatacatatttttaaaagatgcttttgcagttgtttgtgccttgtattaaggtagaccatatagtttggggttttattgcccagaaccaaaaaggtaaaatttatatgctgaagtgtgtgtcacagagtctagctctttaagaagaaaattttgtgtgttcctcagcttcagcatgaggacgtcactaaaactagttgagacagtgatgatgttcgttaagattttactgagcactttagaagcactttaagtagattgtcccattccatcctcttagccggcctgggatgtatttttattcccacttcatacatcagggagctgagactttgagaggttaaatcacttgcccagtgcccctagctaaaaggcactcacttttcaggacgaaaatacttgagttaatggataaggccaaggtggcagaagtatttccttcccttttaccaatgcccagaggtatttactggaattctagaactgaggaggcagttctagaatataaagtcctattgagcatgggagacaatggaatgattgggttccacctgaagaagcaagttgacccatttagctgacttgaggcaaacgcaaagtagtaactgggagccactgctcaatccagatgttgattaaatgcttcctgggagccctgcatgtgttcccactctcccctgtaacattgctcaggggttctctggctgtcaggctgagatctagcctctagctggcctctatgcgggggtccccaagatcctcaggtgtgaagattcactagaggaacatagaaaactgatatacttaacatttacggtttatagtcaaaggatacagattaaaatcacaaagataaaagatgcgtagggcagcaaccagaagagaggaggtacagctgttgtagagactgctgaattctcccagcgctgagtgacaatatagagtagcatcaaccaaggaagctcacccaagccttggtgttcaggacatttactaggtgatgatctagtgggcatggagtgcccacctgactgactttagtcacttagtctcccacccctctagtggtcagactgttacagtgtggcctaagatcctcaccataaatcacattgttgacaaatacttggcatggcccaaggtcctcaggtaaacaaagatactcttaggcagcatgatcaccacatgccttgaactgaaagaaaccagggtcacaaatgattttgttggctttctacatggaaggaaaagaaaccaaaagtattattgtagtggattgaattactagctcaattcttcactgctccttgcatatatacacccacggccatatttatggttcttcccagtaaaggcaaatttgatgtccccacccattccttgagtttgggtgtggccatgtgacttgatttggccaacagaatctaagtggaagtgatagcatgctagtcctgagtccaggcctaaagcccattgtgtctctgccatcaggatgagaagaatttttcctgtgagccttgcaagacaaatacagcagacctggacccaaactgcagcctagagccaagcccagctgagcccagcccagatcagccaaccctcagacacatgacaaaaataagcactttttttgctgtgggccacagaggtgtcgtagctgtttgttacagagcaatagctgatacaattgccaaattaaagtgaatactccctgaaaaagataaggtttgaaatctggggagaggataagaaagagacaaagggagagaggaaaggaggagcatccactcaggagagtccagaggccagaatgctgattgaacagagcacaagcacaaaaggggtggccaagggaaagggccttccaaggtctgcagtattgactacaggtgccatggtgggtgcaggagatgaatgaggagaatccagctatgcagctccaggcaagggaacattgttggtctgccagtcattcagtcattcctcagccaactcttagtacctagccctgtacaaggcatcaaggataccctggcctcggctatgtaaagggcaggacccctctcaggcctaacagcacagactcacaatctaggcagaaaaggagccaatgaggagagattccattggctttccaagtcaccctatacccattaaatgtcaaccagggctcttcttcctctccctgacaccagagtcccctccagctgctgccctatctcgctcgtttcctccttagaatctccctgaaaaggggtctaaggatccccacactgatgccactgtccattcacccgttatggactgaattgtgtccccccaaaattcatatattgaagtcctaacccccagtatacctcagaatatgactgtatttgaagataagacctttaaataagtaattaaggttaaagaagatatggatgggtcctaatccaacatgactggtgtccttataaggagagagagacagtaggggcatgtgcaaacagaggaaatgccatgtgaggacacagtgagaaggcagccatctacaagccaaggagagaggcctcaagagaaaccaaacctgttgacaccttgatctggggacttccagcctccagatctgtcagaaaataaaaaaaatttttttttttttgagatggaatctcgctctgtcgcccaggctggagtgcagtggcgtgatctcggatctctgcaaactccacctcccgggttcacgccattctcctgcctcagcctccctagtagctgggattacaggcacctgccaccacgcccggctgattttattttatttatttattatttattttgtatttttagtagagacggggtttcaccttgttagccaggatggtctcgatctcctgacctcatgatccgcccacctcagcctcccaaagtgctgggattacaggcatgaaccaccgtgcctggcccagaaaataaactttaaactatcgtttaagccaccaaatctgtggtattttgttatggcagtcctagcaaactaatacaccctcctcccacccataatcagagggcactatcaggcacctgggtcagccttgctcaccccttggacactgtagttcaacccatcaaccctatcatctataccaaacttgtccaacccacagcccacgggctgtatgtggcccaggacagctttgaatgcagcccaacacaaattcataaactttcttaaaacattatgagattttttttgcgatttttaataaactcatccgccatcattagtatattttatgtgtggcccaagacaattcttctaatgtggcccagggaagccaaaagagtggacacccctgatacaccttcaaaacagatccagatctgaccacctgttagcatctctaccacaccaccgtttgaccaccctgatctgagctacctgcctcaggtgccagtactctcaaagcaattgcatctttggtctccctgactccactctcatcttgacagtcttctcctgcagcggccagagaattcctatgaagagctaagtcacagcacagccctcctctgctcaaaggcctcccatagctcccacttctctcaaggtggaaatcaaagtctgtatgtgagccaagtgtggtggctcacgcctgtaatcccagcactttgacaggctgaggcaggaggattgcttgaggccaggagttcaaaagcagcctaggcaacacagtgagacattgtctctacaaaaaataaataaacaaagtcgtatgtggctcacaagcccttcaagatctgcccccacaggcctcccttttctgtccttgtcccctcccatctccttcccttaatccaccccagccagtcttcctcatccatgcctcctcctgacgtgggcatttgtgttccatctaccttgaacttactctccctgagttcttcgctctattcaggcctcagcttaaataccaacttctcagaaaaatgacttctttgtttaccatctgcctccccacacaataacatcacctccataaaggcaggccatgcttatcatcattgcagtatccaatctgcagtggtgctggctgcctgttgtgggtgctcagtatttatctgtggaaggaaaagaatatatgctcattccagctgctagcagtctgcagggcaaagtctgagaataataggggatgtgagcacaggctggggccaagaaacaccaccagcaccaccaagcaatcatacacaccctgcctcaaaaaggcctcacctgaacataggctgggccaccaacctctatgtatcgggccccaagccagagtctcctgctcaatgtctcttacacatacacacacacacagagaagatacattctcacacacagtccaggcatcgactgaatcacacaatcacactaccattcacagtcaccgtaacaacatcacacacagtctagggcctttatactgtgtcaggtccaccccattacctctaagtatctgtctcagacacaattacacctggtgcaggcaaacacagctgcatgattatcacatatgatgattaaatcacaggtcacacacacgcagagtaagcacacagaacaacccacaaacctggtcacagagtgactcatgcagacagacgcccagctcaaattcagtaaaaaatgatacacatttataaaaatgattacatgtgttcacagagagccacacatagctacactcaatacacaccctgacataggcaaccacaccgctcacctctcacaaaggcaccttcagtacttacacagacactcacacccacaagccctcagacaggcaccctctcccctcactcctaacatgggcaccctcacctctcacccaggtacccttgttactggtggagggtgtccaggttcttggcatcttgaacaaataattggacaaaatgcacaaagaaaagaatgaagcaacaaaagcagagatgtattgaaaatgaaagtacactccactgtatgggagcaggccggagcataggggctcaagagcccggttacagaattttctggggtttaaataccctctagaggtttccattggttacttggtatatgccctatgtaaatgaagaggacgaagtaaagttacaaagtgatttactccatgtacgccctgcataaatggagaggatatttcctaccatagctgcagtttccatttgatttacttctaggaagtccttaggttccctgcctccagacccgattttcttgcctcacccttacccctcacccctcacacaaacaccctcagccctcccaaagccaccctcagcctcacacagccgccctcaccctcagcctcacacaggcaccctcagctctcacacaggcaccctcagccctcacacagccgccctcaccctcagcctcacacaggcaccctcagcctcacacaggcaccctcagctctcacacaggcaccctcagccctcagccctcacacagccgccctcaccctcaccctcacacaggcaccctcagcctcacacaggcactctcaccctcagccttcacatttccctcacctccaagtcccgcctttcgcgcatcgcctgctgctctcccactcagcgccacctcagtcccacaaaggccgggctgggatcctgtggcctccgtgctgaccaacgtcaactacaattcccagcaggcaccgcgcctgggtacacttgagcttccggaggacgccgggaattgtagtcctggcgggcgtgggcccttgaggtgtgctgggagctgtggtccgggtcggcgggcgcgcaagttggctagtctctgcggccacctccggaagggtccgccggctgtgctggtgaggtgggtttcgggggtgttctccgtcctgatccaggctggagaggggcacagcaggtccagaagccgcgaacctctggggcggccagagcgagatgcggggtaccgcccagcgggtagagagtgagaggctgactaggggacgtgagtagacggactgcgagtgccggacacacgcgcagaggatgtgacggactgacggaccaggcgtggacggaccgtgtgtgcacggactgacggacccggtgtggacagactcacggaccgaatgtggtgcggaatgacacactgagtgccggacggaccgacggagaatgtgtcggactgacggagtgtgtgtcggatggactgattgaccgggtgtggggcggacgaagtgtggagcgggcggacagataacagataaaatgtaggaccagtggcctgggagggtgtggggcggacccgtttatgtgtctgataggcggttctgtgtctgacacctcttgggtgtgtgtatctgacgggttggagtgtgtgattctgataggttgagtgtaacactaaccatggagtgtgtgactgacagagatggttgccgtttgagacttcctacgtgggttgtgagatactgtgagagggtgagcgtgtgacggtgggatttcaagtgtgactgattttctttgtgtgtccttgagatggtgactaagattatgaatgactgtgatcagaataatactgtgtgatggaaatgctgcgagggcctgtgtttatttttgagacggagtcttgctctgttgcccaggctggagtgcagtggcgcaatctcggctcactgcaacctccatctcccgggttcaagcgattatcctgcgtcagcctcccgagtagctgggattacaggcaccggccaccacacttggctaatttttgtatttttggtagagacgggctttcaccatgttggttaggctggcccggaactcctgacctcaggtgatccacctgcctaggcctcccaaagtgctgggattataggcatgagccaccatgcctggccaggcctgtgtttatttgactgattataggtgacattgagatatttcctgtgtctgggtattttgaaggctgtggctgacagactgtacctgagataatatgtgttaatatctgattgactgagatttttatcagggagactaaaacttgggtgatccacaaacagtttaccaagcatatgagagaggatttgtgctttgccatgtctgcagctgaaactgagtgactagtggtcattcagctgggcttatggatatgtcccccagtgtttgcttacgtgtagcagggggctatggtatccatacatctactgcatgtttactgtgcaccaggcctgtgctggacacttataataaatcacctcacataatctcatagcaaccctctgaggtaggtaccattatcaggcttggtataatccatgtgtgagaaatgaaaagaaccaccctccttggttggtaaagcagctgtggatggggaacctcaacctgataggagttgaggttggctgaggaggctgaggaagtttcacatacatgtatttcagagaccgtcatgagggatttctccagaacaggtgttccaggggtgcaaaagagaacttggaagctgttgcagcatctattgtcatccctgccacccttgctcctccttcccctcatgattccctacattcttgggtaaccatgctcagcctttactggtcattccatttgcttaatgcctgcttattgtgaacctgctatagggcaagtcctgtgtgctgtggctccaggacagcccagcctctctgaggaaacagtacagaactagcaaagagttacccagggcactctgggaagaggacttagactagtaccaggtatctgggatgacacctgaggaaagtggcagctaagatgaggcctagagagcccagaggaatccgtcagagacggatttcagaactcgagagcagcaggggcgacaaggggcttagaaaggccacaagagacccaggagaactttacagtgcggcgaaggggcttaaacgcagcttggccagaggccaccagaggtcaccagcggtcaccaaaaggtttcaggattggggtcttgttttagagtaacgttctcttcttcctgtgcccaaggccattgctctttctcaggcctcctgcatctctgtccagggtgacttccttgagcagagactccaggcacactgagcgtcctggctgacattgaaggaaaggaaaaagaactccaaatacttaaaactgtgggagtcgtggatgggagagggagaggctaagtctttgagtaaggagtagtatgtggccaaagcaaagtgtcgaggtctcctaggagaggttacacttaatttagggtattcttcctgactataagagaaaacaaattcactgtgggaagtagagaatgtcaagaaaagtaatacagtagtcacccctcatcttcagttttggtgaatatagtacaataaaatattttgagagagagagaaagaccacattaatatagcttttattacagtgtattgttataattgttctattttattagtcattgttgttaatttcttactatgcctaacttatgaactttatcaagggtatataataagaaaaaaatatagaatatataaggttcagtaatatccatggtttcaggcatccactggagggtcttggaacacatcccctgcagataagggggaactaccatagtataaaataccttggtaaggatgtagagaaattggaaccctcatccacaactggtgggaatgcaaaatggtatagccaatttgcaaaacagcctggcagtttcttaaaaagttaagcattgcctacatgcggccaggcgcagtggctcatgcctgtaatcccagcaatttgggaggctgaggtgggcggaacatgaggtcaggagatcgagaccatcgtggctaatacggtgaaaccccgtctctactaaaagtacaaaaaaaaatagctgggtgtggtggtgggtgcctgtagtcccagctactcgggaggctgaggcaggagaatggcgtgaacccaggaggcagagcttgcagtgagccaagattgcgccactgcactccagcctgggcgacaaagcaagactccgtctggagaaaaaaagaattttttcaaaaagaaagtattatctccctctgaatgtcggtagcacccccatctagaaatggggctagattctgagaagtagaattaatattgaggcagagagcacagtcattttaaagctcttacaacatactgccaaattgtttgccaaagatattctaattgattgccctcaccaatagtacatgaaagtagttttttgctgtccctgaccagcattcagtgctcacagttctagaatttggaaaggctttgagtgtggaggaaagatcgcagatagcctgagctcaaacactagctttgttcctactgaccagatgactctagcagctgactttccccaacttggaaaatgggagtggtaatactgactcacagggtggagctaaggcttgaatgggataacagatgccaaaggctagtgtggcctggtagccggtaggttcccactgactgtctgttcccattttcttttattcctgttgcacactatacccatatccatcatcataattatcttatcatgtgttggtcgctgtccttccgttgaggccattgagcccagcacccatgccttccccgtatttgcattcctagtacagtgctgggcacagagtaggcacctaatggggctgtgctgaacaaaagtattattattgatgtatgtgcccagcaatgctgtagacactggggataaagcaaagacctaaacaaaaacccctgcccttaatgtgctgatactccaacagggacaagtaaataataaacaagtaaccacatacgtgtatcacacatcaggtggtaaagagcaaataaagcagtgtagaagcacagagacttactgataaggcgtcttttgtgtagaggcctgacttaaataagggagagaacacccaacaattatcaaatgcactttttttttttttttttttgagacagaatctcactctgtcggccaggctggagtgcagtggcacaatctctgctcactgcaacctccacctcccgggttcaagcaattctcctgtctcagcctcccaagtagctgggattacaggcccccgctgccacgcctgtctagttttcatatttttagtagagatggggtttcgccatgctggccaggctggtcttgaattcctgaccttgtgatccacctgcctcagcctcccaaagtgctgggattacaggtgtgagccaccgcgtccagctgacgttattattattattattattattattattattattattattattattttgagatggagtctctgttgccaggctggagtgcagtggcgtgatctcggctcactgcaatctccacctcccgggttcaagagattctcctgcctcagcctcctaagtagctgggactacaggcacacgccaccacgcccagctaatttttttgtatttttaatagagacggggtttaatcatgttggccaggatggtctcgatctcttgaccttgtgatcggcccagcttggcctcccaaagtgttgggattacaggcatgagccaccgtgcctggccaacattatttttttaaaagctgtatttttattttattttattttttgagatggagtttcactcttgttgcccaggctggagtgcaatggcagaatctcggcttactgcagcctccaccttccaggttaaagggtttcttctgcctcagcctcccaagtagctgggattacaggcatgcaccaccacgcccggctgattttgtatttttagtatagatggggtttctccatattggtcaggctggtcttgaactcctgacctcgtgatctactcgcctcggtctcccagagtgctgggattacaggcgtgagccaccgcgcctggcctccagaacatttttatcatccccaaaagaaattcccaaacctattagcaaccactctcatttttgtctctcttcagcctctgacaaacactaatatgctttttttttttttttttttttttgagatggagtctacctctgtcgccaaggctgtagtgcagtggtgtactctcggctcactgcaacctctgcctcccaagttcaagagattctcctgcctcagcctcctgagtagttgggattacaggtgcctgccaccacacccagctaatttttgtattttttagtagagacggggtttcactgtgttggccaggctggtcttgaactcctgacctcaggtgatctacccacctcggcctcccaaagtgctgggatcacaggtgtgagccaccgtgccctgccgtgtctttcttcttttacttagcatcatgttttcaaggttcatccatgttgtagcattaatcagtacttcatttctgtttatggtgaatagtgttccattataggtatatacagcattttatccattcatcaggtggacatttggattgtttctccttttttgctgttatgagtaatgctgttatgcacatttatgtataaagttttgtgaggacatatactcatttctcttgggtctatacgtaggagtagaattgctaggtcatggggtaactctgtttaagcttttgaggaactcccagactgtacttcccacagtggctatcccatcttacattcccagcagcagcatatgaggattacagtttctccatatccttgcctacacatgttatctgattataggcatcccagcaggtgtgaagtgctatctcattgtggttttcatttgcagttccctggtagctagtgatgttaagcatcttttcatgtatttattgcccatttgtgtatcttccttggagaaatgtctagtcacattctttgctcattttaaaattgtattattcatctttttactatggagttgttctagatacaggtcccttatcaaatatatgatttgcaaatattttctcccactctgtgggctgcttttttactttcttgatgtggtccttcaaatcacaaaagcttttaattttgataaagtccagtttatttattttttcttttgttacttatgcttttggtgtcatagctaagacagctttgcattattttcaagtattcatggaacattaaccaaaattaaccatacactgggtcacaaaccaagtttcagcaaattttaaatgatcgaaatccattgtagcatgttttctgaccacaacagacttaatctagacatcagtaataaaaagacaactagaaaacccccagttgtttggcaatgaagcaggagagttttaaataaataaccaatgggactgggcatggtgactcatgcttgtaatcccagcactctgtggggccgaggcaggcagatcgcttgaggtcaggagttcgagaccagccccgccaacatggcaaaaccccgtctccactaaaaatacaaaaattagcctcacatggtggtgcacacctgtagttccagctacttgggaggctgaggcaggaggattgcttgaacccgggaggcggagttgcagtgagccgagatagcgtcactgccctccagcctgggcgacagagggagactccgtctcaaaaaaataaaataaattttaaaaaataattaatgagtaaggtagaaattgtaacagaaattagaaaatatttttaactaaatgataatgaagatacaacatatcaaacttgtgatgtatagctaaagctgtgtttagagagaaatttatagccttaaatatgtgcattagaaaagaggaaaggcgaaagtcaattatgtatcaatctcaaacactacaaaataattagcaagtaaagtgagagaatgaccatgtggctacctggggaacagagggagaaagacttggctctgttggggaggagcacgccttaaacaggctggctgtaggtttgcgtgggtttgtagcttagctctctgttaacccttcactagctgagggactttgggcaaatattttcctcctgagtgtctgtttttccatccataaaataggtagaaagtcccacctcctgagtttgttgtaagttttttgtttgtttgtttttgttttgagacagagtcttgttctgttgcgcaggctggagtgcagtggcgtagtctcggctcactgcaagctccgcctcccgggttcacgccattctcctgcctcagcctcctgagtagctgggaccacaggtgcccgccaccacgtctggctaatttgttttgtatttttagtagagacggggtttcaccatgttagccaggatggtgtttgttgtaagttttaaatgagtctacatgcaagcagtagtagcttagaacagtgctcagcaccaagtgggtgctgtcctaattatgaggattgtctatgtctttgtgagagtctttcacatctcacgggccacaagcctgtgttttccctgctctgtaggcatgaggcagggcccaggttccatgtgatgctgaagctctgacattcctgcaggcccagttccaaggctccggcatcctgtgtctcactgagcactgctgcccgatggccatccccaagcactccctgagcccagtgccgtgggaagaggacagcttccttcaagtgaaggtggaggaggaagaggaagccagcctctcccagggcggagaatccagccatgaccacattgctcactctgaggctgcacgcctgcgcttccggcacttccgctatgaggaggcatctggtccacacgaggccctggcccacctccgagcgctgtgctgtcagtggctgcagcccgaggcgcactccaaggagcagatactggagctgctggtgctggagcagttcctgggtgcgctgcccccagagatccaagcctgggtgggagcccagagtcccaagagcggagaggaagccgctgtgctggtggaggatctgactcaggtgctggacaagagaggtaaaggggcgccgtgggcagcttcacggcacaccagagatacaccctggacaggaacatgggagcacagggctctggtttggggttgctcatgcacccattctcacatttgtactttaccgtaactctcacacactgttgtagacaggtgtgttttggttgcaggtgaccaaaagcgagctgaaatgggctgaagcaaagaagggtaaggaggcagcagatacggctatatccagaagatctgttgacagcatcagaactctcttcttcctctcttgttctgtttctcagttggttttttctgtgttagcttcattcttattttaggttctctttccaaaggggttaaagatagccaggaaccccaggcttatgtcttaccaatgtagaaaccccggggtaataacaataagaggtccctggtctgagcccccactggcctggttgggatcttatgtttgtgtttggccaaccaaatcccagggactaacagtgagcaactggctgtttctcagaggaaaccagacgagggcctgggtgcctggggtggctgttgggggtgacggaaataccagatgtccctgtgtaccttctctatgcccaccctgggctggcctccaggatttgggtgggtcagacctgccccaggctcagctgggcactgttactcacagagacccacacaaacatcccaacccagggaggtccagtgggatgcagggaagacccagccttgggacaatccagagcagggagtggtggctcgtctcagatgggcttggcctggcctattggcaacagataggaggtgggcataccacacactgggaggaaacgtgcagtgtgcaggaggaatgtggagtctggatacagctgcatcatcaaggctcagtagatccaaccgctgctgctcttcctggccatgtgactcccttgtgcctcagtttactcatgggtaaaatggggattgtaataaaaacgcccaccttagtggtgttgcgagatacaaggcaatacccgtgcagcacctgaaatggtgcctggcacagattaaataaatggtaactgcaactgttaggataatttgttcagctctgggagaaacaggcctctctggaacagaggttggtctatgcccaagcagatgtcacagagacagggagaggaaggagggagtggccccatcctcccacagggttggccaaagctcagagaaagggtaaaatgcagagggaatggtggggtcaaaggcctggcagtgtgatttgcactggtgtattctggtaaaagcaggtggtgtgatgtttctggatagaggaaggaagggggagacagggccaagcagatggctgggggagcaggggagactgcctgtggacctggaggagaacattctggagctgaaatcccaactgggccactagctaactgtgatcctgtaccagttactcaacaccttccctcagctggatttcagtttccccatctgcaacagaatcacagcagtacctccttctgagagcaggtcgaagctgaaatgaggcgatggaagtcacccactgtgcttggggcccagcacgacaagagcctgatagtggttagtggccctggaaggccagcggcacagcatccatggcttacagatggggagactgagtcccagatgagggcaggactgattaaggtggtagacctggggtttgagtccagtttctgcactgctgagccccactgtggacttgagcagtgggtattccacctgtctctgcctcctccctggaatccatccagtagatgtgccagattatgtgtcctttgcacccatgcagggcaggtcagtgcgagcattcctctacctcatgcacactctgatctccaagagcacctccgccacactctgccttcatagtactttacaatgtaggggcttgagaggccagatgggtacctcatgtactcacccccagcagccatattctacctggggttctacttgcagaaattttcaccatcgtgggcttctggatggattccctcattcagccagaattcactgagcacctgtggacacatccaggcctagaggcaaggtgttgagtgtgagggacagaaccgcaacctcacagagatcagagcctgcaggggacacatccaggcctagacgcaaggcgttgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgtcgagtgtgagggacagaactccaaccccacagagatcagagcctgcaggggacacatccaggcctagacgcaaggtgttgagtgtgagggacagaactgcaaccccacagagatcagagcctgcaggggtgcatgtgctcagggtcctgacaaggacagaccctccctctctctctgtctccagatcagttccacatcagggtttctcctcttgactcttgagccaaaattgggagccttgaaagatggcgagtttggtgggaggaggagaaatcagaacccatggtgtagttttggatggtgtgggaggacagccctgcaccctttgtcatccaagacaccaaatgagaaacttccccttggaactggggccagatgttaggaacgggccacatctccccttacaaagtgtgaccggggccctcggcagagtaggggaggcttggtgtggtaggaggagtgacagtgtggttcggactgtttcaggatgggatccaggagccgagcccacagaggcaagctgcaagcagagtgacctgggagagtcagagccatcaaatgtcactgagaccctcatgggaggtgtttcccttggacccgcctttgtcaaggcatgtgaacctgagggcagctcagagaggtctggactatcaggggagatctggacaaagtctgtcacccaacagatccacttcaagaaaacttcagggccttacaaggatgtccccacagaccagcgtggccgtgaatctggtgcctcgaggaacagttctagtgcgtggccaaacctcacctcccaagagaagcctccttcagaagacaaatttgatctggtggatgcttatgggacagagcctccatacacctactcagggaagaggtcctccaagtgtcgcgagtgtaggaagatgttccagagtgcttcggcgctcgaggcacaccagaagacccattctcggaagaccccatatgcctgcagcgagtgtgggaaagccttcagccggagcactcacctcgcccagcaccaggttgtccacacaggggcgaagccccatgagtgtaaggaatgtgggaaggccttcagccgagtcacccacctgactcagcaccaaaggattcatactggagagaaaccctacaaatgtggggaatgtggtaaaaccttcagccgcagcactcacctcacccagcaccagcgggtgcacacgggggagcggccctacgagtgtgacgcgtgtgggaaagccttcagccagagcacgcacctgactcaacaccagcgcatccacaccggggagaagccctacaagtgtgacgcgtgtggccgagccttcagcgactgctcagccctgatccgacatctgagaatccactctggagagaagccatatcagtgtaaggtttgtccgaaggcctttgcacagagctcctccctcattgagcaccagaggatccacacgggagagaagccttataagtgcagcgactgtgggaaggccttcagtcgtagctcagccctgatggttcacttgcggatccacatcacggtgctgcaatgaccggaagtcgcccctgggggcgtagcacagcgtcttctcggaggctcgaggtctaagagaaacgctgagttcctgaagagccacagacagggtgggtgattgatgagttgtcaaaatgataggtgcctgagggcagactcgggctgtctaggaaccactctgcatttgaggaaccctgatgagcacaaggtgattcaggccagctggagaagcttccagaagggccctgcactgctaccctctatttcccactcagggctgtcccagagagaaggcagccgaactgaggatttagactggttctgagggccagggcaaatgaaggcgcatgtctctcagaactcagcgtcccaagacgctctgggcgggccaactgtagcttgttctcatgtggttcttcttgcctgcttttctgctgcttagcccagaacggacacctgccatgcccacctctgtgccttggcacctactatttccactccagactattttgtgcctaactgcaaggctgacttttgagactgcctcttccacgatgccttttctacactctgcctctctcatggtttcctgtcgtaatcagtggtgctgcttgacacctgcccagcatgttcctgtctctccttttccttccacatcccaccagtcaccagcgctattgttttaacctaaagcttatctgtaattcacctccttttccaccactgctaccttatgtgagccctcattgcctcttgcctggattatagccggggtctccttcctgaccacttcctgcctttattctctgcccctgtatcactctccaggggactcttgatattacttagatctgactgtgtcactccaaggtggaaagctctccaacccatcttctacagcacagcttcctgaacagggtataagtatgctgagatgcaggctgctctgggccccgagcaacctctccagttatcctcatatgcatgtatgaatactgtcatttttctgtgcgtgcagtgaaaatggcctcatctcataccatggctccaccttccatacaccagccacacggaactactgtggtccctgaaggagccatacattttcccacttatgtgcctttgtacctgtgcctggaaccctcctcttctttttctttttcttttcttttctttttttttttttgagatggagtctcgctctgtcgcccaggctggagtgcagtggcgcgatctcggctcactgcaagctctgcctcccgggttcatgccattctcctgcctcagcctcccaagtagctgggactacaggcgcctgccaccacgcccagctagtttttttttttttttgtatttttagtagagatggagtttcaccatgttagccaggatggtctcgatctcctgacctcgtgatccacccgcctcggcctcccaaagtgctgggattacaggcgtgagccaccgcacctggccctcctttttcatctaaggtgtttcaaatgttgcccaaagaaacctccctgctctccgggagcagacttcagcttgccctctctgcttccagagcacctcctagatacctctcttacaactcctgccaccttgttttacttatttgctccttgtagagctgccttttccaaggataccataaactcctgagagcaggggccatgtcttactctcagtatctacaacacacaagactcagtaggccctgactgatgtctcttacatgaatgtgactggtgcccccaggaggcagtcaccgtgctgtctctgccccacattgtccttatgtatgtttacatggatgtctccccagcagcttgaaccctggagagcaagaataatctgattttcctgggggccagcacccaaataagcctggcatgcagtggcctcaataaaatgtgactgtattgagtcattttctagggccccagatcccctggtgtcatggacttagtctttgccagcattctgtccatgtgttctctggtcttctctcacaatgctgcatccctgtcccatttttagggtccctgtctatcactggatgctgcagcttctgttcattactgttagtgtatcattcttcatgcctctgtttctgtgatggtctcatcatatgtgaaccatttgacctggcgtattgtgtactagtcaccgtcaccatctctccatatgtatctccctgtatttcgggcccattccctctatgtcaagagtaaatagaggcacagagactgatgagaaacgttcataacatgaaggtaagactcagggagacagagactttgtggaagtatctctgagggagtcccagacacaggcagagagggccacatatcgtgtgccagaggctgagagactgagagggatgacaggcttaggggaaaactcagagaggagagatgcacattcctagtgaaattgcacaggcttccagcatgctggagggaacagaaaaggcatgggcctgaattcaggctgcagagcctgactcctccctgtggctacttttgggacctaagataagtgactttcctgaacctccatgacctcctcatatgtaaaccagggacaggacccaccttgtgtagtgcctgacccaaagcctggccctgcacactgtctctgactcacagcaatcatcagcacctctctttgcctcctacttgctcagtctctgtcacaagaactggatctccatccccttgatgctctgagcatcttcacccatttggtcgttgagacatatctgtccatgtctgtctaaaaggggaggagatgagggagaaaaaagggaatctactcagagcctgtgtgtgctgcccagtctaccaaataatttatatacatctcagtcctcacacaaccatccctgttttatagaggaggaagtggcttagagaatgtaactgaccaaagtcacactgccaggaactggaagcactaggatttgacagcatatccaaatatgtcagcaatttcaataaacatgactgtactcaacaaaccaagtgtaaagacaaattctaacagactgaatttctttttggaccagccatatgttctttagaaaagatacacctaaaacaaggatatgggaagttgagggcaaagggatagaaaaggatatacaaggtaggcatgaaactgaagaaagctgatggagctgcattagtcgcgcaaaacagacattaaggtataaaagcattttaagaatcatggggtcactatgtttttataaaagaaacaatctattaggaagatgtaatagttcaaaaccaggcacataatatgagtcttgtagaacagaatcacagtgagaaactgacgaaaccttaagtgtacttggaagtgctaacacgttctttatgatagaaaacatttgaagaggccgggtgcggtggctcccacctgtaatcccagcactttgggaggccaagacaggcggatcacgaggtcaggagtgcgaggcaagcctgggcaacatagtgaaactgtctacaaaaaatacgaaaattagccagcctgggccgggcacagtggatcacacgtaattccagcactttgggaggccaagacaggcaggtcacgaggtcaggagattgagatcatcctggctaatatggtgtgtaaccccttctctactaaaaatacaaaaaattggccaggcacggtggctcacgcctgtaatcccagcactttgggaggccaaggcaggcggatcacgaggtcaggagttcgagaccagcctgaccagcgtggtgacaccccgtctctactaaaaatacaaaaaattagctggatgtggtggtgtgtacctgtaatcccagctactaaggaggctgaggcaggagaatcgcttgaacccaggaggcggaggttgcggtgagccaagatcacaccattgcgctccagcctgggcaacagagcgagactctgtctcaaaaaaaaaaaaaaaaaaaagccaggcatggcggcacacgcctgtagatccagctaatcaggaggctgaggcaggagaattgcttgaacctgggaggcagaggttgcagtgagccgagattgggtgacttcactccagcctcgacaacagagtgagactctgtctcaaaaaaaaaaaaaaaaaggctgggcacagtggctcacacctgtaatcccagcactttgggacgccgaggtgggtggatcacctgagttcacgagtttgcgaccagcctggccaacatggtgaaaccccgtgtctacaaaaaattagccgggcgtggtggcgggtgcctgtaatcccagctactcaggaggctgaggcaggagaattacttgaacctaggaggcagaggttgcagtgagccgagattgcaccattgcactccagtctgggcaataagagcaaaactccatttcaaaaacaaacaaaaaaaagactcaacccagaattctttttttttttttttttgagatggagtctcgctctgttgcccaggctggagtgcagtggtgtgatctcagctcactgcaagctccgcctcccgtcaacccagaattctatatccagtgcaaacacacttaaagaacgaaggcaaaatacagacatcctcaaatgaaacaaacctaagatatatatttcttgccagcagacttgcctgaaaagaaatgccaaaggaaactcttggtagaagggaaatgataccagagggaaagcgggaactttgggaattaaatgatagtaatagagattgcacaattattttatctttaaaatatggctggaggcggctgggcgcggtggctcacgtctgtaatcccagcactttgggaggctgaggtgggcggatcccaagggcaggagatggagaccatcctggctaacatgttgaaaccccatctctactaaaaatacaaaaaaattagctgggcgtggtggtgggctcctgtaatcccagctacttgggagactgaggcaggagaatggcatgaacctgggaggcagagcttgcagtgagccgagatcacgccactgcactccagcctgggcgacagagcaagactctgtctcaaaaaaaaaaaaaaaaaaagaaaaaaaatgtggctggaggccaggtgcagtgtaatcctagcactttgggaggctgaggtggacagaccacttgagctcaggagtttgagaccaacatggcgaaatactgtctctactaaagatacaaaaaatgaccgggtgcggtggctcacgccagtactttgggaggctgaggcggttgggatcacaaggtcaggagtttgagaccagcctggacagcatggtgaaaccccatctctactaaaaatacaaaaaactagccgggcatgctggtgggtgcctgtagtaccagctactccggaggctgaggcaggagaattgcttgaacctggcaggcggaggttgcagtgagccgagatcacaccactgcactccagcctgggcaacagagtgagattcgggaaaaaaaaaaaaaaagcaaaagcaaacaaacaaaactcaatagtaagaaaacaaacaggccaggcacggtggctcatgcctgtagtcccaacactttggaaggctgaggcaggtggatcacttgaggtcaggagttgaagaccagtgtggccaacatggtgaaaccccctctccactaaatatacaaaaatcagccagtgtggtggcacatgcctgtaatcccagctacacaggaggctgagggagttgaatcgcttgaacctgggcggcggaagttgcagtgagctgaaatcatgccactgcaccccagcctgggcaacagagcatgactctctcaaaaagaaagaaaagagaagaaaaaagaaaagagaagaaaaaagaaaacaacccaatattttaaagtgtgcaaaatatataaacagacatttcatcaaagatgctatatagatggcaactaagcacttggggaaaaaatgcttaacatcatcagacattaaggaaacgcaaggaaaaccactattagatatgtctacatacctattagaatggctaaaataaactttttaaaaaactaagctggggctgggcgtggtggctcacccctgtaatcccagcactttgggaggctgaggcgggtggatcacttgagctcaggagttggagaccagcctggccacccaacaaggtgaaaccccatctctactaaaaacataaaaattagctgggtgtggtggtgggtgcctgtcagcccagctactcaggaggctgaggcacgagaatcacttgaacccaggaggtagaggttgctgtgagccaagatcacgccattgcactccagcctgggcaacaagagcaaaattctgtctcaaaaacaaataaacaagaaaaggttttaaaaattgataaaccactagcaagaaagagagagaggacacatcaggcttgagagaagtgacatcatcatagactgtgcagacattaaaaggcataggcatattaggaactagatattactaaggcagtaaaccagatcactagcaaattcgttgaaaaacacaattcatcaactattggttgataatactgatacgcatcttctgtgtgccagggccttgaggccctgctccaggcagaaactcggcagtggttgggaaggcatcagatgtcagatggcacaagaggactcagagctgagggataatgggaaagaacacagaggaatccagccatttccacagcgtccagctctgctgtgggaggctgggaacagcccagcactaccaccctggactgggaggacaagaccacaaaatgcagcttccctgaacctcctcttggtgatggggttgatgtggtcgaggtagaggtgagtatgtctggagcctcaagcaactgcccatacctgctgggaccaggccgaggtgcccagggagtaagaggcagcatcctggaagagcacagatgaaagaggccctgagaagtgttggttggccaggtgctgtggctcacacctgtaatcccaacactttgggaggctgaggcgggaggatcacttgagcccaagagttcaagaccagcctgggcaacatagtgagactcatctctacaaaaaataaataatagaaagaaaaatgtgagttggccaggcatggtggctcatgcctgtagtcccagctactcaggaggctgaggtgggaggatcacttaaggccaggagttcaagacaagcttgggcaacacagtgagaccctgtctacaaaaaataataattagccagacgtggcgatgcatgcccaggctcccagctacttgggaggctgaggcaggaggatcgcttgagcctgggaggtcaaaactgcagtgagccggactgcaacactgcactccagcctgggtgacagtgtgagaccctgtctcaaaaaagaaaaaagaaaagaaaactgtgctcttaagagccagttctccactcctctacctcaggagccaccccagaacccatccactttgaggacacgagatcccagcccactcagccctgggagtccaaagacattttaaacagagcctctcttcacatttattaattcctgggaggaatgagggaggcttctccagccccccagagaccccggccttgtgctgcaacaggaggggagggagccagtccagaatccccggcacttctgaggacaccaacagcaccctgggcccgcggctgcatcagctttctagacaacgggagaaaagagaaatggtggaggaggggaaatcctatgccctcctcctcgcggaaatcaaggccgacctccctgacgcccccccggaaggaagcgcgtggtcggctgccagccgagacccccatctgcgcctccagctgcagggcctttgctgggcggttcctcgcccgcaattcccccacgagccctggggagacccagcgctaaccaggggtgcccaagggaggagccgggagaggccctcctggaggtgggcacagcccaggcaaacatcagcagacggaaccagcacccgggacccagggaaacgtcacctgccaccaggagctccacagggtcgctgagctccgattcgaaggtgtggggcacccaggagcggtagcggcacctgtagttgccggcgtgctggggccccacgaagatcagctcgaggttcgccgcggccccgggggtgcggaccgtcttcacggccttcgtctcgccctcgcgcagcagctcgaaggtgacgtcggggatgggtccctcgcagcgcaggacggcatctcggcccgccaggaccgccccactccacgtcgcccggagctgaggcctgggagggggtcctgggcggagcgggcgggtggtcgggccaggccacgccccaggccacgccccaggccacaccccaggccacaccccaggccgcgcccgcgcctgcgcctcagccccggcttcatcttccctgtcttgttcctgggcgcagagggctcctccggcgccgccgagctgcgcccgctgccttcacaccccggacatccgcgccacacgtgagtgtccccgcacccctcccccaggaccgtggaagtcccagattcgggcctgctctggggcttctggggtccccagcctcggtcactctgacgggtgaagggaagaagaaatgatggagaaaacggtgctccttcatggagggaccaaaaaaggacatacaatctatgtcaatagatgagggttttccctccataagtttaactttaaaagtgtatttaaggtgccgggcgcagtggctcacacctgtaatctcagcactttgagaggccgaggcaggcggattgcctgagctcaggagttccagaccagcctgggtaacacggtgaaaccccgtctctactaaaatacaaaaaattagccgggcgtggcagcgtgcgcctgtaatcccagctactcgggaggtggaggcaggaaaattgcttgaacctgggaggcagaggtttcagtgagccaagattgcgccactgcactccagcccgggtgacagagtgacactccgtctcaaaaacaaacaaacaaaacaaaactgtaaggaatcaaatgttacaaaatcctggaagattttggtaatgctgttgataatttcagggaaattaatgaagtacatgtaagtgcttgatttaaatgtgtattttattcaatagtttgagtatcttgccatggaagatactagcccagcctagcagaaaagtgcaatatgtataatatactttcgcattttaaaagttatattccctatccattttgaaatgctagccaaactacatgaagttatttgcaattaattgtaagctaatcaggaattttgaaagcttgattggattaacaaactataatgttgaaatttggtaaaatcataatgttaatttttactgtgaaacgttttcttgtaagatagatatacacatcctagtttaattttgtgtcttagtgtggatttacaaatttactacagttattctgagcccaggaacccaatcagatttcaggccagtttgatactggctgttcttaattctaacaggagagtaggacatcatactaaatgttatgtcagtgggactgtgttgtctttggagcttagtaaattaatcattttcttcagactttaaggagagtgataaataaaatttggagtcataggatatagatgtacaatttaaagattaaacattttttttttttttgagatggagttttgctcttgttgcccaggctggaatgcagtggcatgacctggactcactgcaaactccacctcccgggttaaagcaattctcctgcctcagcctcccaagtggctgggattacaggcatgtgccaccacagctggctaattttgtatttttagtagagacagggtttctccatgttggccaggctgctcttgaactcctgattttgtgatccacccgccttggcctcccaaagtgctgtgattacaggcgtgagccaccttgcctggccaagattaaacatttttcatcaattgtggatggtggcttataacactgcaagaataggctgggcatggtgactcacaagtgtaatcccagcactttgggaggcagaggcgggcagatcacaaggtcaggaggtcaagaccagcccagccaacatagcaaaacccggtctctactaaaaatacgaaaattaggtgggcatggtggcatgcgcctctaataccagctactcaggaggctgaggcaggagaactgcctgaacccagaaggcgaaagttgcagtgagctgagactgcaccactgcactccggcctgcaagaataaaagtaagttatccaaaaaaaaaacaaaaaggagaagaaaagggaggaatgaaggagagagatggggttggggggcagagatgagagagagagaaagaagaaaaaagaagaaagaaaagagagaaagaaggaaggaagaaagaaagaaggaaagagaaagaaagaaagaggaaggaaggcaggaaagaaaagaaagaaagtgaaagaaaagagaaaacggtgctcccagcaaagggtacgacctcaagatctggaggtcagacctgtgccctcacgctctgctgggctctgagtcctggagacgtcgatgaggaaatcagagggacaaacagagctggggacggcggggatggggagaaggacacatcagccgtgcgcctgcgggaccggggccggggcggggggtccagtatgacgactgacatggccagtaataaaacaaggcagccacagagctgcagggatctgaacaagaaaacctggggccagcctccctgctgccgaccaccacgctacacgtgacctacgggcttgcgtccgtgggaaataagccgaaattccaggcgtccccagaccctcgaccaccgatcgcctgctccccgccggggtaggcgatgggggctgaaccaaggcccagagcgccgccgtcggacgcccaaggaaagaggggaaagacaggaggccccgaggggcactgaacccgcgcccgccctcgctggtgccccgccagctcaccgtccacgtgcagctccaagcgctcgctgggcgcggagcccccgaaaggcggcttcaggtccacgtagacgcagctgtagttggcggagtcagccacggaaatgttgtgcagctcgaagagcgcctcggtcccagcggggctctggaaacggtgcacgcggcgcccgcccctgtcctcgcgcaccagggcgaagcgcgcgccctccaggggcgccaggcaccgcagccgcaaggccctgccggactccggctccggggagaactccggcgcgggcagcgtctctgcggagcagcacacgggctgacccgggcgcccagcggctggctcggccctaacgcgtggtctggcctcgcgctctttgccttggctgagtcttctgcccgcaatgacctggccagcttcctccctcgcctcctccgggcccgccccacctttgcatcccagtccttggatatctcacacgcaccctttcactgtttcttagtaatttgtttgtctacagacacagacgggaagcggggacggggacatgttttgtgcatggcttgatgcctggtgcacgatgccgctcagtagtggatttgctccacgagcgtcttctgagcaccgccccaatgcccgccccacggaggggcccctgtggtccgctgggcatggggttcgctgtccggtgctcagagtttgctaaataccatcaggtccaaggcaagcgagcggaggagctgcctcagcagaggccctcagtgctcacctagacctggcagctgggatgggacctgccaggtggtgccccctgtggcctgggccagacctgttcacccagttattccctgtggggcctgaaggttgtcacgctcatcatcatatttgcagtttaggaccctgaatcggcgggtgggcggataaagttggtattggaccctggcccagagcactgcacttccccagactctacacctggtactgctcctgctccccagggacccagccgcgtccctgtccctgctggccccggctcaccatcgctcagaatcagctcgaccggcgcgctgtccccggaccagccgttttggttgtcatgcagccggtagcggcaggtgtagtgacctccatcccccagggccaccgcgttcaggtgaaagaagatgcgatctgggctggtgctgctcctgggtaccagcagctctttctccccgcgccgtagctggaagtccactccactcaggggagccacgcaggtgagggtcaccttgttgccagggtgcaggacctgggaggactctccatggtgcatcagcacaggcggtggtggtgcagctgcaatgcaggcagcattactaggctgccccatccctggagctgccctctgcccagtccccagacctctgccctccgggtggcaatcccaggaacacccttccattcttttttttttttttttttgaaacggagtttcgctcttgttgcccaggctggagtgcagtggcgccactcagctcactgcaagctctgcctcccaggttcaagggattctcctgcctcagcctcctgagtagctggtactacaggcacctgccaccacacctggctaatttttgtatttttagtagagacggggtttcgtcatgttgggtagactggtctcgatctcttgacctcatgatccgctggcctcagcctcccaaagtgctgggattataggcgtgagccaccgcacccggcctcacccttccattctttgggcatcctctgcccaaactcctttgcaaccatcagacccaggcaaccgtgtggccagcttcctggacctggtcctgggcaaggacattcagcatggaggtcaggatgaatgtggtcatgccccctgtatcctcctcccccagcagcccccagagatggttcccacagtcaccgagctcctcaatggtcacagtagcgctgggctcagagagggcgccttccccatcggtccggtagctgcagctgtagttgccaggctgatggactggaaaggtggcctccacatcctcctgggcctcaggcacctccagaaactcatggtcgccctcccgcctcagcagaaaagtcacaccccgcagcacacctcggcacactgctgttgttttcaggccgggggtgatccaggacactggcgccatcgagagccagggagcaggcaaggactctgtgggtggggtggagttgaagagtgcttctgcataacaggagacgtgggaagcccagcagaacctgggccccacactcataagactgtgaaggagacagggatggagggcattgctgggaaaaggcaggcaggcaccagtggaaacaaggcatacggcaagagaaaaagagtgtgtgggagctgtacggcatgccgggcctgctggggacacaaccatgtattccttacaacacagacatcatccccatttgacagatgggaagattggggcttggggctcagagacatcgggtgacttggaggaagggagaccccccagtcaacaacctacccactgcctcctggcccccaattcatgccccggctcacttggccctgtcagctccaggagcttgctcagctgggtccatcctgtggacaagcccgagcggcagcggtagcggccctgggtgtcacccgtcagcaggaactggtgcttgatggcaggtgagtcaaggtgcacaggctcctgggccaccccattcttgaacagctggaagtctggagtctccaggtgggcctggcacgtcagcgtcacattggccaagggtttcagcagtgattcggactctgcccacaggctgggctgcgtctcataaactgcaaggggtggctgggatcagctcagtgccacagagacagggctcccccccggcctgggcccaccattcccagacctcacccctgcactcacatatggctgcttctgtcactgggccccaggtgacacctgcggagacagcccccgtaaggctcctgttcccgccccctcccgccccagggacccagaccccaggaggcctcaccccacagcaagagaaagaccacgagcatggacatgatggtcgcgctcactccggtgcagtgagtgtctggggtgagcgtctgcagcaatgaggccccaagggagggcggtggggtggctcgggcactgacctcttcccgtgtttgtccttcccggaaggcgggggcagggcccccatggggtcagggcaaagggtgaacttctgaggcctcaggatgcccagcaacaattataatcaataatcatgtatgattaataaactaaatcaagagtgataaaatgatgttaaaaccacctcatcctcatttcagtgatggatcctagaacctgttctagaaggagacgctgagttctccccactctacctggagctgctgaggtcaagtggagagtgccggggctgaagcccagcgagcccctccctgtcacaccacactgcacatgtgacaccaaaggtggggttcacctcttttcagactttctgcggttgccctcacatgggctgtctggaggtgcaccctcactcttcctgaggactgtggttccttctccatcactggttcattctgcatggtgtgacccaccacggctctggagtcggatttccacccaggtcattcagctgagacctgcgcttcccaggcctacccgtgacatgtgctcagttacctgagctgctggtggtcactcatgtggctatagcctgctgcctggaggccaggcctcccgcttcccctgcctccccctctcctcaccacagcctgttgggatggaacaggacaggggtgagaccgtggtgctttcacactcagcctccatggacatcctgtcattcccacccggggaggtctggtccccaccctgggtgtcccagcctagctccgctacgagtgtgagggcccagggcaaccgcctagccctcatctgccccctgcactgcatcctccccactcattcattccacaggcatttattgagcatctactgtgtgccagatgcaaagaagacagtgggataactgggcaaggagcattccaggcagagggaacagccagtgcaaacatgggagatgcgggtgcagtgagaaggagcagaggagaccaggagttgaggcgactgcagagcgattgcagagctcatagacgtgatgaagaccagctgggcactgcagcggctctggcttctgctgtgagggacggggagctgtggagactccctctgtttggtcccatttccatattgctgagcacctgctgcatgctctctgtcctgctcagagccagtacctggatggaggctgtgtgttctgggtggactgggggagaatgcattctttgcagaagagacaaccaggtgctgaggcctgaagtcataaccagacctggggcactcagacaaggactggtggccaggccagaggagcagagctcagggtgtgcacagaactcagaagtcagaccactgaacagtgacagaacctttcagcccattggcaatgaggctgcccaggcagccagaggcctggtcaaatctgaggtctgcagagatggagctgtcattctgtgtttcctttggcagtcccaacaccagcctcgttgcaccctcctcttagcttccctgggttctccagccctaagggtggtagcagcttcctgcaagtatccagctctgagattctgcaacatccacttttgctctctgagccttgcaaaacctgcacaatcagtccctaacttatatcccctctgtttgaaatacctagtgtggtttctatttcctgacttgactctgactggtgtggtacttggtataaagaaggttccctggccaggtgcggtggctcacgcctataatcccaacgctttgggaggctgaggcaggaggatcacttgagcccaggagttttgagacccgcctaggcaacatggtgagacactgtccttacaaaaaattttaaaattagccaggtgtagtgacgcaagtctgtcatcccagctgcttgggaggctgaggtgggaggatcacctgagcctaagaagtcgcggctgcaataaacagtgattgcaccactgcactccagcctgggtgacagagtgaaaccctgccccctcccccaaaaaagaaaagtcccatgaaacagacctacacaggtgagattctgagattgatctggttctgacctcggtcaggaatgcagtgctgagcttcttgccaacagaatatgagacactagaaagccatagcatgcggtttcatcatgtttaactgtcacctgtggttgcctgagatgaagtgctgactgaagcgagcaccttaggagacacagtggccactgcactgagcagctggtagcagcagtggtgaccatgtggactggggggtgggttggctgcttttgacagtgccagagaactcaaagaaatagccacacctgtcggagaccccagttcttgcccacctctgcatggacgaacctctcgccgaagtggagcctgccgccctccctggggtaagagcccatcctacatgtccccagacaggcctgggtggccggtggactatcgtcaaagggactgtgcagccagggttctccacacccaaggccgcccctgcactcccagcaggagggcgcccgcaccggcggcccgaaaaagtctgggccagcagacagcgcactcacgcccgagaccccgcaatgccgtgtgtccgcgacctcccgctcagggcgtcctcgggtcagggcgcagcgcggcccccgtgccgcttctggtgctcgttgaggttgcaacggtggctgaaaggcttcccgcactcgccgcaagcgtagggcctctcgcccgtgtgcgtgcgccggtggcttaagagctccgacttgcgcacgaaggccttgctgcagtgggcgcagacgaacggcctctcgccagagtgcaggcgctggtgctggcgcagctcggagctgccgcggaaggccttgccgcattctgcgcaggcgaagggtcgctctcccgtgtgcgaaagccggtggtgcgccaggccggaactgccgcggaaggccttgccgcagtcggcgcaggcgaagggcttggcgcccgagtgcgtgcgccggtggctcagtaggttggagcgctggctgaaggccttgccgcactgggcgcacgcatgaggcttctcgcccgtgtgcacgcgccggtgctccgccaggtaggagcccatgacgaaagcctggccgcactcggcgcactcgaagggccgctcaccagtgtgcgtgcgctggtgctgcaggagctgcgagctctcgcggaaagcctttccgcactcggcgcaggggaagggcttctcgctgctgtgcgtgcgccggtgctgccgcagccccgccacacgcacgaaggccttgccgcagtcgggacaggcgtgtggccgtgcgcccgcgtggatcttcaggtgctcggccaggttggagctctggctgaaggccttgccacagtcccggcaggcgtgcggccgcgcgcccgtgtgcacgcgccggtgctccaggaaattggagttccagctgaaggccttgccgcactccgggcactcgtagggcttctcgcccgtgtgcgtgcgtcggtgctgcaccagcgtggtgcttcggccgaaggacttgccgcagtccgggcagcggaagggcttcaggccgctgtgtgtctcctggtggtggatgagctgcgagtgcgcgcggaaggccttgccgcactccctgcaagcgtagggcttctcgccgctgtggatgcgctggtgctggctgaggttggagctccaggcgaaggccttgccgcactcggggcacgtgtacggcttctcgcctgtgtgcacgcgccgatgctgcagcaagtaagagccctggctgaacgccttgccgcactccccgcaccggcagcccggctcctctgggagaggcgaagggcgcaacgcccggtctgcaggctcgctcctgggcccagccccgtcccgcccaccgtctgcggggcccagctccctgccggggcctccctgttcgtccgccgcccccagtgtggcttgctgccgctggccgtcccctgcctccctcggaacctccgtggagttttcccaggccccccagcctccagacacagccccctcagagaggcccctcgtggcagtcttcacattgcagaggacctggccttcctctggggccacctgcagggtccaccctcttggggactccatctcgcgcctgtgacctaaaacaggagagaaaaggcaagtaccttagagaatacaaagaacaccagacagagggcctgagggggacacgacggtgggtgggctgtcatcccccactcttctcctccaggtccctggatgcccaatgccctctggagcctggagcaggaaggccagcaggcgggctagacactcgggggatgggccagcactctgggcctgcctgacagggccacgtgcacatccccacacccggcccggcccagcaggaggggagggggcgccagcatcgcagaaggactcaaagttgcccacgcacctgcactggccctactgtggcaccactctcctctccttgcttcacagggtggggccccaagtgtcaagaaggtggagactccagtttgtgaggaacacgatggacccgtctccattcctgaaggctggaggacaccgcctgacccaaacacagctatgtctgcctcacccactccaccctggccggatccctgggtagtcccctccacacagtatgggcagcatgtccaggctggaggatctcagtggctgttacccaggcaatgtccacaccaggcctctgtgcaggtcagaccaggtggtccaaggcatggggtggctgtgcagcccagatccctgagagagagagaggccaagggtgggagggcctccttggtcctaaggccatgcctgcctgtccagccgatccttcccacagcgaagtctctacagcgagcaaaacccatcctcatttgccctgagcaccttatcatccttgtgtagtctccagccccgctgccaaggcagggcagggacaagtgtgtagatggtgccatacctggaggtggggcctggaaggggcccaggggagcctcttgctcctctccctcctctgtcctggggaccagctcctcttggggcctgggggctggcacctggggacaggaaggcagcagggcagggtgaggtgttcagcctagcagatctgagaaaacaaggggcatgcggtggcatgacccacccttctctgcaccttcagttctcaggacacaatgcggagcacacaggtgtggactggagatctctgactctgccgtccaagccaagaccaccaaactcccacctgtcaccatcactttcccacagcccccaggccctctcagccaccaacccacgactggccccagtgctggctcagctggggtcgtgagcaggggaagcacacccagcccccagaccagcccccactcatctggagtcctggcccagctgactcctgctgtagccgctctgccagggcagtggcctcctcagggctgcctagccactgctcctgcgtgtaggcctggatctctgggagcagtgtgcccaataactgctccagcaccaagagctccagcatctgctccttggagcaggcctcaggcatcagccactggcaacacagctcacgcagctgagccagggcccctcggggccctgctgccttctcatagcagaacccccagaagcactggccagggctcttggagctgggctcacccaccatcagttccagtggactcgggaagacctggggggccagggctgatgcctcactcatctgggcagccatcctgcccctttcctgggaggggagtgcagctgcatggcccagggtactttctctgcagctggaaacacaaaggtgagcctgtgagcacagcaaggccacgaaggtcccctccttgggaccacctgagactgagtaaaaatggaagaatgggggtatcggcgtttctggcccccagtgtcagcatctttgcccacctgtgtgtccaggtgcctgagggacacactgaggtgccatggctgcttgtaccatcccttccccccgcctccccgcttttcttgagggtccctgccctgccctgtctccttggcacccttcatcccacacacagaacaactaagacagagactgtgaacaggacacccagagtcagaccagcagatgggtcctgtttgtcccctccaggaagtgttttaaaaatttaagttaggccaagtgcggtggctgacggctgtagtcctagcactttgggaggccgaggtgggtggatcacgaggtcagcaattccaagaccagcctggccaacatggtgaaaccccgtctctactaaaaatacaaaaattagccaggcgtggtggcaggcgcctgtaatcccagctactcgggaggctgaggcagagaactgcttgaacccgggaggtggaggttgcagtgagccgagatcgcgccactgcactccagcctgggtgacaaagtgagactctgtctcaaaaaaaaaaaaaagagaataaatactgatacatactacaagatggatgaatcttgaaaatattatgctaagtgtaaatgaaaaaattcagacacaaaagacttcatattatgttattccatttatgtgaaatgtccagaacagataagtctgtaagagacagaaagtagatcagcggttgccaggatctgcagggaagagagaaatgggagatacagccgtgggagtgatgaaaatattctggaattagtggtgatgactgtgcaacactgaatataccaaaaaccactgaattacacactttaaaaggatgaattgtatggtatttatgttttttaaaaaagttaccacccaatcccaaaagcttaaaaactgtatgactccatttctttttctttttctttttttttttcttttgacagggtctggctctgtcatccaggctagggtgcagtggtgcaatctcatctcccaggctcaagccatcttcccacctcagcctccgaaggagctgggacatcaagtgcgtgccaccatacccagctaatttttttattttttatttttctatttttgagacggagtttcgctctttcacccaggctggaatgaagtggcgcaatctcggctcactgcaacctctgcccccaggattcaagcgattctcctgcctcagcctccccagtagctgggattacagatgcctgccatcaggcctggcttattttattttattttattttattttttagtagagatggggtttcaccatgttggccaggctggtcccgaactctttttttttttttttttttttttttttttttttgagaagagtcttgctctgtcgcccaggctggagtccagtggcgctatcctggctcactgcaagctctgcctcccgggttcataccattctcctgcctcagcctcccaagtagctgggactacaggcgcctgccaccatgcccggctaatttttttatatttttggtagagccggggtttcaccgtgttagccaggatggtctcgatctcctgacctcgtgatccgcccgcctcagcctcccaaagtgctgggattacaggcgtgagccacggcacccggccggtgggccggtcctgaactcttgacctcagatggtccacccgcctcggcctcccaaagtgctagtattacaggcgcgagacacctcgcccagcctatgcaacattcgtaaaatgacaaaatggtagaaatgagaacagattactagttgacaaaaagaggttaacggggagcagaggtaggagggaagggtatgcggctctgtaagggcaacacggggatccttcgtgatggaaatattctgcatctcagttgtgatattgtactctagtttttctttctcttctctttttttgagacagagtctcgctctgttgcccaggttggagtgcagtggcgtgatgtgggctcaccgcgacctccgcctcctgggtacaagcgattctcctgcctgagactcccgagtagctgggattacaggcaccagcctccacacccgcctaatttttgtgttttcagtacagatggggtttcaccatgttgctcaggctggtctttaactcctgagctcaagggatccacccgccttggcctcccaaagtgctgggattacagacatgagccaccgcacctggcctctagtttttcaagatgccacctttaggggaattgggtaaagcgtacatagggtatgcattacttgttactgcatgtgaatttataattacctcaaatcaaaagttaaattttaaaaaaacgacatctgatttcaataaaaatccatatttgtgtattgaagtatcagaaatccgggtcccccaagggcccatgtttcttaaggcggagccaggcaccgctgcccctccatcctgtggtgtgcgaccccgacccgccagcccccagccgcatctatcagggctgccgtcctgagtccgtcctcgtcgtgggatagcatgtgagccccgtaaggtccttcctgtcggcctcactgctccagcctccccgacgtcctcacgtccacgctgcgtgccctttctgagcctcaacgcctcctcctcacctcgacatgatcagagccacctcccgcgtcagtcccagcgcccacgcccccaacaacgggcacttgtccgaccagtcacgggtacttgtgtctcccccacaacccccaaggcctaggctggacaaacaaatacggagtggataaaggggaggaagctgcggccaggtggcgcgaggcctgtgcgggcagctccggaggctgggaggcgagcccagcctggtgagctccgaaactacccggggctggggactgatgaacgaataaatgaatgtgggaagaaatgatggcgcggcagggcatgagtgaatgagtgaaagaataaacgagcaggaggaacgatgccacagaactgatcgccataaggctcgcgttcaccgagagaacagcaaacgggagccatttccgtcccgaccacggtcgcctctggcccgtgcagggccacttccgggccgctctggacggcgcggaggcctatctctcggtggtcccagagggcccagctcagggccgaggcccgtcctgccccgcgcggcgggagtggttggagccggagggcggatctgtgcctggccgagggtgtccgtcggcgtcactcaccgtcctcggcccgcctctgcgtccactaggagcggcctgaaagaggcccgcacgcgggctcgagccgcgtggaatggtaggagggcgggcaccgggtctcctgggggcgcggttgcattcggcagagcggcccaaggcgtcgcgtttctccccactgcgcctgcgtaactatgccgcggctgcgggcgcgcgccttctggttcccatggggacggcgccacagccaagctactcgggcgtcctgcgttgccatggatgcgctccgccccttcctgcacccggccagcctctgcggcacacacccaacagctacacaggcgcctggggctgcccgggtcgcggacgcaagtcgggccaacgtagcttctccctggcggtcctcctccggccccaggccgtctttaccacccctggaaccttgctgagttgacgccactgagctgcgtctcacacccacgcgctgtggaacacccaccaagctggaatccacgcggtttttaaaatagagtcgggggccgggcgcggtgactcacgcctgtaatcccagcactttgggaggtcgaggcgggcggatcacgaggtcaggagatcgagaccatcctggctaacacggagaaaccccgtctctactaaaaatacaaaaaattagccgggcgtggtggcgggcgcctgtagtcccagctactcgggaggctgaggcaggagaatcgcttgaacctgggaggcggagcttgcagtgagccgagatcgcgacactgcactccagcctggggcgacagaacgagactccgtctcaaaaaaaaaaaaaaaaaattgagtcgggatctcagaagctaagcagggtcgggcctggttagtacttgggagaccgtctgggaacaccgagtgctgttggctaaaataaataaataaaccgggcgcggtggctcacgcctgtaatcccagaactttgggaggccgaggcgggcagatcacgaggtcaggagttcgagaccagcctgaccaacatggtgaaaccccgtctctactgaaaatacaaaaattaggcttgttggcgtgtgcctataatcccagctactcgggaggctgaggcaggagaatcgcttgaaccggggaggcagaagttacagtgagctgaggtcgtgccactgcacactccagcctgggtgacagagcaagactccgtctcaaaaaacaacatagaccagatgctgtaagctaaaataaatgaatagctagagacggggtctcgctatatggcccaggctggtcttgaacttctgggctcaagtgatcctcccaccttggcctcccaaagtgctaggattacagacccgagccactgcacccggcctccacgagctctttttgtaccaatttttcccaatttgtactagggagctctcacctcagcccaggtggtttgggcaggtgtgggtacatggcccaggtccacagcacagggcagtccatccctctggccctggcagtggtcactttggacctgtgagcatcgtgggacttctctctgaactgttagggcctctatctgctttgaacctgaggctgtgagcatctgtcagctggggcagctgcagccttcttgccccgctgaaggatgaatctgttaagagaatggagtccatacagaaaagcagaactgagggatggtgtgttagtttcctgtggttatgcagcaaattaccacaaatttggtggcttaaaacagcagaaatatattcccgcccagttctggggaccagaagtctaacatcgatatgactgagctgaaacaagatgttgacagggctgagctccctctggaagctctaacgtagaacctttccttgcctttttcagcacctagagctgcattccatgtattccttggcttttcgtcctttcctccatcatcaagtaactggtaacatcttactatttctctcattaagttaaaatatttaacatatgttcattttatcttatttgcatgagagtcaattttagctttaaaaaaatttttattggccgggtggggtggctcaggcctgtaatcccagcaatttgggaggtggaggtgggcggatcacctgaggtcaggagttcgagaccagcctgaccaacatggtgaaaccccgtctttactaaaaatacaaaaattagccgtgtgtggtacatacctgtaatcccagctacttgggagactgaggcaggagaatcgcatgaacctgggaggcagaggttgcagtgagctgagatcatgccactgcactccaacctgggcaacagagcgagactccgtctcaagaaaaaaaaaagggggggaggcctgggcgcagtggctcacgcctgtaatcccaacacttgggaggctgaggcggggggatcacgaggtcaagagatcgagaccatcctagccaacatggtgaaaccctgtctctaccaaaaatacaaaaattagccaggcgtggtggtgtgcgcctgtagtcttggatcacccatgctggaagaattcagctgcccggacatgaggaaactcaggtctgcagtcctgtggagaggcagtggagcagtgcatactccaagcccagtggggccttcagatgattgcagtcttggctgccatgttgacttcaacctcgtgagaggccttgagccagaaccacaggccaagctggtcacgaattccccacccccagaaaatgtttgcgatgataaatgtttatttatttatttatttatttttgagaaagtcttgctctctcacctaggctggagtgcagcggcgcgatctcagctcattgcaacctctgcctcccaggttcaagggattcttgtgcctcagcctcccaagtagctgggattacaggcacatgccaccatgcccggctaatttttgtatttttagtagaaacggggttttgccatgttgcccaggctgttctggaactcctgagctcaagccatccgcccaactcagcctcccaaagcactgggattacaggcctgagccaccacgcttggcctggagcatgcccttgatgtgcaaactaaccaatccagagcctcacccctctacctggtccacacaccgcaggagacagtattcctctgtcttaatcatccccggaacaggagccaagcagctggggaacactcccacagctgaaagcccacaggaattactccagctagccagtcctgtgctgtaggctctgctctgccttgcttttcccttggaaaccccagtaaaggctctggcttagagctcccccttggtcctgcccctgctgcctctgacagatgctggtgcttttctcatgtgtccttccttgtgggccgtgcctcctgtttccaggatctgtgagcatgatgaactttgttttcctgagcttgtcctgtgtctcctcttctggccacacctgactgagcagaacataaaagcgacagaacaccaggagggctgctgcttggggaaattgtgtgagaagagtcctgggggactaggggcagggcaagcactgctctccctctcctggaggctggggagagcatcaaggagactaccaggtaggaggaaccatgggcagggcctccctcatcaggatgctttccccacaacagagggatttaagcccctggtgggtgagtcctggattaaccaagacctgagccttttggggggtgcagaggacagaggacactgtgaggtgagtttctcctgggtggattccccaggggcctctgaggctggtttcaggccctgccctttggctgccccactggaagctctgagcatctacccttcagggacgctttccctggtctgaccttggcaagggcaaataagaggtactccatggagggtcaccaaggtctggggcgtaaacggtgcccatctgcacagtagcatgagggccacagagtgtggtaaatgtcagtgaccatcacatgcggtccccagtgtggctgcaggggccacttaggattcttctgttcggggtcccaggccacacttggggaaccctattggaagcaacaaggtctaggccctgagggcccagggctctgccctctccagggctctagctgagccacgtgcaagcatcctcccggccctcccagctggtgtgaggaggaaaccacagccaaagggcaaggtgctccacacagatatgtccctagtcagcctgccccattcggcctctggagtgggagccttgggtctgtctggaaccagtgtggatgaaatgcagggagaaactggaatcatagccatggacagccactcacatagctgggaagaggcatgctgtggtagatcccggtggactctcacctctgcggtgctggggacgttgtgccgacacctcaggcacccacttccactcacaccgcggaggcttggggagatgcggttcagtctggagtccagcggggggcgacaataaaggcgaccccgctcgtcagtcagaccagggcaagcttgccagggcttcacacttcaccaaagggaaccctttctgccgcgactaccgagctgccagggccgggacaggcagaagcctgccccgaggtctcacctctggagggttacgagctgtgccaggccggctacggtagagggtgtgcaaataccccgcggtcccaaggctcctgaagctgcctaagggatatgagagaccctaggttcgaatcctgcctccatcgtcttatgttcgtgcctcaggagagtcactttgccccgtttcctcgcataccagagagcccagtaacacgctccgcggctctgcggagaaaaagaccctagagatcgtggacacagcgtctgggccgtatcagcgcccactcgagattattactgcttatgcctgcaaccggatgctgtgcgcccggttagaaaaggtcaaataaaactcgagttaggggaagcctgtggacgccatgtgtacaaagtgaagtttaatcaaagttacaaacgttggtgggttttccgggacaaaggcccctcctcgacgcagggttcgcttgggcgacgcgtcgactctcggctccctgcagtcaaggcgcggcgcggcccccgtgccgcttccggtgctcgttgaggttggagcgttggctgaaggcgcggccgcaatctccgcacgcgtagggccgctcgcccgtgtgcgtgcgcaggtggcgcaccaggctgcagttgcgcacgaaggccttgccgcagtcgcggcagatgtagggcttctcgcccgagtgcaggcgctcgtgctggcgcagctcggagcagccgcggaaggtctttccgcactcggagcagccatagggccgctcgccggtgtgcgcgcgctggtgttgcaccaggcccgagcggcccttgaaggccttttcgcacagtgggcacgcgtagggcttggcgctgctgtgagtgcgctggtgccggctcaggttcgagcgctggttgaaggccttgccgcactcggggcacgcgtagggcttctcgccggtgtgcacgcgccggtgctccacgaggtgcgagaacagcccgaaggccttggcgcagtcggcgcactcgtacggcttctccccggctcccgacccccgtcggggactccgctcgctgtagtccccgcagggcgggcaccccagccggaaggcgcgccgcgccaggacggggccacgccggtggcgctcggccgagtgcgtcttctggtggcggtacaggccggagcagcgcacgaaggccttgccgcactcggcgcactcgtagggccgctcgcccgtgtggatgcgctggtgctgcagcaggctggaggtgcgcgtgaaggccttgccgcactcgtcgcaagcgtacagtcgctgggccggggggtcggggacaatagggcgaggtcgcgaggtttggccgcactcaggacacactgggggactcttgcccgcctgctgctgctggttggggcggaagcgcttcccgcaccgggcacacggacggggctcctccgtcgcctgcagcctctcctgggggatccgcagggccctccacgcaaaggcctcgccgcacgcgcaagcccggggctgctccaccaaggggttcctcccgcgggaggtcggctttggggtcctcgggcaggtcggagcgccagtccctggttggcacggccaacagtccgtgtggacctcacacagttgagtccgggggtggttctggatccgctccggacaggggtcacacacgggtggcgtctccccagcgggcgccccgcgatgccacgccaggcaggagttcctgctgcagtccccgccacgcgctgggctcctacaggggccctcccgggcttgcagcccctcggggataaccagctcagggttctgagaagaggtggggccgcacggctcccgcacgaggggtctggtcccggcgctgtgccgggtccccgggccggggctcaccccgaggctgcagccccgggagcccccgcctgggggagtcgtcctaccgcccgccgctccacgcaggtcccccttttgagtggggcggctcccagctcggtcctcttcgaggggcctcggctcctcgggcctcttctcccgggccccggaggcaccctgggcatcggccttggggagtcctccctgcccagccttctgggctggagcctccatcctggggcgcagagttctggttgtaggatctggaagagcagagaagaaatggaggttggcggttcccaggaggagagaagtggagaactgggccaacgagcgaccaccccacagctggcacctactgggcggcccccagctctctgcagatgcgaaagggtaaatggagtgacataggcagcccgtcctgcccctcttcaaattgtcaccacccagaccccagagaacagcttcccaggctctgcctgcccgccatcaccgttcctccccaacactagctcctaaaacactgtgcccctggctaaggccctccctggtcccccttccccaagcaacagggactcccccgttgctcagctgccagctccccaaaatctcacttactcctgccctccgtttctcagtggcaagccgacactccgggtcctcctggctccattcactgccattgtccatgtcttctgagaggtgtgaggtgagactcacctgacagctgagagcctggccgggagatccacgctgcagaggccaatgctggacttcccctcccctcttcaaccaggtaacggtggtgctctcaaggctggcagcctcatctacaaaatgggtatgataacggtaagtataaccagctgagtagggagacaggcagcccagatcattcaagcaagtgtgaacattagcaacgcctggcgcctgctattactattttaaaattacactgtggctgtattagttatctattgttaaagctgctttaacaaactgccaccccatagtggcttgagacagtgcaaacttgttatctcagagttctggaggtcgtaagtcctaagtgaaggtttcagtagtgtgggttccttccagaagctcttggggaggacgtttgctgaccatttccagcttctaggtgccacctacttttctttcttccatcttcaagccagcagtaagacatgttcatctctctctttctgggtttgttgtcaaatctccttatactccttataggattctgacccttctgcctcttgtgatcacactaggccaaccacacataatccaggaatctccccatctcaagatccaaaacttcatcacactcagttcttttgccttgtgaagtaacatagtcagaggttctaggaaacaggacgtgcagatctttcagggggccattattctgcttacaacagtggactttgctgagatacacacacgtgcatatataaatattcatctcctaagcaagcaattgaatagcaagtgaaaacaaaggacggccgggcacggtagctcacgcctgtaatcccagcactttgggaggccgaggcagatggatcacctgaggtcaggagtttgagaccagcctgaccaacatagagaaaccccgtctctactaaaaatacaaaattagccaggcatggtggtgcgtgcctgtaatcccagctactcaggaggctaaagcaagagaatcacttgaacccgggagatggaggttgcagttagccgagatcgcaccattgcactccagcctgggcaacaaaagtgaaactctttcaaaaaaagaaaaggaaaaaaagaaaagagagagagagggagggaggggtgaaggccggggggggggagccgggcgcggtggctcacgcctgtaatcccagcactttgggaggcctaggtgggcagatcacgaggtcaggagatcgataccatcctggctaacacggtgaaaccccgtctctactaaaaatacaaaaaattagctgggcgtggtggcgggcgcctgtagtcccagctactcgggaggctgcggcaggagactggtgtgaacccgggaggcggagcttgcagtgagccgagatcacgccactgcactccagcctgggcgacagaacgagactctgtctcaaaaaaaaaaaaaaaaaaattgccgggcatggtgatgcatgcctgtagtcccagctactcaggaggctaaggcaggagaatcacttgaacctgtgaggtggaggatgcagtaagctgggattgggccactgccctccagcctgggcgacagagcgagactccgtctcaaaaataaataaataaataaatattttcctcattgtgatgtgatgtgaggtttctcagcctcacacgtgataagtgcacaatcctcctgtcccctccctagatctcattgtttccagaacaaagatggatctgtccagcacagcctttagactctgaatcccggatggctaacatcatatgcagagcgtgagatggacacacttgtggcaccctcgtaaatcactgcttcactcggcacaggagctcagattcttctccttttgtcctgtgttccctattctgtgcaaggcagatatcctcttattttattttatttattttggtgttttttgagacagaggctctctctgtcacccaggctgcagtgcagtggcgccatctcagctcactgcaacctccgcctgctgggttcaagcaattctcctgcctcagcctcctgagtagctgggattacaggtgcctgccaccatgtctggctaattttttgtatttttagtagagatggggtttcaccatgctggccaggctggtcttgaactcctgaccttgtgatctgcccacctcggcctcccaaagcgctgggattacaggcgtgagccaccgtacctggccagatatccctttatttatttgtttgtttgtttgtttatttttatttatttagagacagggtttcactcttgttgcccaggctggaatgaagtggcacaatctcagctcaccgcaacctccgcctcctgggttcaagcaattctcctgcctaagcctcctgagtagctgggattataggcattcaccaccaagcccggctaattttgtatttttttcttagtagagccggggtttcaccatgttcacggggctggtcttgaactcctgacttcaggtgatccacccgtctcggcctccccaagtgctgggattataggcgtgagtcaccgcacccagccgatatccatttattaaatgtctcagagggccgggtgtggtggctcatgcctgtaatcccaacacttggggagtccggggggggcggatcacgaggtcaagagatcgagaccatccttgccaacatggtgagacgtccttgacctgatgtcactttttctgtctgttttgcagatttctaacaggcagttgccctgggccacctggtggcctgaaataacttgaccgggaactaaaaggactcacgaagcatttaaccaagactctacatgttgacttttcagccaaggacacttcagagcgactggctgcagttctccaaaggaagctgctgccagttgcccctggggggttatttccttcttggacatcatgaccacaatggcagaaatgcattgatggccagcactctggggatgaatgtttttgagtggaaatgaaacataccaaactggttaaagacaaaaatgcagagttggacaagttctgcaggtcacgaaaggcctttgaagcagccaggcccggttcctgctctgctgtatgggaggctgctggcctgagctggagagcagaaaggcccagtgccaagggttcagcaagtaccagtcccaggccaggcatttgctaataagccagggtgacagtaaggacaaggggactctggtgtgatgtgaggtttctcagcctcacttgtcacacgtgataactgcacaaccctcctgtcccctccaggcctgtgtgagacaggaaaggtgaggctgcctctccctctgcaccttaaagccactcggggtctgggttttcctgagacttcccggagccagatgcagactcccaaaggcgccgatccttcctcgatctccctccctcaagagtggcactaatcaggtctaatttagagaaaatccatcacctccccccactgtgggctctgccacttcatgccttggtctctccacctatcagccagctggagcctgggactcaaggaggcatgcttggaagtaaggaacttctctgagtacgaggacatctgggtggtgctgaacaccagcatgctttgccccgtggcctggactgtgcacagggcacctagagtgacctgtcacctcccacgcaggtggaagggtgtgagagagaatgggcactcagttacaaacatccccttcccaaacacttgtggatctgagtctgaggctactccttccaggtgaggggttggctgctgttgtagcttgttactctctttctgtcccttctgccctcaggtcttgaccatgcagcttcccaagaacaggatggggaatgatatgggcacatggggaggcaagcagccacaggcctcacctgctcatgggcactgaccgtcccaacagcaggtggacatgaatctaacccacagacaccagagtagagggagctgggctccctgagtctggatggggttctcacaggcccccacagggagacaagggaagctttctccagaatgtggagtacggactcactgtgtgaataaagtaaatgagctggagggggcgggacaagatttcaaaaagcaccactcatacacccaggactggcaaagctgctggcagtaagctctatcatggggctcccccactgcaggtgagctgattggcctcagctggcaccatccatgctcagtgtttgccctgaggacaagaagacatggcaaaaaagaggaaagtacagaacacactcccacctggctggtggggatatagatagtgcagctgctgtggaaaccttcagctccacagaaaggtaaagatggagctaccacaccccgagtaattccacccctaggtatccacccaagagaaatgaactcaggcattcaagcaaacactggctcacagatgttcagagcagcgctgttcacagtagccaaaatggagaaacaagccaagtatataaaatgacaaatgcataaataagatgtggtatatccatagaatgggatattattcagccataaaaatggatgagtactaacacatactgcaacatggactttagaaaacatggaaagtaaaagcagtgagtcacaaaagaccacatattgcataattccatttatacgatatatccagaataggcaaatccacagagacagaaagtagactggtggtcgccaggggctgaggggaaagagtggggagtaattgctttacgggtatcaagttttggggtaattaaaatgttctggaaattatagtggtgatggttgcacaacatagtgaatatattaaaacctaaaaaatatactaaaacctggccaggcggtggttcacacttgtaatccccgcactttgggaggcgaaggtgggaagattacttgaggccagttcgagaccagcctggccaaaatgtcgaaaccccatctctgctaaaaatacaaaaattagccgggtgtggtggcacattcctgtagtcccagctacttgggagactgaggcagagaatcactggaacctgggaggtggaggctgcagtgagccgagatcgcaccactgcactccagcctgggcgactgagcaagactccatctcaaaaaaaaaaaattatatatatatatacacacacacaaaaacatggccgggcacagtggctcacgcctgtaatcccaacactttaggaggctgaggcaggtggatcacttgaggtcaggagttcgagaccaccctggccaacatggtgaaaccctgtctatactaaaaatatgaaaattagccaggtgtggtggcaggcgcctgtagtcccagctacttgagaggctgaggcagaattgcttgaacctgggaggaggaggttgcaatgagccgagatcacaacactgtactccagcctgggcaacagagcgagaatctgtctcaaaaaaaaaaaaaagtatatatatatatatatatatatatatatatatatatatataaaattacatatatacttaagagtatatatttatatagaatgtaaatatatattagagatatatatatactaaaacccaacctgaattgtaaaatggttcatttgttacatgatttatatatttttgttttgttttgttttgttttgtttttttgagacggagtctccctctgtcacccaagctggagtgcagtggtgtgatctcagctcactgcaacctctgcctcccgcgttcaagcaagtctcctgcctcagcctcctgagtagctgggattacaggcatgtgccaccaagaacggctaatttttgtatttttagtggagatgggatttcaccatgttggtcaggctggtctcgaactcctgacctcatgatccgcctgcctcggcctcccaaagtgctgggattacaggtgtgagccacctcgcccagctgatttatatctttttttttttttttaaagcagaatgcacccatgccacagtgctccttcctgcagcctgtcaggcgtcggcccaccctgcaacatccaggatgtcatttgagccctggtcacacgaaagcactgcatgggatgaaggtggtttatttatttatttttattttattatttatttatttttttgacacagagtctcgttctgttgcccaggctggagtgcagtgacacaatctcggctcactgcaacctctgcctcccaggttcaagcaattctcctgcctcagcctggcgagtagctgggattacaggtgcctgcccccacgcccagctaatttttgtattttcagtagagatgaggtttcaccctgttggcctggctggtctcaaactcctggcctcaagtgatccccctgcctcagcttcccaaaggtgctgggatcacaggcacaagccactgcgcccggccgaaggtggtttcttttaagcaatacatttgtattgagaaaaacaagttcttggccgggcgcggtggctcacgcctgtaattccagcactttgggaggccgaggcgggcggatcacgaggtcaagagatcgagaccatcctggctaacacggtgaaaccccatctctactaaaaaaaatacaaaaaattagccgggtgtggtggcaggcgcctgtagtcccagctactccggaggctgaggcaggagaatggcttgaacccgggaggcagagcttgccataagtcaaaatcaggccactacactccagcctgggtgacagagcaagactctgtctcaaaaaaaaaaaaaaaaaaaaaaaaaaaaaaaaaaaaagaaagaaaagaaaaaaggaaaaaaaaagagaaaaacaagttcttttaaatctctaggtaaaaataaaataatttctcacacacagccaagtcaactgcataccagagtaccaagcatagtttccacatcagaggcttaagctctggggtaaaagcattttctttaaccaggtgtctgttaattcactcatatcaaagagaaaacttggctgggtgtagtggcttatgcctataatcccagcactttgtgaagccaaggtgggtggatggcttgagcccaggagttagagaccagcctgggcagtatggtgaaaccctgtctctattaaaaaaaaaaaaaaaaatggccggacgtggtgactcatgcctgtaatcccaacactttgggaggccaaggtgggtggatcacgaggtcaggagattgagaccagcctggctaacatggtgaaaccccatctctactaaaaatacaaaaaattagccaggcgaggtggcgcgcacctgtaatcccagatactcgggaggctgagacaggagaatcactggaatccgggaggcggaggttgcagtgagccaagatcgtgccactgcactccagcctgggcgacagagcgagactccgtcaaaaaaaaaaaaaaaaggctgggcgcagtggctcacaccagtaatcccagcactttgggaggtgggcagatcacgaggtcaggagattgagaccatcctggctaacatggtgaaatcccgtctctactaaaaaatagaaaaaattagccaggtgtggtggtgggcgcctgcaggagaatggtgtgaacccgggaggcggagcttgtagtgagccgagatcttgccactgcactccagcctgggtgacagaacgagactccatctcaaaaaaaaaactatccaggtgtggtggtgcaagcctgtagccccagctgtcaggaagctaaggtgggatgatcgcttgagcctgggagattgaggctgcagtgagctacaattgcaccactgcacgccagcctgggcaacacagtgagaccacatctcaaaaaaagaaagcaaagaaaactcttcattagaaactgaacatgctcgctgggaatgatattcagggcacagggcaattccttacaggggcacacacccaagggcactgctgccaccacatgggaagttgtgacgggagggaggagactgagggcaggacacaagacatggagacacacattctggtctgtctgaccatggagctctgtccacacccaggctgcctgctggctcccaaccaccacacacagtatctggcgtttctcacaggtgtcggcttctctctctcgagtccatctgctggccgtggacctggctattcggggcaggcccatcctgcccacctccccacactctctcaagcctctgtctctgagcactgcaggttttgtagtgttccctcgtctacctctgagaggccaggctgactgaagagctcctgagaaagccaccaggacccactgctaaaggggttggtccagggtcattgccaggctgggatctgaggtccccacacatagggcagggaactccccagccatagactctgatgggggtaccagtgtggactccagccctttacacggaggagggagcatgccactatggatgctgagcagcaggaggtcaggggccccgctttcacaatgtgccatcccagaagccccacagccaggatctggacctctctgacacaactccaggtcacagagacccagatgtcagggatggagggacttgggcacctgccttgctattagctccaaggctgctggcttcatgtcacagtctgtacaacagctggtggcatgagcagggctaggaccagcactcagcatgacttcctagaactctagggacttaggggctgaggacttcccagggtgaaagaccatacctgggacagcctggccaaacagggacaattgatcaccatggaatcagtggacaggcccaagaatggatgggcacatgaggtcacccaggatcaggcaggttccactgaaggaggctgcaaaagatatatccaatgtcctaaccccggaactctcagaatgtgaccttattaggtctttgcagacataattaaggatcttgtgatgagatcaccctgaataacctgggtgtgccctaattccaatgacaggtgtccttatgaaggaggcaaagggagttctgacacggagaagagtggtccatgtgaagatggaggctgatattggagtgatgcagccacactccaaggaacacccggagccgccagaagccggaagaggcaaggaaagacccccacccagagccgtcagagagcacagtactgctgacaccttgatttcagacttctggcttccaggactgtgagagtaaatttctgttgttttaaactgcccagtttgtggtagtgtgttatagcagccacagaaactaatagagactggtctagcaccctcgacagaatgtgtgtgttgtaaggggctctcctgatccctagtgatggggagtcagaggactgcttagtgtctgaacagagggttggggaagctgggttgtcctgaagaaccagcagtccccacttggcagaaagggaccctgaacttgtgggaggtgggggctgaggggcacctgctagccatgtgctaacagcatcttcggattggtccccagatgccctgctcccaggggtggctcctctgctgcaacaagaacctgcctcccagcaccagacacagcaggtgggagctgtggaccatggccgagtctcttcgtctccttgatctgctcccaggatgcactgtccaactatcccacctgtaggtgggtggcattccagccatggacccatgatctgaggctgagcacagcaaacacaatcgaggctctgggtcccaggtcccaggagcccgtccttgatggtgcattacagctctcccaggctgttcttacagtgacctcccacctgccccaggtgagcatgcttgcacctgggtgctcgcccagcctttctagttgtccttagggcttctggtgttgggaacaggatgcagagttaccaatttagggggactgagaggttaacgtggccaaggctgagccctgcagaactgcagagcaacagcacacacaggaaagctagtgaggttcaacatcctcatggaggttgcacacggcacaatgaggtcttatttgcccaagagaatgtgcagggaagtcgccaggcacggtggtgcatgcctgtaatcccagctactcgggaggctgaggctggagaatcgcttgaacccgggaggcggaggttgcagtgagccgagatcgcgccactgcactccagcctgggcaacaagagcgaaactccgtctcaaaacaacaacaacaacaacaacaacaaaaacagaatgtgcagggaagtcaacgttggtggctctgaggtgtggaggacacaggctagtgcccagctcagcgtggctccacctctctgagccacagaccaacctcacccacactgacagtcccaggggacacagactctagcccctatgtccaattctacactgtgcacgcaatgggaagaacagtgcatcatgcactgtacagcagaagaaatgtcctctgagtgcaggcacagctcccttctgtgtctgtcctcccgacagtgcctccaccctcaaggattagcaagcttcaaccctcgcaggacatccactgtgtcagggccaaacggtgctgcatcctgctctaatagtgagtgaaggaggggaccgcagacaagaagaaatgaacaagagaccgtttaagagagaaaaagacgtgaagaacatcagacagggagcagcgcgagggcgccagggagggaggcagcggattcttcgggcctctgtgaagagggggcatgaaaccggtctgcagacaaggaaagagcaaagtgcaaaggccaggatgcgggggcagagacggtagggaggccggcgtcggcctcggctagcaggtgggcttgactccgagagccgcaggccgccaggatgggtcccgggcctggagcctcccctcgcgggcttcaatgacacccagcacggaaacgcgggggccagaactacagaagcccgtcccgcccggaactcaaggtcgcgagtgctgtgtggccggtccggacccggagcgcgaggaccggaagtgcgcggcgtcacgcctctgccccggaccccgcgcgcggaggtggagaggggactggggtggtggccgcgctatgcgccgggaggtccccgcctcgcaggccgaggttgcgggtccgcgcagaatgccacttactctctggaggcggcccgcacgggtccctggtccccgccccgcatgcagcgcggagccgtcctcccgccacctccgggccgccgcggcactgagggacccgggccacagcaagcgcaggcgggaacccgcgcggggactgctgggaaacgtagtcccgtcatgtcccgctttgacgctgcggagaaagcggtgtagggagaggcttgggcttcggttatcatagaaacagaggccggctacacctaaaaggcggggcgtggacctaagtcgtcgccaaagaaacggcgttctggacggggacgtagggtcccgcccattccttctcgtgaaagcgggtgactggtcatgattatgattgatagcctcctctcccaatctgatttctaagaggtcccaacccggaaccgacttgcggttcgcaggctcccctcgggtgggagagttgggctgggaagcacctggggagctctgaagtgtcttggtgagcgcgttgcgagtcagaccgataacatcagaatctgggactgggcccgagcatatgcgcgtcaaaactcctcagttaagtctatttttttgtattttttttggtttgcttttttgagacggggtctcgctctgtcgcccaggctaatgcagtgacaccatcacggttcactgcagcctcgacctcctgagctcaagcgatcctcctacttcagcctccagagtagctgttaacaggggcgcgcgccaccacgcccggctaattttctttcttctctccctccccctccttctccccctcccttcctcctcccactatgtcgcccaggctggtctcgaactcctgtactgaagcgaccctcccacctcaccctcccgaatagctgggactataggtgggagccaccatgcctggatagtttttttatttttatttatttatttattttagagatagggtctccatatgttgcccagactggtctggaactcctgggctcaagcgatcctcgtgtctcagccttccagagtgctgggagtacaggcttgagccactgcgccaggcccctagtccggctcctagttgattctaacacgtgcggccccattggggaaccacagcctccccagcccctttgggtgttgctgactctacgggccctcccaggtaggatgaactggtcacgcctcctacccatttgtaacccccagctcttgcccccatctattgtgtggctcctgccctcaatagggacatctaattttgttggccagtccagcacatatattgcatgtaacgacccagtttgccccacctttctgcctccactgcatctgcttcagggatgctgggactgttccactccctttctccatcctttgggtgtctgcacatcgaaagccttgtcaggaggtctatctccctgcccaagtacaaaactcagggcttaccaagctaattgagggcgagcaggaggctgaagggcacttggagggctgcccgccttgtgggtcccttggtggctgaagagagttgcacaggaaggccttgacaattgtcacagagaaaggagtgcagctgctggctctgtgtgggtgtgcagatgtctgacaggttcagccactggccccaattgggacacaagtgggatttctttttttttttcttttttgagacagtcttgctctgttgcccaggctggagtgcagtggccgcgatctcagctcactgcaacttccgcctcccaggttcaagcagttctctgcctcagcctcccgagtagctgggattataggtgcccacgacctcgcccggctaatttttgtatttttagtagagatggggtttcaccatcttggccaggctggtcttgaattcctgacctcatgatccacccgcctcggcctcacaaagtgctgggattcaggcatgagccactgcacccggcctgacacaagtaggatttctcacacctgtggatgcactgctactggaggagtcttgagcctatgtggaagaacttcccactcccaggcacagaaagggcctccctctggagtgaagattctggtggtaccacaggcctggccaccacacaaaggccttgtccctgcagggctggcatggggtgactggcagccctggagtggagtttgaagcaccaatgaaaggcctaaccacttggcaggcacaggtgcgggggacttgtctggaggggaccggctatgggggctgtgacagtctgtaggctttcttcacttctacacaagcctgttgtctaagtggaccctgcagggttcatgcaggggcagcaccagagaagcatcttgtgacaatggttacacaggagcgatttcaggaatgagactgaatcaggcaaggacctggagaggaagctccagtggggctcccacccaaggggtccaactttaccaatcccacaggtccccagtctggggctcattctatgtctgtaggcctgggaccctgcacccaggagagttgtcctgctaccggccatccctccgcagaggtccccctctggctctatgctgtcttcagcaaagggcctctgctccatttcacacctctcctgagggcctggggtagcttactgcgaagcagcctcagggaatagaggcttcagcagggcatcttggcccccaacacagaatcctggttgtaggatctggaagaacagaggagaaatggaagttggcagttcccaggaggggagaaggtgctggtgagccacgaaagcaaaccccagtggctgaagcatcctggatgactcggccacatttccttaagaatctttgtgtgtgtgtgtgtgtgagacggagtcccattctgtcacccaggctggagtgaagtggtgcgatcttggctcactgcaacctccaccgcccaggttcaagtgattctcttgcttcagcctcccgagtagctgagactacaagcgcccgccaccacgcctggctaatttttttgtatttttagtagagatggggtttcactgtgttagccaagatggtctcgatctcctgacctcgtgatgtgcccgcctcggcctcccaaagtgctgggattacaggcatgagccaccatgcccggccctcttctgtctcttataaggacacttgtcattggatttagggtccaccctactaatcctagatgctctcatcttgggatccttgactaaattacatctgcaaagatttttttccaataggtcacattcgctgggtctgggtattagggcatgaacttacctttttgggggccaccattcaatccattacaggtgggcatcccatagaagcagacagtggctaggccaaagtagcccatgaagtatcagccatgggcacaagatcaagtttgggatgcggcagggccaggcttggctctgccaggcaactgggtggactgaatccagcacactccaaacgagttgataatcaggctggggacttcaacagacaaccaaggtgccagtaaaggcattaaggagctatcacggccaggtgcggtggctcacacctgtaatcccagcactttgggaggccgaggcaggcggatcacgaggttaggagatcgagaccatcctggctaacagtgaaaccccatctctactaaaaatacaaaaaaaatagccgggcgtggtggcgggcgcctgtagtcccagctactcgggaggctgaggcaggagaatggcatgaacccaggaggcggagcttgcagtgagccaagattgcgccactgcactccagcctgggcaacagagtgagactccgtcacaaaaaaaaaaaaggagccatcacaaggatgtaagatcagctaacagtaagactgtggctggtagggtggacaggcaaagtgactgcctggagagtgggcaggtggcccagcagggcccagagggtgccttcccagaagtgaggagtccagtctggggccggccactcaggatggacacaatgtaccagaagtgaggtagatctctgcagagtctctggggtcctcatccagtctgaagaacacagcaccagcagccctagatctatgaggtcagactctgcatcttatcgtagcaccttggggacctggggaggctggaccaccctggacctggtggcgggggtggggggtgcatgagtctcggctctgcagtattcaccacgccacacttgagggcacctgccctctgcagcacgatgagtcattctcatgaggtctgtaaagatgtccattatcaaatgaccatggtagccaggccacagggttcacattgacgttgcctcattgcattctcatttccacactgaaggggaaaacaggttcagaggggtgggctcactgtcctgatgagtgctgcctgttttctcccaccctccctacaaccagcacccccatgcccctcactcaagaccagggagaagcccacctagcccctcctgcaaccacacagaccccagtgggagccccaaggctgctactctgcacaggatggagggcaggggtaaaggccattaggcggtggcagtaggccgtgcccctcaccagaggctgaggtctgaccccttgaccagcccagcttcagggcatgtgtcctttcatgagctgtgactgaccacagtccaagggcccactgtggggagtcctcagcatatttggacagaaacgccccagaattggggtaagaagagcctttacagtcaggcagtgaagaaacacagctgctgggcacctgctatgtgcacgcctcagggatgggagtagggggcaggcccagccctgggacctgggtcaggtggctgggcccttcggatcccgagttggagggataaccccttggaggcagagatgggcatcagagacagggcggccccaggtggtcctggagtcgcctcgtaaaggttatgtctatgcctgctgcaggcagagacacagtcaaagtagttgctacctctggaaagtcccagttctgctcatgagcctagatctaagaggctgggacaggcagaggggtatgaaggggtcatgggcaggcagactgtccacactggctgccagggtggccaagtgagtagagtgagctggggcactcactaccgtgccaaccccacgcacggatgaggaccccgggtcgaaggcccacatcctcaatcccacgcaatagttcaggccctgtgagagggttcgctgtctgctcccagccagggctgagctgttcagaggccctacctgttcagaggcagctgggggaagggacagaagttggggggcaggggattgtgtgctggcgggaataatctccttcatctcatggctaaatcttccatccctcctttcaacctttggccagaaacctacgtttctgacccttggagaggtcggccagttcaagaggcacccctgagagccacgtctgcagacacgagggcctcgtgacgtgagccctgagggcagggggctgcaacccctcgcgcgggctccccggccgtggaggacacaaggacaaacacgaagggtccccgacctgccgaccccctcctcccggacaccgcgcgtagcctgtaggctacctccgcgctccacccagagacgggtcgcgctgctcccgccgccgcaaccccgggccctcgtgccggcggtctcccctcttccacgggcgagattactgcatagcagaggtgaagggcgcggaggctgtgggggaacccagcgtggtatggcaggaaaggtcgagcagggaaacaggcccagccagaggctcgggatccggggctcgcgagcgtggtgctcctgggccgggcggtgggggaggggccgcgtgtggcaggcacatgcgcacggcaacctggacctgcggagggcggcggtgaccactgggcctcactccgctaacccaggtccgcatcaggcgcgtgccggtgaggcggctgtggccgcggcgaggagtcagagggaactgaactggctactcccgcggcaggtgggatttaaggtcagcagctgaacaaagaagcgagcgctggccagacttttttctttattagacatggctgcgttggtctcacggaaatctctgcgcttttgcaggcgcccacaagacagggcaactacggggtagcggacatccgccaggcacgcttctagggccgcttctgcaactgcgcatgcgcttgggctgcacccattccgtctagcccaaaaggttcctctacaaccttcctccggattggtctatagggacacgatggccttttacgcaagcgtcacccgtgctgacccggaagttttcttcccagttaaaagtgttggcccgcggcgcgcggcctcttcctgtctgtaccagggcggcgcgtggtctacgccgagtgacagagacgctcaggctgtgttctcaggtgagaccgccgcggggccggggatcctagggacggttcatggtctttcggggatagtgccccgcggcctgggccttttctcattaggtctcatttctgtctctggaaaagaaaatgtagaagaaacgggcgcgggccgagttactcttgacttctttctggtgctccgccgcttctagcttttccccatagcggggcttggggaacttggtttgaactatgcggttgtactctgagataggaagtttccatttcttagggacacgatgccctcttttgctctgtgtaactttccccccgtaatagcagcccctagagccttcatactgtcggtcaagaatcgaaacctttgggttgattgtgccacacggtacctaccgtggtccttgatgtcatataacggtcccgcctcacggccaaagaaacagtccgagacggaacgttgacttgggtcaaagaccatgtaaatcgcgagattgtggtttgaattacagcccatgcagtgtgaggacgtatggcatctgctgagccattataccttggtcccagtgcagcagctgttgactggtggctgccaagtcttgggcccaggggttctaggtgaaagacagatgcttcttgctgacagctgagtaatttttctagtgcttgaaaacacgttcacggcctttcttggtcctttgcgaccccccagttcatcactagatggcggctagcctcagagttgggaatgagtgcgcctttgctccatgctagctgagctctgacgtttttttcctgtcatcaccctgtcccaggatgaccgagtgggagacagcagcaccagcggtggcagagaccccagacatcaagctctttgggaagtggagcaccgatgatgtgcagatcaatgacatttccctgcaggtgaggggaacttggtgattggccttcctggctgggggcggacattattccaggaaggcacacatcaaacttgttgctgtgccattaagtcaagaatagagatcataacaggtaaagaagggatcccttgaccaccacatctaccacatctgctcttacgtcctgttcaaagatgactacaacttctgtcatgagaggactccttcaccagaaggagcatcacatctcacatatggtatttttgttactgtttttgtagtaaaatacataacatccagtgtcattcttttgcatgtgaatatccagttatccagtaccatctcctaaagagatgttttttttccctcaattgaatggccttggccacttgtcataaatcagctggccgtagttttttttttttttttttttttttgagacggagtctcactctgttccctgggctggagtgcagtgacgcgatctgcctaccgggttcacaccattctcctgcctcagcctcctgagtagctgggactacaggtgcccgccactgcacctggctgatttttttttttttatttttagtagagacagggtttcaccgagttagccaggatggtctcgatctcctgacctcgtgatccgcccgtctcggcctcccaaagtgctgggattacaggcgtgagccaccgcgcccggcccagatgtatgggtttcattacagactttcagttatattccactggtctatatgtctgtctctatgccagtaccacactttcttgctttgtattaagttttgcaattgggaagtgtgagttgtcctactttgttcctactccgtacggttttacacataccctttttttcccctccccatgaaggcatcattaagaattttgtgggccttaagaactttagcttttgtgagcccttcctccattaaaagaaagtgtttgaaattatattttgtgactgcattgatataaagatgaatataacttgggttgcactttattcactttcctcctctttttttttaatcattaaagttttatctttgagataagatcactctctgtcacccaggctggagtgcagtggtgtgatcacagttcactgcagcctcaatacacctgggctcaggggatcttcctgtcttagactccaactagctgggaccaaagatgcatgccaccaaacctgctaccttttgttttataaagaatgaaaacttttttgttgtctgtaaagatgtcaggggacttaggcactatgcctaatggataattcagccttgtttttcactctgaatatcttgtagatcttggcttttctttccttcaggggtttatttcggggggtccaaaaacattttaaatattattattattttttgtttgtttatttatttatttatttttttgaaacggagtttcgctcttattgcccaggctggagtgcaatggcacgatcttagctcaccacaacctccgcctcccgggttcaagcaatgctcccgcctcagcctcccaagtagctgagattacaggcgcacaccaccacgcctggctaatttttgtatttttagtagagacggggtttcaccatgttggttaggctggtctcgaactcctgacctcatgatctgcccggccacattttaattatttatttattttttgagacagagtttcgttcttgtcgcccagtctggagtgcaatggtgcgatcttggctcactgcaacctctgcctcctgggttcaagcgattctcctgtctcagcctcccaagtagcggggattacaggcacatgccaccgcacccagctaatttttttatttttagttgagacagggtttcatcatattggtcaggctggtctcttaactcctgacttcaggtgatcagcctgcctcagcctcccaaagtgctgggattacaggcatgagccaccacgcctggcgttatttatttatttgtgagacagagtctctctctgcctcccaggctggagtgcagtggtgcgatctcggctcactgcaacctctgcctccccagggtcatgcgactttcctgcctcagcctcccgaagtgctggggttataggcatgagccactgcgcccagcccacaaacattttcattataggcccagataatgttttagactttgtgggccacactggccactgttactttttttttttttttttttttttttttttgagatggagtcgctctgtcacccaggctggagtgcagtggcacgatctcggctcactgcaacctccacctcctaggttcaggtgattttcctgcctcagcctccctagtagctggaactacaggtgcatgccaccacacctggctaatttttgtctttttagtagagacagggtttcaccatgttggccaggctggccttgaactccttgatctattaaacgtttgttaagtgcctgttccactagggaaataaacatcaatgggagttcactgtattttaaacacctgtgcagggctccactgttgggccaaacccttcctggggaatttggtgtttgcaattttttgctgcatagtgaaagccctgcgtgaatgcccttcacgagactgtgagttttttttttcttgcagccagactatgaaatagtactgagagtttcagtgtcctgtgttcttttcccatcattccttgtatttgtagaaacaggtattttgtgtatattctcagaggcaagtgatagaatggccttgggtacattttgtaatggaactatcaacagcagtctccttcgaatgcacatagctcctttcttcccctttacatactcaaggttaactttttggcatttttctagatttttgtgtggggatggctatgtaagtataagaagacttgttaaatgattgttttaaaactgtggttctgggccgggcgccgtaatcccagcactttgggagactgaggcgggcagatcatctgaggtcaggggtttgagaccagcctggccaacatggtgaagccccgtctctactaaaaatacaaaaattagccttgcatggtggcgtgcacctgttgtcccagctacttaggaggctgatgcaggagaatcgcttgaacctgggaggtggaggttgggatgagctgaaatcatgccattgcactccagcctggccaacaagagcgaaactccatctcaaaaaaaaaaaaaaaaaaaactgggctgagcatggtgacgcatgtctgtaatcccagcaacttgggaggctgaggcaggagaattgcttcaacccaggaggtggaggttgcagtgagccaagattgcaacgttgcactccagcctgggtgacagagtgagactccatctcaaaaacaaacaaacaaaaaacccaaaaacaaaaaagttctcagccaggtgcagtggcttatgcctgtaatcccatcactttgggaggctgaggcggacggatcacctgaggtcaagagttcaagaccagcctggccaacatgtccaaaccccagctctactaaaaatacaaaaattagcctggcatggtggcatgcacctgtagtcccagctactcaggaagctgaggcaggagaattgcttgaacctgggaggcggaggtttcagtgagccaagattgcaccactgccctccagcctggaaggcagtgagactccatctcaaaaaacaaaaaaccaaaaaactgtggttcctactctggggtggttggtttcctgtcttagagaacacttagcaatgcctggatacatttttagatgtgaaaactgaccggggtggtgccaggcactgtggctcatgcctgtaatttcagcactttgggagcacaaggcaggcagatcacttgaggtcaagagttcgagaccagcctgctcaaaacagtgaaaccccttttctattaaaagtacaaaaaatttagctgggcttggtggcgcgtgcctgtaattccagctactcaggaggctgaggcaggagaatcacttgaacccaggaggcagaagttgcagtgagccgaggttgcgccactgcactccagcctgggtgacagcaagactcagcctcaagggggggaaaaaaaaaactaggccaggcgcagtggctcatgcctgtaatcccaacactttgggaggccaagacaggcggatcacaaggccaggagttcaagaccagcctggccaacatagtgaaacctgtctctactaaaaatacaaaaaaactagctaggcttggtggcaggcccctataatcctagctactcgggaggttgaggcaggagaaccatttgaacctcggagtcgtaggttgcagtgagctaagatggcaccactgcacaccagcctgggtgacagtgagagactcaaaaaaaaaaaaactgaaggggttgccagtggcataccagatggctgttaaacatcctatagtgtgcaggacagccccccagacaattatctggtccaaaatctagtctccttagattcccactcttccattacgaaggaagtgtactttttagcgacttggtaaagtcacctgttcagggtttttttcctcatggtggatggggcttacatccaagtcccctgttgaggcataccaggatcccagacagctgttggactaccccgaatgggtacttgatctctcctctggtgtctggccaacgcccatgctgctcctgaccattttcccttcatttcctgctccctgctgccccaggattacattgcagtgaaggagaagtatgccaagtacctgcctcacagtgcagggcggtatgccgccaaacgcttccgcaaagctcagtgtcccattgtggagcgcctcactaactccatgatgatgcacggccgcaacaacggcaagaagctcatgactgtgcgcatcgtcaagcatgccttcgagatcatacacctgctcacaggcgaggtagggctctgtggcctggtgagggcaggctgtgccctcagtacacccgaaagccccacggagtgtatgtcaggcttatcccctgtgtggtgtggtcactcttgttttaggtatgaggaaaggggaggaatgcatggggctggatgtcaggctcatatcccccttctctctagaaccctctgcaggtcctggtgaacgccatcatcaacagtggtccccgggaggactccacacgcattgggcgcgccgggactgtgagacgacaggctgtggatgtgtcccccctgcgccgtgtgaaccaggtgagcctggggcttatgcacgtggcagggtggacacagccacgggagtgggtggggtcttgcctggggcaggaaggctcctctctgtctgcatgttttacctgcagcatcacttcctctaggaagccttcctggattcccaccctgcataggggctgatccaggctctgggtcctcttcgggaacacatttggcagaggtcttctttctttcctttgggtgtatatttttacactgtgtgtatatgtactttttttttttttcttggacattttgagaatcagttgcagacattttgattgtgttttccctgaacactgcaggtgtctttaaaaacaaagatgacctacccccgtcgtcacccccaggaaggaatttatattcacagcaatagtcgttgttccatttagcatctgtccccagaatgccagaatgccctttatagtggcgcattgtcaattgggtccaagttaaaagcaaatatattgccttgttttttagaaataattgagatggaatctcagggtgttcttgaattcctggtctcaaatgatcctgtcccctcagcctcccaaagtgctaggattacaggcatgagccaccacacctggccgccttttttgttgtcgtcggtttttttgtttgtagaggtggggtttcaccaagttgctcaggctggtctcaaactccctgccaaagtgttcctcctgcctcagcatcccgaagtgttacaggcgcaagccaccgtgcccggccgtctagcagtttgctgttgaggcaggtctcaatctcctgtcactggggacgcaacttcagcctgtgtgtgtgtgtgtctggacacttgctcttgtgaccctctatctgattgcaaatcaggcatgatgccaccacctcttgtctcagtgggcctatgggtgacaacgtggctggcagcatcagttgggagtggccccagggtgctggaggaccgcagtctgtccttctagcctgacccctgctgtcttcctaggccatctggctgctgtgcacaggcgctcgtgaggctgccttccggaacattaagaccattgctgagtgcctggcagatgagctcatcaatgctgccaaggtgggtgagggcactccggttggggggtcttaagttgggcatttgtgggggtccttcagaattcagagctgtgtgtctccttgcagggctcctcgaactcctatgccattaagaagaaggacgagctggagcgtgtggccaagtccaaccgctgattttcccagctgctgcccaataaacctgtctgccctttggggcagtcccagccacctgtgctgttgtctgtcttcggtggggggatgtgggtggcatagccctggtggccttgggagctgctcaccttcctgacctgttggcctgtggggacctggaagtattgctgactcagaaccatggcaccccagggctagcaggtggggcactggatgcaggccaggctgcctggagtgtcccagcaggtactggaaatgagatggggttatccataacttctgagggcgtggcacatgagatgttgctgtggtctgggtggatgggtggcttgggtgcctgtgaggtctgggtagtcacaagaccatcctgagaggcttgtcaccttgaagtagcactggggagaggaggaaagctcagctgtttagggcacacgatttcagacccctagcttcacccccctcttggagtgtggggtggtttcacactggcgaggttgtgctcctggttacctccccggctacactggttgtggctgcaccctgggcctgcacacccagtttctgtgggctgtacgggttcccttctgccagtgtccatgcagtgtcatcaggctgctggggacaggttgggacccacccagggccacaggctggtgactctggtagaagactcatcaggttctgaagggtggggtgggcccaagcccacccaccgtgtgccatcacccttccaccgcccccaacatctggccaagacaggcttggtgttcatcctggtggggctggcccagggggcggggcaggcagtcaaacgggtccagcgggtacctgggacctggaggggtggtgccggttgagcaccctccccctgggagggtacttttgagcccagctgctggcaggccaggaacagacagggacacgccactggccagagggaggaggcttccacaggtaggaaggcgcccacaggctggctgcggtctgtcattactctgtggggggtgcctatctctgctcctctgtgggtcaggtcctttccatccctgtctggggtcctccccatctccgtgttcaactgcggtctgtctctccgtttccaattcaggaactggtaccccgtgggtccattcctatccccagtctccgcctcgggcctccccatctcccctgctcctcgacgctagctacacccttctcgggatggggtgctctgtactgggggatcctctctaaagtacagtccccagtcttccctggattccctgctggtctcagaacccgctccaggctccaccgcctccttccctgcctgacctcctctcctcccaggtccatccggatgccctgccctcggccgttctggctccgccattcccgggccccccagggctcgggtcccagctccccaggctcgctctctgcgccccgctccccaagcagaggggaagaccaggaggaggaggaggaggaggaaggggacggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccggggtcgccctgggcccccgcctggacgccgcgccccacgggccctgacctggacacggccctgccaggaactgcagaagatgcgctggagcccgaggcgggccccgaggacccggcggaggccgagaggacgctggacaggcgatcggatggcacgtggggcacagaggctggccccggctgggccccgtggccacggggcgcgaggaggctgtggggctcacaataagtgcgccagtactgcagtcctgcctccaggcctggcacctccgtgttatctggggcccttagtagggcgcgcagcacttacctgtttctccagattggggcttagggcaagcatccttggcattgtcaccatggggctggaccctctcaaggagcaggcaccgcagtcgtcccacaaggatcctctgggaacacccctgacccccattcttgtggctgtccagcggagggtgccctgaccgtgacctctataagggtcctgctggggcttgctcctgctccgcaacccctactccgtgggggtgcagttggaagcatccctgatcctcatcccttgtaggagtccagctgtggacgcccccgactgacatccatgcaggtgcccagccaggggcagccccacacggatccttgaacgggtcttgctgggagtgcccccagtcatcctcaccacagattcctgggggagcgtccttgccagcactggaggccaaagcactcatccttcggattggccataggttgcaggggcccgcctatctttggagggcagagctgctgctgctattcttccttggtcacctcctccccaactggctcattgcaggggacgtcccaccactccacccatctgtggagtttgttttctactgcctgcaggctgggcctgggtgggctccagctgtctacatgctggtcccgggtgtagagttgccatcctgtacacctggttggggctggggctcaggcttgaagtaacagggtgtcctggccagggctggggaggaacttgagccttaaagactggctcccgccccaatcctaagtcccaaactgctctgggagcctccacttccccctgggtcgtggcttctaggatcctcccaatatgctgtggtgcagctgtgcttatcatggctcagaggccaacatcaccccaggggtcagacagaggcagacaatggtgggggtgggagtcctggacctccttggttagccagagggatcctagtccctttccctggccaccagagtccccatcacccccgattaatatcttgatgccagttactgcacttcttcctccagggctccatctgtcctgcccagcctcctttcttgtacctcgaggtgaaccctgagccttcccaatagacagcagcctccagggaaggtggcatatgggctcctgtcctcttcctcccagaagtcttcctgggttagttatgggggtagatggcagctattctctgtgcagactgaacctggggcttctgtttcctcccaggccctgcacaccacccccccaatcctgcctcacctcactctgggatggagtgctgtgttttgggaatgggcacccagcatgttccaaagcgaaacgtgacttctatgtggctggaggctcctgtttgatttgttaacgtgtgtcctcagcaccagcatacagtaggtgccaaacaagggagtgacagaattgcaggtgacccaggcagcctgggaatgcaccctgggcccaggactgtctagagctagctctggtgtgagctgctgcttccaggtgggagccagaggaggaacactagggagtccacagtgtgtcttcccagaccagttcttgcccacacccacatgccgatgtcacccacaggggctgggaccagtgtactgggtcactgggcagccacagcccagcctcatagggaagaaacctggtcagacagccgcagagttggtggtctattcattttctgtggctgctgtgacaaaatacccccaacttaattatttagaacacgcgtttattttttttaatttatttttgaaacagagtctcactctgtcgcccgagctggagtggagtggtatgatctcggcttactgcaacctccgcttcccgggttcaagcgattctcctgccttaggctcccaagtagctgggattacaggcgcccgccaccatgcctggctaatttttgtatttttagtagagacggggtttcaccatgttggccaggctgatctcaaactcccggcctcgtgatttgcctgccttgccctcccaaagtgctgggattacaggcctgagccaccgcagccggccttatttcatttatttatttatttttttgagacagagtctcgctctgtagcccaggctagagtgcagtggcgcaacctcggttcactgcaacctctgcctcctaggttcaaatcattctcctgcctcagtctcccaagtagctgatattacaggcgcccgccaccacacccggctttttgtatttgtaatagagacggggtttcaccatgttggccaggctggtcttgaactcttggtctcaagtaatctacccacctcagcctcccaaagtgctgggattacaggcatgggccaccatgcctggctaaacacacacttcttatcttgcagttctgcagtccagaagtcaacgatcagtttcactgggctaaagttgagttgcccatagggctagttctttctagaggctctaagagagaattcatttcattagtttttccagcttctagggctgcattccttggctcctggctccttcaaagccagcagtgcagcatcttcagatctctctgaccctcctacctccctctttcacttataaggacactacaagtacatagcgcccacccgaataatccaagatagtctccccatctcatgatcattaatttaatcacacctgcaaagtccattttgtggtgtcaggtaaaagattcacaagttccagggattcagaccgggatatctttggaggccattattctgcctaccatagggtctcagagatcctcctcattgcttccctctcccacccaacctaggggagtgggggtgtgcaatggtatttctgacccagacaggccaagcaggggagtcagaaaggggcccttgcctggtgttgcacagaagagggagaggatgttctgtgcctgagggtagaccaggaaggctgcctggaggagggagctgtatcctaaaggatgctcaggagctggcattgaggccagtggcatagcctgcacaaatacaggaggacctggggaggccaggggtggggctgggggtattgggtggggctggccgcattctccgtcttaaccagctcgctcctaggtgcttttgtggcttctgcactctaccagcttggagccaggggcctcattctctcttgcagtaaaatgaggctgatgactgagcctaggagttgctgggcatctggtctgctgattaccaccttggtgcccaatgtctgcctgcctatccactgctttcaaacaaagaggctgcctgacaccacccagggggacgcctcccacccttgcccagcctcagccaatctcctctttctcttcttcagagctggagttgtgccctcctatcctctctctgcccaccccatcactgctgtacaccctgccccttggcacttcggccccggacttgctcctcctggcaggcctgggtgcttgtgaagccgggtgccagagggcccagcacggcacggcctttgattctgttttctgtaaatcgacgacaataaattctctttttccttcatccacaagtgtttactgagcgccttctgtgtaccaggccgcaccagggtgcggagcaaagaccaacctcagggagcagatgaggtccaggcggctgaaccaaccgaaccatggttctggtagcactgcctcccccgccaccctcagggggccctgctccccaagcccttcccaaatcctgccgtccagctctcctccccaccttgcaggagggacgccagggcccggttttcgggttccgccattctttcctcaatgagggtcggagaggtccctgcccacgccagacccgtccccggccgtcgcggcaccctcttgtgatcaggcggagggaccaagggccaagagcggggcttcgccggacgctgggagcgtcactgtccagactgacagatggggaaactgaggctgaccagctgggcagggcgtgcatacgaatctgggtcctggaagcgttctgcaagatcccttctcacctcaaccgcacgtgctggcatccttgggtttccctccttccccagatcacagccgcacttctctcctccgccctcatagtcacggccctgccttctccctcctcttgccccgggcgggccccgcccagaatgcggagaggccttcgaggaagcgcggaccaatcggaggccctatgtagggctgaagaggcgggactctggtcgccataacaactcatcacgcctgtgctgcgcgcgcgcgtcgccttagtgccgcagccctattacgtgaggtagggaaggcgcgccagactcgacggccaatcagggacccgagggcgatgttgccatgacgaccacgttgcgctggagattgcgacgggggctgaaaccgcggggaactcggggagcgagtggtgagaacagtgagcaccagcactccgatggcgctggcgagaggaaaggctgcggcgcgcagagcgaggctgcgggaccccaggatgggggacaggaggctgcggggcctcaggtgagcagcaagcgagagaccagtcccttcgagcgccctcacgcgttttgtccccacgccacgccggggacgagtctgtggcacagactcgtccccggccccgcgggcttaagttgtctgggggctgtcgctttgagtacagatcatatagttatgaatacattttaacgcagatccaaacacatagtataacgtgaggatcctatataaagtgagactcctcaaaaaaaaaaaaaaaaaaagatttttttttttttttagccggacgtggtggcgggcgcctgtagtcccaaccactcgggaggctgaggcaggagaatcgcttgaagccgggaggcggaggcttcagtgagccgaaatcgcgccactgcactccagcccgggcgacagagcgagagactccgtttgggggggtaaagtgtttttttaaatgcagtcaaattcgaacgtaggttgataggatcacatagttgatccactctaaccccacacccacttgcagacctggttagtgctgaggtcctctcatcccagggagtaggctagagttcgcactggctcccctggggcccggcttggcgtggcaaagctgggagtctcgccctaggttggggtttcctctgctctgtaagcctctgcagaaggagcagagggtggtgggagaagaagtgcccaagaggggccacaagctacctgtgatctgtgtccccccaccagggggatgggtgctttcatttttatcgttgtggaaaatttcacattaagtacttctccaaagaatctcccagacatctacttgttctttcaaaacataacagatttttttaaaaaacaatttacataccatataatttgcccattttgagtgtacaattcaaggctgggcgcggtggctcacgcctgtaatcccaccactttgggaggctgaggtgggcggatcacctgaggtcaggagttcgagaccagcctgaccaacatggagaaaccccatctgtactaaaaatacaaaattagctgggcgtggtggcacatgcctgttatcccagctcctcgggaggctgacaggcaggagaatcgcttgaactcgggaggcggaggttgcggcgagccgagattgcaccattgcactccagcctgggcaacaagagcgaaactgcgtctcaaaaaaaaaaaaaaaaaaaaaaaaaggccgtaggtctgaatagacccctcacctaagaaaaatagatacatagctggcaaataggcacatgaaaatatgctccacatcatatgccattagggaactgcaaattgaaacaataatgagatactactatacatctattagaatggctacaatgcaaaacactgatagcaccatatgctagcaaggttgtgaggcaatgggaactctcgtttactgctgatagaaaggcaaaatggtatagccactttggaagacagtttggcagtttcttacagaaagttaaatatagtcttaccatatgatacagcaatcacactcctgggtatttgcacaaatgagttgagaacttatgtccatgcgaaaaccacacaaattattatagcagctttattcataattgctcaaaacttgaatcaacccagatgtccttcaatagataaatggctaatctgtgttacatccacacaatggaatatcattcagcaataaaattaactgtgctaccaagttatgaaaggcatggaggagtctgaaatgcacattggtaagtgacagaagccagactgaaaaagctacatactgtatgattacaagtttatgacattctggaaaaggtaaagctatagagacagtaaagcagtgactgccagggactcagtgggagggagggagggagggagggaggaatgaatagtagcacaagtaatttttgggggcagtaaaagtattttgtactatattgtaatggtggatacatgaatttatgcatttgtgaaaacccatataatgtacattaataataatgtactaatattcattttacaatgttaacaaatgggccgggtgcggtagctcatgcctgtaatcccagcattttgggaggctgagcggggcggatcacgaggtcaggagatggagaccatcctggccaaaatggtgaaaccccaactctactaaaaatacaaaaattagccgggtgtggtggcacgcgcttgtcgtcccagctattcgtgaggctgagacagaattgcttgaacccgggaggcggaggttactgtgagatcgtggcactgcactccagcctgggtgtcagagcaactccgtctcaaaaaaaaaaaaaaaaaagaagaaactaaaatgaggtccaatgaagtagtgccaggaaaaacataaatgaactaactattaagcccaggaaaggtaagtggttaagagagaactttggtctgagacttcctggaatcaaactgtagcactgcctcccactggctttatgactcagggcaaatacttagcctatgggagactcaggccctggaccctctactcctctgctccacccgtgggagagatcaggcccatctcacagaggaacagattttttttttttcttttttttttattgatcattcttgggtgtttctcgtagagggggatttggcagggtcacaggacaataggggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatcaacaggatcccaaggcagaagaatttttcttagtacagaacaaaatgaaaagtctcccacgtctacctctttctacacagacacggcaaccatccgatttctcaatcttttccccatctttcccccctttctattccacaaaaccgccattgtcatcatggcccgttctcaacgagctgttgggtacacctcccagatggggtggtggccgggcagaggggctcctcatttcccagtaggggcggccgggcagaggcgcccctcacctcccggacagggcggctcgccaggcggggggctgacccccccccccacctccctcctggacggggcggctggccaggcagaggggctcctcacttcccagtaggggcggccgggcagaggcgcccctcacctcccggacggggtggctggccaggcggggggctgacccccccacctccctcccggacagggcggctggcagggcggggggctgacccccccacctccctcccagatggggcggctggccgggcagaggggctcctcacttcccagtaggggcggccgggcagaggcgccccgcacctcccggacggggcggctggccgggcagggggctgacccccccacctccctcccggacgggtcggctggccgcgcggggggctgacccccccacctcccttccggacagggcggctggccgggcggggggctgacccccccacctccctcccggacggagcggctggccgggcagaagggctcctcacttcccagtaggggcggccgggcagaggcgcccctcatctcccggacagggcggctggccgggtgggggactgatccccccacctccctcccggacggggcggctggccgggcggggggctgacccccccacctccctcccggacgaggtggctgctgggcggagaggctcctcacttctcagacggggcggctgccgggcggagatgctcctcacttcccagacggggtggctgctgggcggaggggctcctcacttctcagacggggcggctgccgggcggaggggctcctcacttctcagacggggcagttgccaggcagagggtctcctcacttctcagacggggcggccgggcagagacgctcctcacatcccggacggggcggcagggcagagatgctccccacatctcagacgatgggcggccgggcagagacgctcctcacttcccagatgtgatggcggccgggaagaggcgctcctcacttcctagatgggatggcggccgggcagagacgctcctcactttccagactgggcagccaggcagaggggctcctcacatcccagatgatgggcggccaggcggagacgctcctcacttcccagacggggtggccgccgggcagaggctgcaatctcggcactttgggaggccaaggcgggttgctgggaggtggaggttgtagcgagccgagatcacgccactgcactccagcctggacaccattgagcactgaatgaacgagactccgtctgcaatcccggcacctcgggaggccgaggctggcggatcactcgtggttaggagctggagaccagcccggccaacacagcgaaaccccgtctccaccaaaaaaaatacgaaaaccagtcaggcgtggcggcacgcgcctgcaatcgcaggcactcggcaggctgaggcaagagaatcaggcagggaggttgcagtgagccgagatggcagcagtaccgtccagcttcggctcggcatcagagggagaccgtggaaagagcggggggggggggagggggagggggaggagggaagaggaacagattttcaagaacgatttgaggatatgtattagcccaggacatgttatgggatgaccagtgtcttcaaactaggcagaaagaggggacagggtacaggagtcaggggaagtaggcgaaaaggtggactgtttagtaggggatcaggaacatagaaaagtggcaaggctagtgaccttggtacccagacaccaggggtataactcaggtaccaggtgtgagaacagctcaattccagggatacttccatccccagcttgcaatctccatggctgagcctctttgataacttttgtgctattcctggtttcaagtctacctggtccatcaatcagtgctcttgtctgcactccagttgggggaactcatgaactgtaaagggcaatcctgtgggggaatgaacaggttggtcagtccagcctagggcagactgacccaccatgacagtccaggggtactgatgacaggcatgtaccatgagcttgggggtgtcccacctgtgtctccactggagagaatacacaggtgtcactgaggaacagggttgcaaggactgaggatatggggtcagctgaggacatgttaaggagaggcaaacattgcacagctaggcactaaggagagagaaagggacacagcggggcatggccagaaaactggaattgagctgagtggaggcaccaagacctgcgagggcacaggctgggcaccaggtgtgagaacagcccactcctgggggcattcaccaggggtagatctcttcagggtccctctgccacaactagttttgagttcatatggtccacctgctggtgggaatgtagaagccttcagacctatgaaggatgatgagtttttgagagtccaggccaggagaggccaaaacaccatgaccccagcaagcgagaataatccttactccaagacaaacacagacctgcaaaaaatgaacattcagggaaggctcccaggcaggacccagtgggcccacacgcacccatgtcagtgcatgcagtgcctggaatcttacaggaagtgaccgagctgaacgtgaccagctgtgaagattcagagacttctgagccccgatcttggccactcacggcccttgggtagaatgtgtggggtgtccactcagccacttgttagaggaggtggcatgatctgggcctcagtgccacgaccaacagcgacttccaaggggaacatggaaagaacagaggaaaaaaaccagagttgaggctggggagagttatggtgccagtggtctcacccagcactgagtgcaaagttctccagcaccacttcaggtagaagctcctctggaccttgcctaagaactccgttcgtccgggaggacgcaggcccacctgctctaacatgaacgcgtctgaattcagcggaggacacccaggagcccggttattctcctgccagcgtcctcccctgatgtgtccctgaccccgtgctctgacgtactcagccatgtactcactctcctctcccaggcccccatacctgagatcaccatggcctgatatggggtagactacaagcctaccgtgcctcagccatgtgcagggcgacctgtccctggcatccacacctgtggcccatacgtcgcccgcattgtggggcgccgaaaacccaacacaactgaaacacaactgctgaccttccccctaagccgcctctaaacgaggtccctcggcccctggtcccagccgctctttgaagacttgcctgatgacaggcatgtaccatgtttttggctgggacatttttctgagccttgctccgggctccgtaaagcggacacggtgccagggagagaatttcggggcggttgcgggcacaggcgggcttctgcggaggccctggcgaacgcccccgcgcggcgcggtccgatggccccatggggccgcccctccactgtgaggtcaccggggttcagcaacattcactgcggctaggacgcgtacaggtcactgaggcagaacttcccgattctcgcgccttcgttcgtttctgcggaccagcggagactcctccacaccgcccaccgcccaatgatcccactgccgcaaaccgccccaaagccagcgccgaaagccgacgccggaagccccgccccacgcagggcccgcccgaacgttcccgttcctgggccgccattggccaagtctgaacggccccacgtcgaggctccttatgggaaatgtagttcacgtcccgcttcaggagctagcggcgccctcccttatcgccttggcaacgacccagccgcgccgcgaggagagccgggaatggaggtcgtggcgtgaggggcgccgagcgaggggaggcgcgggccacgggagttccgggagttccggcgttgcccggcagtccgcagtcctcggcgggaaggctgtcccggcgcctcaggcagctctgcgtgggccggggtgacttcctcgcgatcccctgcgcgaggtgaagggcagggacctttgccgcgccttccacgcgccgtgccccaccggcgagtggctccatcttcctcagacttatcgctcgcggacaggcgccgtgggtctcccgggcctccgtaccgtcctccttcccagcggctccgggaagcggttccctgtcttcggacgcatttcacccgcgcggggagagcttcccgggaaggttccacggcggccgagggtttccgcgcccgggacgcgtttcggctgaggccgtgggtccagtccacgggttctgcccgcacggtccaatggccggggaggcggaggtgagcagaggatgcctccgaggaatgagggggcccaccaggtggggggcggcgtgtgccagggcagagttggaggagggcaggagatctgcgtatgattccagggggaggtctttgatgcacggctggggcatgcccttggcagtgggagccattggagatgtgccgcaggactgggacaggatggggtcgtagttgctgtgccaggccctctggagacgcatgtgcagaacggcgtgtggaaggccaggcaattgcctatagggtaaactggggacgttgtgctgggggtgtacagttttaggcattctgttgtccagttttgtgcctgttgagcaggaggcaaactggaccctgggaccaggtacttgagacctaagggagaaggatgagcataggtttggttgcgtctgagaggtatgatctctgggactggaattggcaggcaggagatagagtggagcctgtgcccttggccctgcacatagatggcatcagtctggtcaccaacctgatgtcgctttgggctggacacagtttccagtagtaacaccagaagcatcaataacaccagcagctctgatattcctctgggataggagaaggaaggtataagggtatgtgtagggagtaaggtggggaagagtttagagctcatagggaaagataatgtcagggggagatgtgataggaccctgagatacaggtcaagggcctgaatgtgtccatctgtccatattttggttgtttttttctgcccatcattgaccccaaggctcagttggacccatcattgcagggcttggtgatgtttgaggatgtgacggtatatttctccagggaggagtgggggctccttaatgtgacccagaagggcctataccgggatgtgatgctggagaactttgcactcgttagctcactgggtaagtctcttacactgtcccccagcacactgactaccccctcattttccccatgcgaagttctgtccataacgaagccagaccatgggggctctttccttcccagattccctgttgtaggtattgtgggtggtgggactcggtggtgggactcggcggtgtgctctttccctgcctttctctgagcaatgctgttggcagcctcaacacctcttgccccaggagctagtggagcaggttttgggggtcagatgtttcatagtttgcccaccaaatcccaccaagctctgccttttcctggccatgtgactctcttgaagacatggcttctctgtgctctgggttttgcctccctacaaaagaaattttacagggacctccctgggccaggcttgagccatgaattttaatcagaacggtttgggaaatatatatatatatatatatatatatatatatatatatatgtgtatatatatatgtatatatatgtatatatatgtatatatatgtatatatatgtgtatatatgtgtatatatgtgtatatatatgtgtatatatgtgtatatatgtatatatgtgtatatatatgtatatatgtatatatatatgtatatatgtgtatatatatatgtatatatatatatgtgtgtatatatatatatatatgtatatatatatataatttttttttttttttttttttttttttttttgagacagagcctcactctgttgcccaggctggagtgcagtggcgcaatctcggctcaccacaacctctgcctccagggttcaagcgattctcctgcctcagtctcccgagtagctgggactacaggctcgcgccaccatgcctggctaatttttgtatttttagtagagacagggtttcactttgttggccaggctggtcttgaactccggacctcatgatctgcctgccttggcctctcaaagtgctgggattacaggcgtgagccactgcgcctggccacaaaggtacttctttcgttaaatttattcctaagtactttattcttcactgttaagtatggtgttagctgttggttttttgcagatgcccatttcaggtgaggaagttcccttctctttctagttcatttaatgtgtttattaagaaaagtcatggccaggtgcagtggctcatgcctgtaatttcagcattttgggagggcgaggcaggtggattacctgaggtcaggagttcaagaccagcgtggtcaacatggtgaaaccccatctctactaaaaatagaaaactagccaggtgtggtggcacatgcctgtaatcccagctactagggaagctgaggcaggagaatcgcttgaacctgggaggtggaggttgcagtgagctgagatcgcaccattgcactccagcctgggcaacaagagtgaaactacgtctcaaaaaaaaaaaagaaaagaaaggtcactagattttgtcaaatgcttttccaatgtctaatgaaatgatcatgtgatttttgtcctctcttctgttaatgtagtatattagaataattgattgccttttctttttttgagacggagtcttgttctgtcgccaggctggagtgcagtggcgcgatctcggctcactgcaacctccacctcccgggttcaagtgattttcctgcctcagcctcccaagtagctgggactataggcgtgcaccaccacgcccagctaatttttgtatttttcgtagagatggggtttcaccatgtttgcaaggatggtcttgatctcttgacctcgtgatctgcccccgtcggcctcccaacactaattgttgattttcatatgttcaaccttgcattactgggataaattccctgtcatggcttataatacttgtttttttttttttttttttttttagacagagtcttactctgtcgcccaggctggagttcagtggcatgatctcggctcattgcaacctccacctcttgggttcaagtgattctcctgcccccgcctcctgagtagctgggttacaggcatgcaccactatgcctggctaatttttttatttttagtagagacaggggtttcaccatgttggccagggtggtctttttttttttttttttttttgagacggagtctcgctctgtcgcccaggccggactgcggactgcagtggcgcaatctcgactcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccactcgcctcggcctcccaaagtgctgggattacaggcgtgagccaccacgcccggcctggccagggtggtcttgaactcccgacctcaggtgatccacccatctcggcctccaaagtgctgagattacaggtgtgagccaccacacccagccagtggtgtagttttcttataatgtctctgtattgagtatgagggtaattttggcctcaatggatgagttgggaatgtttccttctcttctgttttctggaagagtttcttaagtattggtgttaattcttatttcagtattgttagtattcacctttgaagccatcagggcttggggttgtgtgtgttttggggggaatgttttttaataacaacaagaaaaccctctttgttacatttgtatttagattttctgtttcttcttgactcagttttgatagtttgtgtctacttgggaatttgtccatttcatctaagttatccaatttgttggcatacatttgtacatagtatttcattattttttaatttttataaggttactagtgatgtcctttttccattcctgttcaaagtagtattgagtcttctctctgttttttgtcactctaggtaaacatttgccaattttgttgattttttcaaagaaccaaattttggtttgtcggttctctttttctaatctgtttcattcgtttctgctctaatttttattatttccctccttttgctatctttgggtttgtttttctttttcttgttccttgaggtataaagttaggttattggtttgagatcttttaaaatatgggtatttatagccataatgttcctgctaagctctgcattttctgcatcccataattttttgtttgttgtggtatttttttctttttctttttctttttttttaatttttctttttgagatggagtcctgttgcccacgctggaatgcaatggtgcgatctcggctcaatgcaatctccacctcctgggttcaagcaattctgctgcctcagcctcccaagtcgctgggattacaggcatgtgccaccatgcctggctaatttttttttttttttgaggtggagtctgatgcctcccaggctggagtgcagtggtgcgatcttggctcactgcaacctccgccccccaagttcaagcgattctcctgcctcagcctcccgagtggcatggtccaccacacctggctaatttttgtattttttttttttggtagagacagggtttcgccatgttggccaggctggtcttgaactccagaccacaggtgatccacccacctcagcctaccaaagtgctgggattacaggcgtgagccaccacccggcctgttgtatttttcttttcttttctttttttctttttttgagatggagtcttgctctgtcacccaggctggagtgcagtggcactatctcggctcactgcaagctccgcctcctggattcatgccattctcctgcctcagcctcccgagtatctgggattacaggcgcccaccaccacgcctggctaatttttttttgtatttttagtagagacggggcttcactgtgttcggcaggatggtctcaaactcctgaccttgtgatccacctgcctcggcctcccaaagtgctgggattacacttgagccaccacacccagccctgtgtttttattttcattcctcccaaagtacttgtaattgtcatgtgatttattttttctttgactctggatttttaggaatgttttgtttaaattccttaaatttgtgagtttcctaaatttctttctgttgttgatttctgttttaattcatttgtggacagagaacatacttgacattatttcaatcctttgaaatctactgaggcttgctttatttatttatttatttattttgagacagagtcttgctctgtcgcccaggctggagtgcagtggcgcgatctcagctcactgcaagctctgcctcctgggttcacgccattctcctgcctcagcctcctgagtagctgggactacaggcgcctgccaccatgcccgggtaattttttttttgtatttttagtagagatggggtttcactgtgttagccaggatggtcttgatctcctgacctcatgatctgcccgtctcggcctcccaaagtgctgggattacaggcatgagccaccgcgcccagccgaggcttattttatatcctagcaaatggtatgttctgaagaccgttccatgtgcacgtgacaatgtatatcctgctgttgttaggtggcaagctctatagatgtctgttaggactagttggttttcattgttgttcaagtctgctgttgttattgatggtgggaaattacaatcgttattattgctgaacagtctgtttcttcagttatgtcagttttgcttcatagaaaggcttttttttttctttttgtttgtttgtttgtgtttttgagacagagtctcgcactgtcgcccaggctggagtgcagtggtgtgatctcagctcactgcaagctctgcctcccaggttcatgccattctcctgcctaagcctcccgagtagctgggactacaggtgcccgtcaccacatccgcctgatttttttgtatttttagtagaaggggggtttcaccgtgttagccaggatagtcttgatctcctgacctcgtgatccgcccaccttggcctcccaaagtgctgggattacaggcgtgagccactgcgcccggcctgtttgtttgtttttgagacagggtctcactctgttgcccaggctagagtccaatggtgtgatcgtgactcactgacgctttgacctcctaggctcaagtgatcctctcactatggcctccctagtaactgggactacaggtggtgcatgccatcatgcctggctaattaaaataatatattttttgtagagttggggtcttactgtgttgcccaggctggttgcgaacgtctgggtttaagtgatctcctacctcactttccaaagtgctgggattacaggcatcagccaccatgcccagcctgtttcttttactacctgtcacccgcaggacttgcaccttcgagatcccctgtgtttacccagctggaggatgatgaacagtcgtgggtgcccagctgggtggatgtgactccagtcagcagagcagaagccaggagaggttttggtcttggtaagtggagtggaggggaataccttggtttcagcagtgggctcacagaatgctgagtacctgcatacaccgataccttggtgttgagggcagtgaccataccttatttccttccacctttcctgtcttatgtggacactgtgcagtctgccatctctaccatgattttcaggccccgcatgttcctgcctctctggcctgcgtctcctcattgcccttctctgtatctgtgcagagctgtctactgttggcgactcagtgcgtgtcttgaaatgtgcacatatccttaaacaggtatttgaacttcagccaatccttaattaatacttaaacaccagctactattttggaatcacattttgctgggactagacacatgcctcctcatagtgcttggctgtcaccagcagccaaggccctgctgaaaccctttgcagaggagtgacttggagaccccacctctcttccctgcaccatatcctatcttgtgccctcatctcagttgaggttttccttagtctgtagtctggtggagccatattcagttgtgccaggctttcccaacccagacctttcctagcaacctctcagcaattcttttttttttaagatggagttttgctcttattgcccaggctggagtgcagtggcgcaatctcagctcactgcaacctctgcctcctgggttcatgccattctcctgcctcagcctcttgagtagctgggactacaggcgcctgccaccatgcctggctaatttttttttttttttttgagtcggagttttgctcttactgcccaggctggagtgcagtggcgcgatctcagctcactgcagcctctgcctctggattcaagtgatcctcctgcctcagcctcccgagtagctgggattacaggcatgcatcaccacacccggctaattttgtatttttagaagagatggggtttcgtcgtgttggtcaggctggtctcgaactcctgacctcacgtgatctgcccgccttggcctcccaaagcactgggattacaggcgtgagccaccacgcctggccctttcagcagttctatggagtccttctgggtgtgtctgacatgcactggtgattaaggtacctcctccctctagttcaactcttagtaatgattcatctctgctttcagatggtttgtgtagagtggaggatgagagagcccatcctgagcatctaaagagctacagagtcatccagcaccaggacactcatagtgaggggaaaccaagaaggcacactgagcatggggcagctttcccacctggttccagttgtgggcaacagcaagaagtccatgtggcagagaagctgttcaaatgcagtgactgtgggaaggtgttcttaaaggcctttgccctccttgaccatctgataacgcattctgaagagagacccttcagatgcccaacaggcagaagtgctttcaagaagtcagctcatattaacccccgaaaaattcacactggagaaacagcccatgtgtgtaatgaatgtgggaaggccttcagttacccgtctaagctgaggaaacaccagaaggttcacacaggcataaaaccttttaagtgtagtgactgtggtaaaaccttcaaccgcaaagacgcacttgttctacaccagaggattcacactggagaaaggccttacgagtgcagcaaatgtggtaaaaccttcagtgttctgtctaccctcattcggcaccggaaagtgcacattggagaaaggccctatgagtgtacagaatgtgggaagttctttaaatacaataatagcttcattcttcaccagagagttcacactggagaaaggccttttgaatgcaagcaatgtgggaaaggctacgtgacccgttcaggcctctatcagcactggaaagtccacactggggaacggccctatgaatgtagcctgtgtgggaaaaccttcactaccagatcctaccgcaatcggcaccagcagttccacactgaagagaggtcttatgaatgtacagagtgtgggaaggccttcaaacatagttccaccctccttcagcacaagaaagtccatactccagaaaggcgtcaggaggacagggcacatgggaaggtcgttagctgctagcaccgtgttcatcaggaaaggtcttattccagaaaggaggttaaggagagtggccgtgagagtgccatccgaaagaagctaaaccttgcacatcccaacacccaccccagggagagttcccgtgtgtgcctggtgtgtgggacgctttcgggagccacattgcactctgacttgcctggggctgttggcagtgtcacatcactgagtttatccaccgccatccacctctatccaccccataaggtccctacagcaagtgggacagcagaccttgtgctccttgctctaaacagtagagaatcgttaatagtggagcccaaaacaggcctcattccctacccttgactggtttagctgtggacatgacccacctctggccggaggagctgagctggtatctgctgggggcttcctgggaaggtttaccattttcatggaaatggttgacattacacatggtatttgtcatgccctagcatggactgtctcatactgctctggactatgtggtaataaaggctttattgtttaagccgcttaaaattttttttttattttttttttgagatggtcttattctgttgcccaggctggaatgcagtggtgccatcatagctcaccacagccttgaactgctggtctcaagggatcttcctgcttcagcctcctgagtagctggcactacaggtgtgcgccatcacacctggctaatttttttttttcatttgtggacagggtcttgctatattgcccaagctggtctcgaactctgagcctcaagctatcctcctgccttggcctcccaaagtgctgggagccactgtgcctggcctagtttttttagagacagggtctcacagtcttgcccaggctggagtgcagtagtgtgaagctagctcattgcagacttgaactactggactcaagtgatcctcctgcttcagcgtattgaatagctaggattgtacttgtgtggcaccacatctgactaattttaaaaatttgtatagagacaggatcttgctacattgcccaggctggtcatgaactctttgcctcaagcagtcctcttgcctcagccttccaaagtgctggtattatagttgtgagccactgtgccctgccaagtctcttttaatattgaggttctgatccctgtgtgtggagagattgagaatagaatccggcactatcaccgtaagttgagggaatggcttttgtggaggtggtctcttgagttttttctgcctcagtggggatggcaggatgacagaaaatacctctagtcaaggttggcctaatttgtattggcccctgagtcctccagggaaagacttgtagcctggatgtcaggcttttttgtgggtccagagctcaccttgcggaagggaatagttggtgagagatcttctatatgtttatggacataaaaagttgggttccttgttcccagggaatgttccagaacttccagcattggtcagaaggagctgtttccagattcagctcaaaagtcatattctccaaaatctggaacatggaggtaagttatagactgactctaagacctataggggcctgttgggtagagtaatttgagtagagtaagtgggcatagaaatattgagtgaagtagtatggagtgaagtgtctgataaacaagaggatttcagccagttctaaagaggcatccacaaatgttccagcaactgaggtttcctggggtgagggcaccagaacttctcagcaattgcagacctgttatttgtgtcaaggtcactgtcagcaaataatctacagactttctggattctcatatcctctctgggctgttcacctctcatggccattatcctgagactgaaagattctatagtcctgggatgtgccttttgtgacccagccagtactcctggtgtctggatgctgtggcctttgcagttgtcaagtttttgctgtcatggtgtcagggctttccctctggggctcaagagagacacgtagggtaaccaaagtatggatccagatcttgcggtttatgggaccttttcagagtcttgctgtgtcacgcagcctggagtgtagtggtatgatcacggctcactgcacccttgactccagggattcaagtgatccttctacctcagcctcctgagtagcagcgactacagttacacaccaccacactcagctaattaaagaaaaaatcgttttaggctgggcgtggtggtcgatgcatgtaatcctagcactttgggaggccaaggtgggcagatcactttaggtcaggagtttgaaaccagcctggccaacatggtgaaactccacctctactaaaaatacaaaaaaattggctgggtgcagtggctcacgcctgtaatcccagcactttgggaggccgaggcaggtggatcatgaggtcaggagatcgagaccattctggctaacatggtgaaaccccgtctctactaaaaatacaaaaaaattagcccggcatggtgacgggcgcctgtagtcccagctacttgggaggctgaggcaggagaattgcttgaactggggaggcagaggttgcagtgagccaagatctcaccactattctccagcctgggtgacaaagcaagactctgtctcaaaaaaaaaaaaaaatttgggagtagggggtcaggattggcggctcatgcctgtaatgccagcactctgggatactgaggtgggaggatcgcttgagccgagaagttcatagaccagcctgggcaacatggcaagaccccatctctttaaattttttttttttttaagagacaaggttttgccatgtgcccaggctgatcttgaactcttgggctcaagtgatcttccagcctcagactcccaatgtgctggggttggtgtgacactgttcctggcttatacccacttttattttattttattttttttgagatggagtcactctgttgtccaggctggagtgcagtggtgtgatctcagcacactgcaacctccgcctcccagggtcaagtgattctcatacctcagtctcccgagtagctgggattataggcatcggccagcatgcccggctaatttgtatttttagtagagacggggtttcaccatgctggccaggctggtctcgaactcctgaccttgtgatctgcccacctcagcctttcaaagtgctgggattaccggcgtgagccaccgcacccagcctatatacccacttttaaagacatacgagatgctaaatgttattcagaatgggctagaaaatgggtggtaacttccagctgttgccatgctaaggggcagtaacttccgagtgttgccaaggcagtggcaaactgccatggcaatggcgggcctgtcttacggggaagtgctttcagcgccttttcctgatttcagcgtcttcaacctgctctggagtagagtcccatctgcctcctacctcagcttcacaaaaatcccttgaaggaggaattatcttcattttccattgctcccccacttccccagactggctgctggataggatattgatcaccttgctgcctatagaaatctcagtgctgcttttttagggggaacggaagccaatccacattgtaatttttttttcttttgagacggagtctccccgtcacccaggctggagtgcagtggtgcagtcttggctcccaggttcaagtgattctcctgcctcagcctcctgagtagctgggattaacaggttcgccgcaccatgcccggctaatttttgtatttttagtagagacagcgtttcaccatgttggtcgggctggtctcgaacccctgacctcgtgatccgcccacctcggcctcccaaagtgctgtgattacaggcgtgagccaccgtgcccagccatgtaattttaaaaatgtaatttataagagcataaaattatgaaatacttagaaataaatttgacaaaattatgcaagacttgtacactgaaaactacaaaatgttgctgagagactgattgaagaatacctaagtaaatgaggacatttaccatgttcatgaactggaagtctcaatattagtatgttaatcctcccaaagttgatttgcagattcaatgcagtcccaataaaaatgtcactaggttttgttgttgttgtttttgactcgctctgtaacccaggctggagtgcagtggtgcaatcttttctcactgcaacctccgcgtcccgggttcaagcgattcgcctgcctcagccccccaagtagctgggactacaggtgtgtgccaccacgcctggctaatttttgtatttttagtagagacagggtttgctatgttggctaggctggtctcaaactcctaacctcaagtaatctgcccctcttaccctcctaacatgctgggattacaggcatgagcagttgatcaaattcaacatcccgtcatggcagaaactctcaactaggcgtagaaggaacatacctcaacataataatggccatatatgacagacccacagctaacatcttactgaatggggaaaggctgaaagctttttctctcagaactggaacaagacaaagatgcccactttcaccactcctattcaacatagtactagatgtcctagccaggcaagagaaaagaaaaggtatccaaattggaggagactaagtaagttgttcctgtttgcagatgacatgatcttatatttagaaaaacctagaccccaccaaaaaaactcttaggtctgataaagagattcagcaaggtttcaggatacaatcaatgtacaaaaatcagtagtgtttctatacaccagtaatgatctagctgaaaaagaaatcaagaaggcaatcccatttatgatagttaccaaaatatacctgggaataaatttaaccaaggaggtgaaacacctctacaaggaaaattacagaacattgataatagaattgaagagacctttggattcatcctcacattcttcctcttctgcccacaaataacccccttccaaaaaaaaaatgatacaaacaaatggaaaaacatatgctcatggattaggagaattaatatattttgttttgtttttgtttgttttgagacagagtctcgctctgttgcccaggctggagtgcaatggcacgatctgggctcactacaagctccgcctcccgggttcacaccattcttctgcctcggccttcccagcagctgggactacaggtgcacgccactatgctcagctaattttttgtatttttagtagagacagggtttcaccgtgttagccaggatggtctcgatctcctgaccttgtgatctgcctgcctcggcctcccaaagtgctgggattacaagcgtgaaccaccacacccggctgttttttttgagacggagtcttgctctgtcgcccaggctggagtgcagtggcgcgatctcggctcactgcaagctctgcctcccggggttctcgccattctcctgcctcagcctccagagtagctgggactgttggcatgtgccaccacgcctggctaattttttgtatctttagtagagacaggttttcaccatgttggccaggctggtctcaaactcctgacctcgtgatctgcccagcttggcctcccaaagtgctgggattgcaggcatgagccactgcgcctggcagaagaattaatattgttaaaatgaccatactgcccaaagcaagctacagattcaatgcaatccctatgaagatatcaaatgcattttttccccacagaattagaaaaagttctcagagctttgtagaatcaaaaaagagcccaagtagccaaagcaatcctgagcacaaagagcaaagctggaagcatcacactacctgacttgaaaatatattacaaggctatagtgaccaaaagagtgtggtattggtataatagtcacatagaccacggaaacataatggagacccagaaataaatccagatatttacagccaactgattttcaacaaagatgccaataacatacattgggaaaggataccctcttcaataaatccaaaaactagatatccatatgaatgaaactagacccccatctctcaccgtatacaaaaacaactctaaataaagacttaaacatatgactcaaaactgtaaaactactagaaaaacaagggggtcggggcagtggctcacacctgtaatcccagcactttgggaggccgaggcggacggatcaccagaggtcaggagttcgagaccagcttgactcacatggtgaaaccccatctctactaaaaatacaaaaaaaaaaaaaattagccaggtgtggtggcgcatggctgtaatctcagctacttgggaggctaaggcaggagaatagcttgaacccaggaggcggaggttgcagtgagctgagatcgcaccattgcactccagcctgggcaacaagagtgaaactcagtctcaaaagaacaaaataaaacaaacaacaacaacaacaacaaaggaaaaggaaaagcacgtgttgggagaaaatatttgctaaatatattcgacatcttttatctcaaatatataaataacacttataactcgattataagttaataatcatccaaagtttaaaatgggcaaaagatctgaacaaatatgctttgaaagaagatatatggttatcaaatacacacttgaaaagttgttcaacgtcactagtcattcaggaaatgcaaatttaaactatgatgagatacaactactacacatttattagaatcgttaaaatgaaaaagacaaacatacaaatatatggcaagaatgtggagcaactagaactctcagtgagttctaatataagtgtgataaatttttttgaaaacagtttgacagttcttaaaatgttaaacataaaagccgggtatggtggagtgcacctgtagtcccagctacattgggcaggaggatcttttgagcccaagagtccaagtccagcctgggcaacatagccagaccctgtctcaaaataaaaacaaaaacaaaacaaaacaattaaacatacacctaccatatacccccaaaattccacttctaagtatctacccaagagaattcaaaggatatattaacacaaggacttgtacacaaatgtttatagcagcttcatttgagatagtcaaaagttagaaacaatttggccaggcactgtggctcatggctgtaatcccaccactttgggaggccgaggcgggtggatcatgaggtcaggagtttgaaaccagcattgccaacgtaatgaaacctgtctctactaaaaatacaaaaaaaatcagccaggcgtggcggtgcacacctgtagtcccagctactcaggaggctgaggcaggggaattgcttgaacccaggaggtggagcttgccgtgagccgaaattgcgccactgcactccagcctgggcgacagagccagactccatctcaaaaaaaaaaaaaagatggggtcttgctctattgcccaggctggtcttaaactccccggctcaagtgatcctcctgccttggcctaccaaagtgctgggattacaggcgtgagccatcacgcccgactgaacctcttttccttataaactatctagacttagatttttccttccttccttccttcctgtcttccttcttccttccttccttctttccttttttttttttttttagacagaattctgctcttgtggcccaggctggagtgcaatgccgtgatcttggctcattgcaacctctgcctgccgggttcaagcaactctcctacctcagcctcccgagtaactgggattacagccgccaccaccacgcctggctaattttttgtatttttaatagaaacgccgtttcaccatgttggccaggctggtctcaaactcccaacctcaggtgatctgcctgcctgggcctcccaaagtgctgggattacaggcatgagccaccatgcccagcctgagatatttctttatagtaacacaaaaacagcctaacaaaaaggtcacatagtaggtaggatttagtaagaaagagagctgagatttcaaggcaggtgaactgggtctaatgtttccactgctttactcacctctccctacctctagatttccaccctcccatgttgaaatctcttggttataaattttcacttgtgcttctttcttagatcaccttcttgaatcacagtggtgtctattttcatatccattgagggtatagtgattccttgagggttacaaggtctgcagatcgatgagttcttggcattttggagaggccagagactggtagctctgagtcattagttgtcaggccatgcctccccatcaaacaatcgaagcttggctgacttctctgagtgccagaagaaggctggggctgggggtagaggatctgggtttcacaagaggcgagtctggaaatgtcaaaattggggtccaaggtgagaggatggcgtggtaggacaacattgtctgccatccgtgtataatggctgaagctctggttagtgggtgtggcctaaggagaatgtagtgattcccactgtcggtgtaaagggcttcatattgatggagagttttctgtgttgtcagaagttctggtggacactgtgagacagatttcatggatttatagatgagacagctgaagcttgggagtctgtgccccagatcgcacaatttattagcagtaggagtccaagttgagccaagccagagaaggttactgagtgttttggcacccttggccttaatctgctgctcttcagatttcacagcccccatgttccagatagttcactcaaagcttgggagttggagatgagggaatcaacagatgctgacactagcatgaaggagaggtatagctgatctggaggtatgattgggagaggttgagaagcctttcaagggtgtccctgatgtgggagggcacaagcaaaggcccaggggcaaggaactgcccagtagattccagaagagaactaccattgcatacagcagagtgtacaataacagggtagtcagtacactgcatcaaggggctgaaggcaactgccttttggtttgagcatagtctgaaagcagtggagccactgaatcccacaaaagctggtaacctggacagctcaaaagtcacagccatcaggactttgcctggaatattctggcattattggcaaacatctatcttcccctaacaggttggctgctgtatactgagacccagtcggagatcagaaggcaggttcagtagaaacacgtaggactctactcatgtattaggaatcttttttttttccttttttatttttattttttattatttttttgagacggagtttcactcttgttgcccaggctggagtgcaatggcgtgatctcagctcactgcaacctctgcctcccaggctcaagcaattctcctgcctcctgagtagctgggattacacgcatgcgccaccatgcctggcttttttctttctttctttctttctttctttctttctttctttctttctttctttctctttcctttctttctttctttctttctttctttctttctttctttctttctttctttctttccttccttccttccttccttccttccttccttccttcctttcctttcccttccttccttccttccttccttccttccttccttccttcctttctttctttttctttctttctttctttctttcttttcttgtagagatgggatttctccatgttggtcaggctggtctcaaagtcccaacctcaggtgatccgcccgcattggcctcccaaagtgctgggattacatgcgtgagctaccgcgcccagccttttttttttcctgttttagagacaaggtctcattatgttgcccaggctggagtgcagtggtgcaaacatagctcactgcagtcttgaactcctgggatccagtgatcctcctgcctcaagtagctggaaacaggcatgccacaatcatgcccagcaccatcttatgagatctaatcttggccactcacacagaggattgagctctgatgacgtgtctaccctaactttatttgcttagaaggctgagccccatatggctcagctaacctttaattctgatcccacatgtgtcttacatattggagacattagcatcttccatattggagacattacactcaggaaggaaggcctgagtagggtaggtatcccccagacacctcactgtgctggggagtatttgagaagccctgctgtaaactttgctgacggcaaaactgttgtggcttctgctcacaatgtggttatcattgtccatcccctcaggggcttccaggagacgtggcagctgcagtggcctctgatccatcatacagtatggatggacaccacaggccaaagattctcatgtcagaggatttccggtcttttctcccctaggcctcaggaggacccagggaaatatctaaagccaacctatagttttggtgaactgagtttgcattgaaatgtttttggaaatgattttcaacatttataaaatcacatgccacatagaaatctgaatatttggctcttcttggaaaaccaggagatatgggaaatctgtactgactccaccatattgtctccccaccccttaagagggacagacctgcttggtggccaccagaagtggaattatgaaggccacggccatatgattctcaagaaaccctggctactcacataagccactccagaccatgatttctgtcttctctgtcttgaggtgcctacctgtgcagtgatggccatgagatgaacagcccagggagtccacaggaaatccacaaaatatttatttgaatttcagttatgagtgacacataggtctgcatgtcctgagaagttctgtacacccttatctcacttggccatagtcattggaagtttctgatgtgcgtttagaacagacatgtcccctcttgtctaccacagtcttctccacacttagagtttttgtaccaatgatagttcccacatagccctggcaggtctgaaccagttatgcctgcctactgagttttatatttcatgagtcatgagccatgggcaggtactgggggatgtagctggtaaagtgggacatgcattgggaacagaggaccaaacttttgctgtggaggttctcaaagaaactaccccattcttcagagctagctctgggcccacaggtgacccttggtgtccagatcacaagattcagtccaagcctgtcagtctttcataggaggccttagggcaacaagacaaattcaaccaaaactggactgagcactcttcctgcccatgcggctgtttgagacactcagtgcccccttacaaaagctgttctttttatattaggatgaattgtttcaaaccacctcaccaactctgatgcaggtggctaaacattaaggcctttgttatctcagagagagacaggcagatccaggagtgagtgattgagactaaacagatcattcctaagtgtcacatgtagatgcaaacaatgtccatgaagagaaaccttttcttctattttagatggagtctcacactgtcgcccaggctggagtgcagtggcacgatctcggctcactgcacaccctgcctcccaggttcacaccattctcctgcctcagcctcctaagtagctgggactacaggcacccgccaccacacctggctaattttttgtatttttagtagaggtgggttttcaccatgttagccaggatggtctcgatctcctgacctcatgatctgcctgcctcagcttcccaaagtgctgggattataggcatgagccactgtgcccggccaagaaaccttttctggaaagctccagaagacaccagctcagatcttagcaagaattgtcataccaaaatctaaagccatcagtgggaaagaaaatgaaggtactcaaagcctatgtaattctctctagagaatggaaaagggagtatagtctgctttcccttagcacagtgagggagactgatacatatcatgagatcttgccaggtggcagagatgagacagtatggcaggcagctttggacatggcttccaatgatctctgccctctggtattcatgctcttgtgtaatgctctccccttgactgtgggctggaccaagtgacttgcttctaactaaatttagcaaagatgatgggatctcacttctgttattaggttacaaatgactgacttgttggtattctccactgcatgatcagcttgcaagctttgattgacaagctgccattttggagaggcccatgtggcagagaactggaggaggtctcagaccaacagacgggtcctcagtccagcagcccacaaaaaactgaatgctgccaattacatgagtttgcttggaagcagagccttccctagtcaagccttcagatgatacacccccagctgacatcttgatgttagccttgtgagaaaccctaaagaggagtcagctagctgcaccaaagttcctgacctatagagactgtgaaatagtgactattgttttaagccactaggttttgagtaatttgttacacagcaataggtaactaatacagatggcttctgcaatagcagtaatacagtgccgcctaagattctgggagctgtggctttcccacatttgttgcccataactctcttgtgaattctctggtgatttttcttaaaagggggtgtctatagctgaaggctttcccattttcactgcatttgtaatgcctttttcccataggtactttatatagctttctcacataggagaggtgactgaagaccatcccacattccttagatgcaggggttttctctactgtgaattttttggttatagataagaatcgatttcttcttgagggtctttcttcataccaagtatttaaagatctctcttcagtgtgggttcttaggtggttgaagagggcaaaagtcttcatgtcttcccatagccactgctcttgaagggcttctccctatcatggcctgcccggtgttatctgatgttagagctgtgtggcagcatcttctcactcagctcttcttcatggcttccctgtgccatgagtactctggtgatggagaaaggaaggcctttccacattctcttttgagcttctcattattctggtactccagtgctggaagggggtagttaccctggaaagccttcacaaatgcctggcccttgagtcctctcacttatgaattttgctgtgcatgaactgaaaagtgctcttactgtgagccatgtcacatctgaaaaggtggtcttcaccataaatggtctactgttggtgaaggtttgatccactcccttgtgtggggtttctacctggagtacactgcctaacgttcagccaggagtacaatctttggcagggcaagggtgccatggtcagggtgaggaacgaccagtcatggagtactggtcctgtcacatatcccactactgagcctgttaggtgacattcacataggcagggagaacagagagggatctaggacagatgtggaagcagcagtggctactgaaactgctgttcagtgatgtgagcccaggccacccttcttttctagagatggggccttgctatgttgccctggatggactcaacctcctgggctcaagagatcctcctgcctcagcctctcaagcagctaggactataggtgtgcaccactgcacctggccaggcctctcctttatggggactcctgttcacatcccagccaatgctctcatgagtacttccttgtatgggggaggtcaaagaaacagcagcagctcacatgtgatgatgctgaaattacatggtaaataagctttttaaaataggtgccggccaggtgcggtggctcatgcatgtaatcccagcactttgggagtccaaggcaggcagatcaggaggtcaggagatcgagaccatcctggctaacatggtgaaaacccgtctctactaaaaatacaaaaaaattagctgggtgtggtggcgggcaactgtagttccagctactcgggaggctgaggcaggagaatggcgtgagccatttaggaggtggagcttgccgtgagccaaaatcgcgccactgcactccagcttgggcgacagagcaagactccatatcaaaaaaaaaaggtgccaaacaccatattctacaaggttctggatctctagctccttctaaaataccagctctgtcaactgtgttaaatgcccccatctgcctgtgcccactctgttggccagcaagactgtgaaggcatgaagtgtgtgttagtgaccagaaaccctggccagactgcaaaaaccactttcctggacgtcaggctatcacttctctcagctcccagttcctacctggggagtgatgggtgccaagatacagtttgagagaggtgaagtgaatgtacatgacattgcatttatctgctttaactgtggcaaaaactttaacatggcaaatacaaaggtctgtagctctggagttgttctgcacaccctcaccctgcacagtcccagttgatggggaactatggctattcctttgtccatgatggcatgtgccctagttcaccagtctacccaaatccctggttattacctcacatccagtgtttctctatgcacatagagtcctccatggacccctctaggtctttgccttggtgaccctgtgactattttagtgttgtagatgagtttatttttcctctgggtaagctctgggccctacggtaactgaaacaggccactatgttcaatccagagcctttcagtctttcccagtctttcacacagcaatgcaaagtaggctacaacaggacagagcaactacccgctcttctactgtgcccttaggcagattttgtgcccccaaaaggcactccccaatctatccattcattttctcaacctaccccaacagaacccctaagattaaaggtgacctgatcaataaggtctttattatcaccagttagtgcaggcaaggtaggtgattccagtggagggtgatttgtggcctcaatggacacatcttaggggttaaacacagacttgaccacatccacaaggaatgtgcatcttcctgagctcaaattagatttccctcaaggcccctcaaccagcatcggttcagctgagcacagtcctgaatccctagagaacacaggaaggaaggctcagggtactgttttccccatgcatgaggacaggactgctgcaaatttttggatccaggcaagatggaaagtgactatggcttctgccttatgctgcatgggtgagatggccctgcaaaggttcctgggctggtcagaaacagagtagcttctgaaggcttttccacattagcagtacatgtaggtaatttttctggtatggggattctgctgcatgaagtttgacttggctgaagattttctcacaaagaccacttccataaggctccactcaggtatgaatctttttatgctgtgcaaggttacaaagatggctgaagagtttcccacactggctacactcataagtcctttctctggtgtgaactttctggtgccgaacaagtgtagatctttcactaaaggcttttccacactggatgcactcatagggcctttcttgtgtgtgaactctctgatgacgaaccaggtgggagttactgctaaaggctctcccacattcactgcattcgtaaggcctttctccagtgtgaactctccagtgacaaataaggctggattttcggctaaagaatttcccacattcactgcatttataaggcttttctccagtatgaactttctgatgcttaatgagaatggagttttggctaaagaatttcccacattcattgcactcataaggcctttcttttgtgtgaactctccagtgttcaatgagagtggagctgtgagcaaaggctttcccacactcactacactcgtaaggcttttctccagtgtgaattctccagtgctgaatcaggctggagctgcggctgaaggatttcctacattcgctgcactcataaggcctttgcccagtatgtactttctggtgctggatgagggtggagctattactgaaggctttaccacaatcacagcattcaaaaggccgttctccagtgtgaactttctgatgtcgaaggagatgggagctttggctgaagtctcttccacattcactgcactcaaaaggccgttctccggtgtgaactttctggtgctgagcaaggttggagttattgttaaaagctcttccacattcactgcattcatacggtctttctccagtgtgaactctccagtgctgaatgagagcagagcttcggctgaaggatttaccacattgactgcactcataaggtcttacctgtgtgtgaactttctgatgccgaaggaaattggagctttggctgaaggctcttccacatttcaggcactcaaaaggcctttctccagtgtgaactttctcatgccgaatgaggtgtgatctgttactgaaggctttcccacattcatcacactcataaggtctttctcctgagtgaattctctgatgatgaacaaatgtgagtttgtggttgaaggttttcccacatgcaatgcactcataatattttacttcagtgtgaaatttctggtgcttcctcagcttagatgagtgactaaaggccttcccacactccttacacacatggggtatttccccagtgtgaaactttttattaccaaggattgatttctcctctaagaaatttccacctgttgggcatgtaaatggtatctcttcagagtgagttctcagatggttggggagagtggagctcttcaggaaggcttttccacagttgctgcactcgaagagtttctgtgtggtacagacttctggaagctgcccaagattggaatatggcttctgcccactgtcaacagcttgaagctggaggaggtcacagctgcccaggatgaccttcccaccttccctgcaagtgaaggggttctctgacaggtggactttagagctcttcataagtgcgtccctgtccttgtaccatctaaagggcttccctccactgtgctccttctggtgctggtgaaggtttgcattcaaccaaaagtctctcccacatgctccacatgtgtagggtttctcctcagactgtgttccctgatgctcagccaggtgcaaaatgtctttcaagaatggcccacacatgtcacaggagttagctttcttggtggaaggatctgcattagggatcctgacctgtaacacttctacagaaacattctgcttgggatgggccccctcaccctctactccatgccaagaacctgaaagtagagaaatgccagttaactaagaattccacttggtgggaatggttgacttcattagaaatgttacccaggaattcacacccaagaagaggtcccagggattgctgacaggccaacagggccatcatcagggtgaagaagggcccattactattggcaggatagggaccagccaagcaacagaataagggagacctcaccaggggtaaggacacagaaatgggtcaaaggacttaaatagacatttctctaaaagaagatatatacacaaatggccaataagcatatgaaaagaagttcagcatccttaaacatgaggagtatgaaaaccaaaaccataatgagataccacttcacatccactagcatagctataataaaaaaaaataaatgacaacaaatgaagtagaaaaactggagcacttatacactgcagacagggatgtaaaatggtgcagccaatttggaaaacagtttggcaagtctgcttctacagagctacacaagagaactaaaaacatccacacaaaaatgtgtacaggactgttcatagcagaatttttttaaaatttgagatggggtcttgctatgttgcccaggttggtctcaaactcctgggctcaagtgatcctcctgcctcagcctcctgagtagacggattataggcaccttgcccagcttctatagcagcatttttttctaacacctaaaaaatggaaacaagccaaatgctcatccactggtaaatggataaacaaactgtagtctttctatacactggaatatttggctataaaaaagaatgaaatattgatacatgctacaacattgatgaacttcaaaaacatgctaagagaaagccagtcacagaaaaatacatagtattctataaaatgtctaggaaacgtaaatctatatagtcagaaagtagattagtggttgcctaggaccggggggaaagggataagggaacatggggagtgacagctaatgggactgctaataggacctacagtttctctttaggtgatgaaaacatgctaaaattacattatagcaatgattataccatgtgaaaacatatagaaatcactagactgtgtactttaaaaggtgaattgtatggtttatcttaataaagctgtttttaaaaaatatctcactgggggctgggcgtggtggctcacgcctgtaatcccagcactttgggaggctgaggtgggtggatcacgaggtcaggagattgagaccatcctggctaacatggtgaaaccccctctctactgaaaatacaaaaaaaattagctgggtgtggtggcaggcacctgtagtcccagctacttgggaggctgaggcaggagaatggcgtgaacctgggaggcagagcttgcagtaagctgagatcacgccactgcactccagcctgggggacagagcaagactccatctcaaaaaaaaaaaaaaaaaaaaaaaaaggaaaaaaaaatctcattgggaaagagacagaatctgggcatgacctcatactgggtaacccgaccagggattggtgaatctcagtgggatctgttaggcagactggaggtgtctgatccccaacctttgcctccacaaggctcctgggcaacagctattaggaaagctcatgaggctgctcagagagagacaggggaagtacacacagcagaacctcagcaccccagcacctacaacaggaaacccgagaaggaagcagtacccatgatctggctttgggatgaacagagctttctatggggaaaagacacaaggcataaggtagtcatcaccatgctgagacagggcattaccaagtgaggtcacaagctcaaggttttccagcatcacactgtggtacaggtgcctctgggctgcatcaaggagctcccactcctcttgggagaagtatacagccacatcttcaaaggttaccatgctcttcaatgtggggacagctgagccacagggccaagaagtatgctgacaaagaaacaaacaattggtcaaatggaaatatgcaggaccttgctgtgtgactcagaatcctgatacatctaccactaatatctctttttcttatgatcctctcagtccacccactactcacccatccacagcttatcttcttcctcagggcccccacctaacatgccctggaattaatggtgcccctctctcctagtagtcccactggtcactgtatccaggccaacccaacctagaggaacaataggcaggtgggcagatggatgcttcctcctccctcctgctggccaattttccttgtgtcttctggctcatacctcccaaacataagaaaatttgggcttccctttcttaagcctcttgtaccagggccatgggcccaatggttcacattctctcacctttacatgtcactcctcagaccatacagttcttatatttccaacccctccctgttcacactgtaggcattctccctagcatctcaccatgcacatggcatacctgacagatgcaaccgggatccattcctggtccaagccagctacagagctccaaaaaccccactgcaagaggcagtcatagcccctcaagtcaatgcctcccctgccagccctgttccttcaaccatcagctgcccagaaccataagcagatctcaaatatctcttccctctgatatctttgcctttgtatgtgttgtctcctccccagtcatagctgtccttgctcttcctaacactcaaatccaagatccactggcccccaccttggcttggggactcagcttaggctgaccctttctgatcttgccactccaccagcctgacaaaaaccccaggaccctatttaagaagagataacatgccctgaccacaagaaggatggccgcaacaatgtagtgagctgtagagaagcaaatcaacctaaaccaaagcccaactctcatcctacttttgccgctatgcttcactgttgtcctagacctactctctgctcaggaggctcagccactatcttgaacccaacccacaactgcatgcagtgtccacacacaagcatccatcccttggatgtttccagcctaaacccgacataatttcataatcacatgtttagtggtctacttggcacctcaatttggtagtgtctgggacatctcaaatacaacatggccaaaatccaactctttatcttccccctgaaatctactcctcacaccaacttccacatctgaaagatctaaggtcaatttttttttttttttttttgagacagagtctcgctctgtcacccaggttggagtgcagtggcgcgatcttggctcactgcaagctccgcctcccgggttcaagccattctcctgcctcagcctcccgagtagctgggactacaggcacccaccaccacgcctgactaattttttgtatttttagtagagatggggtttcaccgtgttagccaggatggtctcaatctcctgacctagtgatccacctgcctcggcctcccaaagtgctgggattacaggcgtgagccaccacgcccggcaatttttttttttttttaagacagagtctcgctctgtcactcaggctggagcgcagtggcacgatctcagctcaatgcaacctccatctcccagattcaaacagttcttctgcctcagtttcccaagttgctgggattacaggtgcacactaccatgtcctggctaatttttctgtatttttagtagaggtggggtttcgccacgttggccaggctggtcttgaactcctgacctcaagtgatctggccgccttggcctcccaaagtgctgggattacaagtgtgagccactgcactcagccttaggtcaatcttaacatttcactttctttcactgtcccacatcaggtaatccatggcccagtttgggcagattcagaagccaaccatctgtcctacctccacgggcacccctctgtccagctacccaaagcacacatctggaccacatctgtcagctcctcactggccttcctgctccaccatcaccatccctccagtctgctgcccactaggcatccatagggcgtctgttaagactggagtcagagcacctacttcctctactccaaaccttccatggctcccaccaccatcagaatagaggtccagctcctcaggctgccattccaggcctaactattggtttcccttccctgtttccaccagactaaatggagaccggcagtccccagaatgcttccatttcatcaccactaaacaaggtacacatgctggtcactgtccctgggacagccttccagatctcattccacaggattccagaaatgggaatccctcgatataaccccttgcctggattcaggatggtaagggtaagtgactcccagggcagggcccaggacccacgtgtgaggacaggacacgatcaagagtcccaggacaccaacatcccctctatctgggcttcaggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtcgtcgcccttggcgttatgttggctttagggagcgcgaggccgaggccaagaaaagctacgcattgggaggtcttgacccagtgtgcgcccggctgtaggcatggaacgtgcgccaaaggtctcctggcacccactccgctggactcagcaccattgtcctaagtctccgattgagaagtatctgccccaggtcctctgcgggccccactgaacagtgtggagcgttcacaggttgggggtcaccatttcagaatccagtttgttgagacgtggagggtacaggaggagggatctgcatatgcgaagacttggacttgaccctgacctgagcgttcaggcaggctctcatgcccccttggcagcgagtggagagcgtaagaggagtcctgcctctcctggcacaccgagggcgcctgggagccatgaaaggtgttgaacagaaaagggatggacatgacctgagttagaatttggaaagtatttcagtggttgctgaatgaacacactactggagaaggtggttgtagtggggctggaagcagggagactgtgggggaggttattgcagtattgttccagacagttatgatagtggcctgtccagaacggaagcaagaaggatgggagaagtgatcagattcccagtggatcttcaagatagagctaatggaattttttgctaccttagataagtggaataagcatgagtaggggtgaaggaccatcccaagtagttaggaagaattaggatgcctcctgtggagaatagaggttggcagttggcaggaggaggatgtttcatggaagattagcgatggattttgtaggtatagagtctgaattgtctggagacctgtgagtggaggtgtcaaatgggcctctggatatatagaattctggtgtggcttcaggacgtccagactgcattatgttggtggcctggcccagtgaacggcctgaggataggatttgggaaggagggttttaggttggaggaccagtggctagggctcacgctcagtgcttagatcacatctgtctgcccattggcttggtgttgcagggcttaatgacctttgaggacagggtcagtacatcttccaagaatgtggggctccttagtgaggtccaagggggcttctacagtgacatgatactacagagctttgtactccagtgcccactaggtaaggctactgtgtctcctctttcccctacacatgaaatctaggttttcctccgcctttccattgttccctctgggaggtgctgctggccctggcactggccagtgtcctgctgtgtccggaattgtttccttcctctgggttcttggtctcgctgacttcaagaataaagccgcggaccctcgtgttgagtgttacagttcttttttttttttttttttgagacggagtctcgctctgtcgcccaggccggactgcggactgcagtggcgcaatctcggctcactgcaagctccgcttcccgggttcacgccattctcctgcctcagcctcccgagcagctgggactacaggcgcccgccaccgcacccggctaattttttttttttgtatttttagtagagacggggtttcaccttgttagccaggatggtctcgatctcctgacctcatgatccacccgcctcggcctcccaaagtgctgggattacaggcgtgagccaccgcgcccggccctgttacagttcttaaagatggtgtgtccggagtttgttccttcagatgttcagatgtgtctggagttttttccttctggtgggttcgtggtcttgctgacttcaggagtgaagctgcagaccttcgcagtgagtgttacagctcttaaaggtggcacatccagagttgttcattcctcctggtgggttcgtggtctcgctgacctcaggagtgaagctgcagacctttgcaatgagtgttacagctcgtaaaggtggcgtgtccaatgttgtttgttcctcccagtgggtttgtggtctcgctggcttcaggagtgaagctgcagacctttgtggtgagtgttatagctcataaaggtagtgtggacccaaagagtgagcagcagcaagatttattgcgaagagcaaaagaataaagcttctacagcatggaagaggacccgcgggttgccgctgctggcttgggtggccagcttttattctatttggccctgcccacatcctgctgattggtccattatacagagcactgattggtccattttacagagcactgattggtccattttacagagcactgattggtccatttttacagagtgctgattggtgagtttacaaacctatagctagacacagagtgctgattggtgcatttacaatcctttagctagacagaaaagttttccaagtccccagccaattagctagacacagagcgctgattggtgcgtttactaacctttagggagacacagagcgctgattggtgcatttttacagagtgctgattggtgcgtttacaaacctttagctagacacagagcgctgattggtgtgttggcagtcctttagccggacagaaaagttccccaagtccccactggacccagaagcccagccggcttcacttttcactgctacttatccctggctgctgcataaacaacccccacaccttccctgggatcttgacaaccttgtgaagccacagtgatggtccctgcacccactcccacgcccttgtccagctctagaggcctcctgtagcccaacccacaagccacaaaatgaggaccatcatggcggtgccggaaatctcacccctcaatgcccacctggaatcggaagtctcaaaacctgtgtagcatatcacatgcagctgggtcgtttcctggctaggttaccctgtcaggatctgtgacttttctgtcctttctgccacattccctcactctagtaggagttttctgccagctgtcccttgtgagtcccagtgggcactgacatggtcattgattgtggggtcactgagcattgactttgtgaagttcagttctttccagctatatacctgcataggtgatcttcacctacggtgatttgtcatggggtggatcaccttgacgtgggctgccttctcacaaaccacttgatgagagctgtataggatcactgccaccacccccgccatgtgatcacctaactagaacaaatgaagagacctggctggtggacagggtggcttgaattaggccatggacagagaggccccatggtgcaccagttctgttgagtggaagacagctgtggcagagctgttggcagtgccctggtggctcacctggtacctgagttgtgccctctgttgtcctggcaccaggatgtatagctgtgccttttaaaaaaaattttcctgaccttcttctgacactctatcctactttgccctgactcctgttccctggatggcttcctctctgtcttccaagattcactctttccccttctcccgtcctcccctccagtggccaggtcttctaccattggcctccctttaatgtgtcttgaacggataatgtatctttaaatagttgttatctgcacatggtggctcataactacagtcccaactacttgggatgctgaggcaggaggagcgcttgagaccaggagtttgagtccagcttgggcaacataacgagatcctatctctaaaataaataaataaatacatagatacctaaatagtttttgaaaacctcttcttccgtgagactggcttgttccatttgaggagtatgggcataggtgtcaatggttcaagacctggacttcgctcactgcatggtactgacctgtcaccagacactagggccctgcagctccacattttgcagaacctacagagaactgacactgaagagatagctgataaatacacagcatatggaaaggtgtttgaggggaagcaagccttttctcctaccaaaaaacttcacagtggaaaaaattgcaagtgtattatgagcatgggaaggccttcacttttgtcttcatcctgagaaagcaggagtacatgcacatcttcaaaggcccttacaagtatagtaacatggggaatcctccagccagaactctacctcctttgagcaccaatatgttcaccccagagaaagtccccataagcgcaaggagtgtggtccagccatgagcaaaattttgcaaaactctcctctgtatcaaaatggtcataccctaatgaaggactcctaagttcagggaatgtggggcactgccagctgtcctggtggcttccctggtacctgacttgaggttcatacatgttatattcagagttctgctttcattagcaaaaacaaattaacaccggaaaatggttgtacaaatgcaataactacatgaaagctttcagtgaaatatgaaacctcatcctgcagaattctcatcagagaggcccagtgcatgcagctaatgttggaaagcctattctcaattttaatcctatttagcaccagcaatttacagcattgtgagtgtagcatgtaggagagcaaaaaattgcagctcctgccttgatgtgcacaaagtgattcacactggaaaaaccctctatgagtgcagccagcatgggagagcatcggccacagctcctgccttgcttggcaccagaaacttcaccctggagaaaagccttttgattatagtaaatgtaggaaagtcttcacctcccttatttagtataaaagaattcacactggccaggtgtggtggctcatgcctgtaatcccagcactttgggaggctaaggcagggggatcacctgaggtcaggagtttgagaccaacctggctaacatggcaaaccccctctttacaaaaaatacaaaaatcagctgggcatggtaacgcccatctgtaatcccagctacaccagaggctgaggcaggagaattgcttgacctcagggggcagaggttgcagtgagctgagttagagccactgcaccccagactgggtgacagagcaagaccctgtctccctcaccaaaaacaaacaaacaaacaaacaaaaaacacagctgggtgcagtggctcacgcctgtaatcccagcactttgggaggccgaggcaggcagatcatttgaggtcaggagtttgagaccagcctggccaacatgatgaaaccctgtctctactaaaaacagaaaaattagccgggcatggtggcaggcacctgtaatcccagttactcaggaggctgaggcaggagaatcacttgatcctggaaggcggagattgcagtgagccaagatcatgccactgcactccaacctgggcaacagagtgaaactccatctcaaaaaacaaacaaacaaaacaaaacccagccctacatgagtagccttcagccacagctaaaccttgtgtagaaggattcctccctgaggagacactccatgatggccctgcatgtggagaagctgacagaacccatgttgtaccatgatcgccctgcatgtggagaagctgacagaacccatgttgtactttgcaacccgctgagggaccttggcagagctatcacaccactgggtcctgtggtggaagcccatctctgttttatggtgacttcccagttgctcaatgtaagtcactccctgtttcctgtttatactaccttggagggatggtaggggccttgcacacattggggtggtatcatgctcactcatgatggggtttgacatggacatgaccccattccaagcaaggagcctgattggataatttctttctcttttttttttttttttttttttgagatggagtctttctctgtcaccaggctggagtgcagtggtgcgatctcagctcactgcaacctccgcctcccgggttcaagagattcccctgcctcagcctcccaagtagctggaattacagccacacaccacctcgcccggctaattttttgtattttagtagagacagggtttcaccatgttggccaagatggtctcgatctcctgacctcgtgatccccccacctcggcctcccaaagtgctgggattacaggcatgagccactgcacccgacctctctccttttgtcttttcttttttcttttcttttcttctttcctttcctttcctttgctttcctttccttttctttcttttctcgtcctttcttttcttttctctctttcttttttttgaggcagagtctcactctggtgctcaggctggagtgcagtggcatgatctcagctcactgcaacctctgcctcccggtttcaagcaattcttctgtctcagcctcccaaatagctggacttacaggcgtgtgccaccatgcctggctaatttttgtatttttactagagacggagtttcaccatatattggccaggctggtctcaaactcctgacctcaagtgatctgcctgcctcggcctcccaaagtgctgggattactggcgtgagccaccatgcctggccgacaatgcaggagcttaaccaaaggaccacgttggctagggtcaatcagctgccccaggtgaccacccttagtgctaatcctgtgcagggtaggggtctgagccaaaaagaggaggctcttgtgtgtacagaaggcaatttgttgctatttttatttcatgcccaattcattaagaatgtttcaaacaattagcatttttctaagtattaagtaattaacatttgcctgaagaattacacattagatggataatgtaaaaataaagtgtttaagaagttaaacgtctccaaacattaaacattacttgagattggacatgatgggtcatgactgtaatcctagcagtttgggaggctgaggcaggtggattgcttgagtacaggagttcgagaccaacctgagaaacatggtgaaacctcgtttctacaaaaaaagtaaataaaattagccaggtgatatggtttggctgtgtccccacccaaatctcatcttgaattgtaactctcataattcccacacgttgtgggagggacccagtgggagataagtgagtcatgggggcagtttccccacactgttctcgtggtagtgaataagtctcaagagacctgatggttttataaggggtttcctcttttgcttggctctcatttgctcttacctgccaccatgtaagacagggctttcaccttctgccatgattgtgaggcctcccagccacatggaactgtgagtccattaaacctctttgtcttcataaattacccagtctcaagtatgtccttatcagcaatgtgaaaacagatgaatatagtaaattggtagagtggggtactgctataaagatacccgaaaatgtggaggcaactttggaattgggtaacaggcagaggttggaacagtttggaagcctcagaaggagataggaaaatgtgggaatgtttggaacttcctagagacttgttgaatggctttgaccaaaatgctgataatgatatgggcaatgaactccaggctgaggtagtctcaaatggagatgaagttgttgggaactggagtaaaggtgatgcttgctatgttttagcaaagagactggtggcattttgcccctgctgtagagatttgtggaactttggatttgagggagatgacttaaagtatctggtccgggtgcagtggctcacgcctgtaatcccagcactttgggaggctgaggcaggtggatcatgaggtcaggagatcaagaccatcctggctaacatggtgaaaccccgtctctactaaaaaaatacaaagaaattagcctggcatgatggcgggtgcctgtagtcccagctactcaggaggctgaggcaggagactggcatgaacctaggaggcggagcttgcagtgagccaagattgcaacactgccctgcagcctgggtgacagagcaagactccatctcaaaaaaaataaaaataaaaataaagtatctggtggaagaaatttctaagcagcaaagcattcaagaggtgactttgatattattaaaagcattcagttttaaaagggaaatacagcataaaagttcagaaaatttgcagcctgaccatgcaacagaaaagaaaaacacattttctgtggagaaattcaagaaatttgcataagtaaccaggagtcaaatgttaatcgcccggacaatggggaaaatatctccaggacatgtcagagacctttgtggcagcccttcccatcacaggcccagaggcctaggaggaaaaaatggtttcgtgggctccccctgctgtgtgcagcctacagacttggtgccctgcatcccagctgcttgaactatggctaaaaggagccaaggtacagcttaggctgtggcttcagagggtgcaagcctcaagccttggcagctcccatgtggtgttgagcctgtgggtgcacagaactcaagaactgaggtttgggaacctccacctagatttcagaagatgtatggaaatgcccagatttggagcaggcaaaagtttgctgcaggggcagggccctcatggagaacctctggtagggcagtgctgaagggaaatgtggggttgaagaccccacactgagtccccactggggtactgcctagtggagctgtgagaagggggccaccatcctccagactccagaatggtagatacaaccaacagcttggaccacgcacccggaaaagtcacagacactcaacaccagcccatgaaagcagctgggagggaggctgtaccctgcaaagccacagagctgcagctgcccaagaccatgggaacccactgcttgtatcagtgtgacctggatgtgagacatggagtcagaggagattattttggaactttaagattcgactgtcctgctgcatttcagactttcgtggggcctttagcccctttcttttggccaatttctcccatttggaatgggtgtatttatccaacggctgtaccccaattgtatctaggaagtgactaacttgcttttgattttacaggctcataggaagaagggaattgccttgtctcagatgagattttggactgtggacttttgagctaatgctgaaataagtagactttgggggactgttgggaaggcacgattggttctgaaatgtgagcacgagatttgggaggggcgaggaacagaatgatatggtttggctgtgtccccaaccaaatctcattttgaattgtagctttcataattcccacatgttgtggaaggggccccagttagaggtaactgagtcatggggacagtttcccccatactattcttgtggtagtgagtaagtctcacgagatctgatggtttcataaggggtttcctcttttgcttgactctcatttgctcttgcctgctgccatgtaagacgtgcctttcaccttctgtcatgattgtgaggcctctccagccacgtggaactatgagtccactaaacctctttttctttataaattacccagtctcagatatgtctttatcagcaacgtgaaaacagactaatacaccaggcatcgtggctcctgcctgtagttccagctacttgggaggctgaagttggaggactgtttgagcatgggaggcggaggttgcagtgacccgagtatgcaccactgcactccatcctgggtaagagagtgagaccctgtctcaaaaaaaaaaaaaaaaaagtaaaaaaaaattgcttgaaatgttaataatgcctctaagcatttgattaaatcacaatagtacttaagtgttcttaaattctttcaaagcaggaaaaatttaaataaaaacattcaaaaattgtcgagctatcttacactatagggatctacaagtagaatcaattctgtggacagttatagctgacagtagacagatatttatagatggaggtgggtatagaggaagacaaaatgaattaacgtacttgacatctgagaactgtctaaggatcctaaaaacaagaccctcacagggaagcaacaaagagagaatcgtttattctctgccaacaacatggtcagtctacattgagactgccctgccttttgttgttatgtgtcaaagacacttagattggtccagagaaaaaaggaacaaagcatccatgttgtgatgtgtggggcaaagcaagaactagatggtctaaggacaagcaaggctggggaattaccttctgctcgtccaagttacaaggaaaacaagttttgggcgagcgtccaagaacaatcacagaatcaagacaaatgacaagcgggtagtgtcattacaggctgagaattcttggtgtagaggttgaaaaacggaccttaaacctttacgggacactgacacacagagagatcaaaccctcgcccaggatgcacagtcagtgagatgcaaagctgggaagggaacccggagctccaggcatctgctcctccacctacacctgccctacccggtgcgttttctcctccctgctacctgctggtgttgccttctggaacctccgcagtttctgctttcacacctgcagggtttagtctccagggctgcttaggtgggtgccaggaactgggaatccccaacgcgggacaacctgccgggcgactcaaccagtgccacggagcccttggaaacccgcggcagctgcgctactccatttccaggcgcccagcgcggcggcgcttagccgttgccatggagactggtaatggccccgcctccgcgccgaaaaacaggcaggaaccacataacccagaaggctgtgcgcaagcgtctgcgcgcgtattggggcaatgtgagctctgggggctggacttccggcgttgggactgtcacttggctgctcgcgtcaggccacaccggtggtctgggctgtggcgcgcgggtcggggcccgaggcgggcggccaggaaggtacggaccacgagcagccggccgcgcccccaagcctcggtatcttcgagtatgacgtggtcggcccgggggcggtcgggccccggcgggaaccacgcgttctcccgccccgcggaagcccaggaggcagcgcattgggcattctgcgcccatgactgccgggcaggctgaggcgcggggcagccgcgggaggctgctggcggggatggcggtcccgggtggtccatgcctttcttccctcccagttgcgggttccgctggcggcggtggcgctgacaagcccgcgccgggggggcgggggagtccctgctcacacagactgcgcccccacggagtgaggccgcttcctagacctcgcctagtcgtctttcctctccctgccctgggggggttgcgggggtcagtgcaaactcctgcgtccagggcactggtgagctcccgacttccggcagccagggggctgaggtcccgaaggaggctccgaggggagagtcctgcgtgtgcaaaacctgggaggggagccgaagcccagatgcttctgggactgagcgctctcgatgtggagctggagtagaggggatgtgtgcggctgcagtagcaggcgagggagtgggctttatctcgagggcgtcgggagacatagaagttttgaacagaatcaggacatcctctgagttgggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggtgtcctgggctgaggacagggcctataaactggactgaagaaggcgatgagcagtcaggcgtgcggagttacagcttgagggtaaagaaaaccggctggggtgcctgaggctatcaggggaggagttcggcaggtggctgaataggagagggtggcagcaatgtgggaaagaaattgcgggagcgctgagatcgagaccatcctggctcacacagtgaaacccggtctctactaaaaatccaaaaaaattagccaggtgtggtggcgggaggctgaggcaggagaatggcgtgaacccgggagccggagcttgcagtgagccgagattgccccactgcactccagcctgggtgacggagtgagactccgtctccaaaataaaaataaataaataaataaataaataaataaataaataaataaataaattgaggagggggcgccatgtggagggaggaagggattgagttcccctgtgttcacaggttcttggggctgcacccctatgacgactggtggggatcatccagtccctcaggctggatgagcagcctggaaatgtcaggcaagcgcagcaggggaaggtctcagtgatgggcatgcctggggggtccacagctgggacttacacccttgcttattacaaaagcaagaagggcacatctggggagggtcatgaatggtcatgctgagtcacgagtggatatttggggctgcccttggtgtggcagctaagggcccagccagggcttgctctagcctgcttgtgtaggggtggccagtggggaagtcaagaagccatctggggcctggaccaggagggcagaggggaggggtcccagacaggtgagggaagtgccacctgaagataatctcggggtggaacccaaggaaggagggacactgggggaggtgactgttgggatggggagcttggtcctggctcacagccataccttagaccatgcctacctccacctccctgctgttttaggacctgatgaccttcgaggatgtggccgtgtacttctcccaggaggagtgggggctcctggacacagcgcagagggccctgtaccgccacgtgatgctggaaaacttcacacttgtgacctcacttggtaaggccctgggtgctccatgaaaagtgcacttggtgacaatcaggactgcctcttcacttccctcctggttgatgagcaggatcaaatctggccagggccacgtggaacaagggtctggtcctgtagacacaaagtttggttgggtcagccactccttgccgccctgtccagctgtggcctctctcatgcctgggctcagtcccgttgctttggtgctctgggcacagttgctgctctggggacacatgagctattcctatgagccccttgccctgtgctatctttagattctcccagttgcacagattactgtctatttccatgaagccctgactcctgctctctgttgggaggtgggttgtcttgacctggggctgggctctcacctgctcctcctcacaggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagccattattgataggtatttatttcgcccatcatttatctttgtattcatcaaatgtttcctgagggcttgtgggcattgtagacacagccttgaccaggacactcatggtcctgcctttgtggggctgatggtgctaggggagacgcagtgagtacgtaggattcaggagtgcagtcttgagcattggttggaggtcattgcaagagcaggtttgggagtgggtgcccaagacggggcaccaggggagaagggagtgagctatggaaagggagggggtggaacagccagtgtggagacgtgggtggcacgcagcagctgctgttttcctcagcttcacatcctgggtgtctgggggctgccgccttgatcatgggagtccccactgcagtcagtgccacacctgtcagggcagatgcttcctccaaaccccagcccctcctgcagagccagcctcacctcttctttttccctaagcttttgtcccggctcctgggctcccccttgcctgtccactcagcctgccctggtcctctcctaaccaggatgccccaggcaaccaccgtttctctgcgtttaggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttcctttacagccgtgtggacctccacagcacagcctcctgtctctattccagggtatgattcagttgtttgtttgtttttgagacagagtctcaaggcaactcttcttgcccaggctggagtgcaatggcacaatctcggctcaccgcaacctccgtctcccaggttcaagtgattctcctgcctcagtcttctgagtagctgggattacaggcgcccaccaccatgcccggctaattttgtatttttagtagagacagggtttctccatgttggtcaggctggtctcgaactcccaacctcaggtgatctgcccatcttggcctcccagagtgctgggattacaggcgtgagccactgcgtttgtttttcatgaagcgtctcagtctgtcgcccaggctggagtgcagtggagcaacctcggctctgcctcttgggttcaagccattctcctgcctcagcccctccagtagctgggattacaggcttgcaccaccatacctggctaatttttgtatttttagtagagacggggtttcaccatgttggctgggctggtctcaaactcctgacctcaagtgatcggcccatcttggcctcccaaagtggtgagattacaggcgtgagccactgcgcctgcctacataccatgattttaaagttgcagctgtttcctattgcttgtaactcagtcttgtcttttcaatggtaaccaatttctgtttcaaactgaaaggttcatgagggtgagttcttctattagtctgttttgtgtcactataaaggaacacctaaggctgggtaatttataaagaaaagaggattaattggctcatggttctgcaggatgtacagccatggcaccagcatctgcatggcttctggtgggacctcaggaagcttgcaatcatgatggaacatgaaggaagagctggcatatcacatggcaagacaggaagcaaggcgggggggaagtgtcacacatttttttttttttttttgaggagtctcgctctgttgtccaggctggagtgcagtggcacgatctcggctcattgcaacctccgcctcccgggttcacgccattctcctgcctcagcctcccgagtagctgggactacaggtgcccgccaccacgcccagctaatttttaatatttttagtagagacggggtttcaccgtgttagccaggatggtctcgatctcctgaccttgtgatccgcccgccttggcctcacagcagagtggtgggattataggcgtgagccaccgcgcccggcccacttttttttttttttttctgaaatggagttttgctcttgttgcccaggctggggtgcaatggcacgatctcagctcactgcaacctctgcctcctgggttcaagtgattctcctgcctcagcctcctgagtagctgggattacaggtgtgcaccaccatgtcagctaatttttgtataatatttttagcagagacagggttttgccatgttggccaggctagtctcaaattcctggcctcaagtgatccacccgcctcagcttcccaaagtgttgggattacaggtgtcagccaccgcacccagcccatcacacacttttaaacaaccaaatctttcatgaactcagagcaagagctcacttctcaccaagggggatggtggcaagctattcatgaggaatctgcccccatactatagtttggatgtttgtcccctccaaatctcatgttgaaatgtaatcctcaatgttggagatggggcctggtgagaggtgtttgggtcatgggggtggatcgctcttgaatctcttggtgctgtcctcaaggtagtgagttctcacaagatttggttatttaaaagtctgtggcacctccttcctttctctcttgctcctgctctcaccaggtgagatgcctcctccccctttaccttctgccatgattgtaagcttcttgagaacctagcaagaagcagattctgaagccatgctcgtacagccctcagaacagtgatccaattaaacctctcttctttataaattacacagcctcaggtatttctttatagtaatgcaggaatggcctaatatacctcatgatccaacacctcccactaggccccatgtccaacactggagatcacatttcaacatgagatttggaggagacacacatccaaaccatatcagttctcttgtccctgagtgaagaggcacttgctccctctaaacccaattctaggtgactagagatttatgaaggtgtcgggatgtttgttcatgatgcatagtggcctcatagggtctccctacttcttctgcaagaagaacaccttcaggggctttcagctcagccagaagattcacataaaggttgttcatctggtaccttgagcactctgccaacacaggtgatcacagattccaagacacataaaagagtgaatcacaactcactggtgactcattgaggagtgatgctcacaaagcaacacacttcgtctaaatacactgtactaaccttggtcacttttgaaaaggtatttctacaattatttgaaactgctcatgaaaactgagctttcccttaaggagcaacccccccacccttcgaaacctatggagatcctatttccaaaaacttaggtaaatggacccaggtcactcgagatgaccctaaaatgcagtggccaaaacggagatcttttgaaattcctaaagtaatatatttgtgtgcacaataggaaacttaatatgtttgttctaaaaccagacaaattggatgggaggcctactttctgtttgtgcaggctatactctgataagatatttgaaaggttttttaaaaagagctctataggccaggcacagtggctcatgcctgtaattccagcactttgggaggccaaggtgggcggatcacctgaggttgggagttcgagaccagcctgaccaacatggcgaaaccccatctctactgaaaaatacaaaaattagccaggcatggtggtgcgtgcctgtagtcccagctacttgggaggctgaggcaggagaatcacttgaacctgggaggcggaggttgcagtgagctatgaaactatagcaaactccagcctgggcgacagagtgagactccgtcacaaaagtaagtaaataaaatacaatgaattctatggtcagatgtcagcttaattaaaagctgatattcaggctttttttttttttttaagaaaaaatacctttctgctttttctcatttggagcctgtttctgggaattttttttttttctgttgactgaaacccctttttacatatgtttagtccctttgtttgcttcttttcttgttagtatgatgtaaagttttattggccttctgaaaaacttaaaatctccccaaattggcttagagctctcccattttcttctactttttcttcctttagctatctttgataccacataaagaaatctagaggagtcttctaatatctctgagaccctttgaggaacacagtaaagtgtcacatacaccttttatggagtcttctgtcttcctcatggaatcctaagtgtagcaggcagtttatcttaggtctaaagctctgatctcttttacactgagttctctgaccttttggcttggggggtaccaagggttactttgttctatgaaagaacatgatctttgggtgtgcactggctggcaagttactggcaagggctgcagttttggctgatagcagttgttttcagtgagtggttattactgcagggtgtactaattcctttgcatgtttaaataagaaaagtatggtttgaacacttggagacttatagaaacactcatcaccaagggggaagaatcctttgggagatgggctgatcacagatcacagagtgggctaattggtgctgggtgtcccaccagcatcagggaatgtccatgcagtgaggtgcactgtggaaacacagccctgtcctgtggtatttccatcttgtggggtcctcaagattccattttaaagtggaatccttgattttatttatttatttttattttttgagatggagtctcgctctgttgcccaggctggagtgcagtggcgtgatctcagctcactgcaaggtccacctcccgggttcacgccattctcctgcctcagcctcccgagtagctgggactacaggcgcccgccaccacccctggctaatttttttgtatttttagtagagacggggtttcaccatgttagccaggatggtctcgatctcctgacctcgtgatccgcccgcctcggcctcccaaagtgctgggattacaggcgtgagccactgcgcctggcctggaatccttgatttttaaagctctagatgttctgcctttcaactgtgccagttttttacatagatggggtttctctatgttggtcaggctggtctcaaactcctgacctcgtgatccgcctgcctcggcctcccaaagtgctgggataacaggcgtgagccaccgcacctggcctatgttgagttttaggccacaaaaaattgaccaaaaattttttgacaattgcatctttaaccatggacattttaagttttgtcctcagctgggcgcggtggcttatgcctgtaatctcagcactttgagaggccaaagcaggcagatcatttgaggtcgggagtcggagaccagcctgaccaacatggagaaaccccgtctctaataaaaatccaaaatttgctgggtgtggtggcccatgtctgtaatctcagctactcaggaggctgaggcagaagaatcgcttgaacccaggaggcggaggttgcagtgagctgagatcgagccattgcactccagcctgggcaataagagcaaaactccatctcaaaaaaaaaaaaaaaaagttttgtcctcttccttcttgaggagttgctttgaagcttcacagcaaccaaggaatctatttcactgatgaaacaattcaatctactttaacatatggctggttatttagaatgtccattttgcatactactctcagtcttccagactgctggaatgtacaaataaggtaatagaaaatcaatttacaaagcttacagaaacttttaaccttccgtggcctaaggcttttccaatggtcctgaatgaaggaacctacaaaccagctctccttaatgtgagctcctgggagacaaaaatatcaaagatcaagggctccaacctggagattttgtttatgagaaatgccatctaataaaggactccctacaaccatgttgaagagaactccagcctgggcaacatgatgaaaccccatctcaacaaaaagaacaaaaaaagcaaaaattagctggcatgcacctatagtcccagctacttgggaggctgaggtgggaggatggcttgggcccaggaggcagaggttgcagtgaggtgggttgtgccactgtactccagcctgggcaaaagagccagaccctgtctcaaaataaagaagttgagggaggcatatcagatattcttaaccaatccttgtgcaagctaaattcaaaggcattgacttgcagattcacatttttcatttttaaaaaatgcagcccatggccgggcgcagtggctcatgcctgtaatcccagcactttgggaggccgaggcgggtggatcacgaggtcaggagatcaagaccatcctggctaacacggtgaaaccccgtctctactaaaaatacaaaaaattagctgagcgtcgtggcgggagcctgtagtcccagctactcgggaggctgagggaggagaatggcttgaacccgggaggcggagcttgcagtgagccaagatcctgccactgcactccagcctgggcaacagagcgagactccgtctcaaaaaaaaaaaaaaaaaaaacaatcctgcttgagtagacatcttcgatcattccagatctccaactgaggcagtcccattccccaagaaggaagaggacaaaacttaaaatgtcatggttaaagatgtgattgtcaaaaaaaaaaaattggtcattttagtttttgtggccgaaatctcaataatcataattatgactgatagcataccatataccagtcatcttatagctcacacgaggatgagaagtagaaaatttgttagaaaatatcactcaggcggtcgggcgcggtggctcatgcctgtaatcccagcactttgggaggccaaggcaggtggatcacctgaggtcaggagttcaagaccaggctggtcaacatggtgaaaccccgtctctagtaaaaatacaaaaattagtcggttgtggttgcaggcacctgtaatcccagctactcaggaggctgaggcaggagaatcacttgaacctgggaggcagagattgcagtgagcagagatcacgccattacactccagtctgggccacagagcaagactccatctcaaaaaaaaaaaaacacacacacactaaaaaagaaaatatcactcaggccaggtgcagtggctcacacttataatcccagcacttttggaggccaaggcaggcggatcacttgaggtcaggagttcgagaccagcccaacatggcaaaaccttgtctctactaaaaatacaaaaattaggtgggtgtgatggcatgcacctgtaattccaactattcgggaggctgaggcacgagaatctcttgaacccaggaggtagagattgcagtgagccaagattgtttcactgtgctccagcctgggtgacagagtgagatgctgtctcaaataattaaattaaaaattaaaaaatgaaacgtttgaagagttaaaatgcctccaaatattcatacattgcttaaaatggtaataatgcctctaagcatttgatcaaatcacaactttaatactacttttttttttttttgagacagagtcttgctctgtcacccaggctggaatgcagtggtgtgatctcggctcactgcaagctccacctcccaggttcatgccattctcctgccttagcctcctgagtagctgggactacaggcgcccgccaccacacccagctacttttatttttgtattttttagcagagactgggtttcaccgtgttagccaggatggtctcgatctcctgacctcaagatccgcccacctcggcctcccaaagtgctgggattaccggcgtgagccacagcgcccggccacagcttgaatagttctaagtgttggggttttttttcttcagggtttttgaactttaatacttccttttttttttttttttttttttgaaacggagtctcgctctgtcgcccaggccggactgcggactgcagtggcgcaatctcggctcactgcaagctccgcttcccgggttcacgccattctcccgcctcagcctccccagtagctgggactacaggcgcccgccaccgcgcccggctaattttttgtatttttagtagagatggggtttcaccttgttagccaggatggtctcgatctcctgacctcatgatccacccgcctcggcctcccaaagtgctgggattacaggcgtgagccaccgcgcccggccctgaactttaatacttctaagtgttggggttttttttttccccctcagggtttttgtttgttttttcctgagacagggtctctctcttacccaggctggagtgcaggggctccatcatagctcactgcacactccaactcctgaactcaatcctcccacctcagcctcccatgtagctggtattacaggcatgcaagaccatgctcagctaatttttatatttttttataaagatggggtcacattttgttgctcaggctggtctcaaactcctaggctccagtgatcgctcaccttggccacccaaagtgctcagattccaggtgtgagccactgcgcccagtcctgaaatgttcttaaattctttcaaagtagcaaaatttatattaaaacattccaaacatgatgagctcccttgctctacaaggatttacaagtagaatcaattaggtggacagttatagctgacagttgacagagagatagttatagatggaggtaggtatagagggagggaggcaaaaagagttaaggaactggacagctgagaactgtctacaggttccaaaaacaagacaaagaaccttttattatctgccaaacaagacagtctacattgagactgctctgcctttcgtttttatgtgtcaaagacacttaaattggcctgtaatcccagcactttgggagaacgaggtgggcggatcacctgaggtcaggagttcaagaccagcctggccaacatggtgaaactccatctctactaaaaaatacaaaaattagccaggcatggtggcgcacacctgtggtcccagctactacggaggctgaggcggggggatcacttgaacctgaaggcagaggttgcagtgagccgagattgtgccactgcactccagcacgggcaacagaacaaagaccctgttaaaaaaaaaaaaaaaaaacttaaatgagtcccaagaaaaaaggaaaaaagaatgaatattgtgatgtgtggggcaagacaagatctagatggtctaaggacaagcaaatctggggaattaacttctgcccatccaaattacaaggaaaacagatgctttgggcaagtgtcgaggaacagtctcatacttaagacaaatgtaggcttacgggctgagaattcttggtgtaaaggttgaaaacggaccttaaacctttacgggacattgacacagagaggtcaaacccgcgcccaggacgcacagtcagtgagaggcagagctgggaagggaacccggagctccaggcatcggctcctccacctccacctgcgctacccggtgcattttctcctccgtgctcactgctggtgttgcctcttggaacctcggcagtttctgctttcgcacctgcagggtttagtctccgggactgcttgggaggacacctggaatgccgaaggcaggactacacaccgggcgaatccaccagcgccaccaagcccttgaaaacccgaggccgccgcgcgactccatttcccagcgccccgcgcggcaggggcttggacgttgccaaggagaccggtagtggccccgcctccacgcagggaaacaggcgggaaccacgtgacccggaaggctgtacgcaagcgtccgcggcgcgcactgggccaatgagaaccgaagggctggacttccggcggtgggactgtcacttcgccgcccgcgtcaggccacaccggtggtctgggctggggaccgcgggtcgggtccggtttccagggggttcctggtgctcgaggctggcggcgaggaaggtactggctgagggcccgcgtcgggcccgccctgcgcacgcgtcgtgatcaagggcgccggccgccggccgcgcccccaagcctctgtttctcagagtgcgtcgtgggcgtccaggggactgtcgggccgcggcgggagccatgcgctctcccaccgtgcggcagcccaggaggctgcgcgctgggcgttccacgtccatgatggccggggagactgaggcgcggggcggccccgggacgctgctggcggggaaaggctgggtggtccacgcctttcttccctcccagctgcgggttccgctggcggcggtggcgctgacaagcccgcgtcggggaagcaggggagtccctgctcacacagaccgcgccctcacggagggaggccgcttcctagacctcgcctagtcgtctttcctctccctgccctgggggggttgcgggggtcagtgcaaactcctgcgtccagggcactggtgagctcccgagttcgggcagccagggggctgaggtcccgaaggaggctccgaggggagagtcctgcgtgtgcaaaacctgggaggggagccgaagcccaggtgcttctgggactgagctctctcgatgtggagctggagtagaggggatgtgtgcggctgcagtatcaggcgagggagtgggctttatctcgagggcgtcgggagacatagaagttttgaacagaatcaggacatcctctgaggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggcgtcctgggctgtggacagggcctatgaattggactgaggaatgggcagggactcagccaggtgtgggcagttatggcttgagggtaaagaagaccagctgggatgcctggggctattgggaagagcctagcacctaactgaggaggggagggtggcaacagagaggggaagaaaggggacaccgggtgaaaggaggaagggattgagttcctctgtgttcacaggttgttgaggctgctcccctgtggcgactggtgagaatcatccagtccctcaggctggatgagcagcctggaaatgtcaggcaagcaggctcagcaggggagggtcccagtgatgggtatgcctgggaagcccctgctgggactcacagtttcttgctacaagagcaggaagggtgcatctggggagggtcatgagtggtcatgctgagtcacgagtggacacctggggctgctcttggtgtggcagctgagggcccagccaggacttgttctagcttgcttgtgtatggcgttgccagtggggaggccaagaaggcatctggggtctggtcagggagggcagaggggaggggtcccagacatgtgagggaagtgccatctgaagatggtgggggcagaacccagggaaggagggtgagtgtctgagggacatcatggaaggtggctgttgggatggggagcttggtcctggctcacagccataccttaaactaagcttgtccaacccactgcccaggatggctttgaatgcagcccaaaacaagttcgtgaactttcttaaaacatgagatgtttatgcaatttttattttttttagctcatcagctgttattagtgttaatgtattttatgtgttgcccaagacaattcttcttccaatgtggcccagggaagccaaaagattggataacccagccttagaccatggctgtctcttcctccctgctcttttaggaccagatggcctttgaggatgtggctgtgtacttctcccaggaggagtgggggctcctggacacagcccagagggccctgtaccgccgcgtgatgctagacaacttcgcacttgtggcctcgctgggtaaggtcctagatactccatgaaatgggcaactgataacaagctgactggccagggctgccccctcacctccctggtggctgacgagcaggcctataccttgcagccaggagccatgtggaataggggtctggtcctatagacatgcagtctggttggctcaaccactccctgtggcgctgtccggctgtggcctctccgagccttggctcagtccccttcctttggtgccctgggcacagttgctgccctggggatgaatgagctattcctgtgagccccttgccctgtgccatctttagattctgcagttgcacagatgacattttctgtttccgtgaagccctgactcctgccctctgtttggaggtgggttatcttgagctggggctggactctaacctgcacctcctcctcacaggactctccacctctcgacctcgtgtggtcatccaactggagcgtggcgaggagccctgggttcccagtggaacggacacaaccctgtccaggaccacctacaggaggcgcaaccctggtgagagggagctcagggtggggtgaattcaggaccaacctgtggtcatgcctctgtccctggttcccagactccccagaagcaccctcctcccctccctcccacccgattcccttcccttccatcatcagcccctcctggaggctgcagccttagctgcccttgaaggtggagctccaagggcacaggagcggggttgacacagaagggcactcaggctatggtgagaccatctcagagtcctgctatcagctgggctggcctcaaaccctccatggctagtcactgccataattgatgggtcatttttttcacccttcatctttgtgttcagcaaacatttcctgagtgctcacagtggtcaggcccagtccaggcaatgtagacacagcctcaatcaggacgaccctggtcctgcttttctggggctcatggtgtggtgggagaggcagtcggtaagcaggattcaggagtatagtctagagcactggatggaggtcattgcaggagcaggttggggagtgggtgcctgagaagggggacaggggcggggggaagggggtaagcaatggaaagagtgtgggtggaatagccagtgtggagatgtatgcagcatacagcagccgctagttttcctcagcttcacatcctgggtgtcggggggctgccaccttgatcatgggagtgcccagtgtagtcagtgccatacctatcagggcagattgttcctccaaaccccagcccctcctgcagggccagcctcacctctacttttcccctaagcttttgtgccagctccggggttccttcttgcctgtccactcagcctgccctggtcctctcctaaccaggatgccccaggcaaccactgtttctctgcctttaggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagagaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattcatgttctccttaatggaaaaaaaaaaaaaaagactaccatctgcaactcagagtaggtgttgcagtttcctgtacagcagtttggacctccagagcacagcctcttgtccctactccagagcatggttcagtcttaatagcagttcaagagcttctctgataaaggtttctttttaaacatttgtgtgaacggtagcaacctgacacctatttcaccctcatacaatgcagatggtattgaacataccctgacatgccatcagcgtttgtcatcatcacagaagttcctggacttggcttcaacctgggtaccctcaagaggccacagagtagagatacagcctgtctgcagcccagggagggagtgggatacctgtatccttttcagggtcagaggtgggttggggtagccaggagctggatgaactgggatagagtggggctgtctggagcagcagccctgctagatgagtcctggtggatcctggcaatgggaggatggtaggtggagaaaccaaggcagggctgtgttccttctgctgctgagatagagggtgtggccatgtgtgatgaccctgcaaggttgactccaaccagtgggcactccatcccatggcttccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctaccttgtcttcccaccagccgcctccctccatcaagttcctttccacgtctgcttgtgcccctgttgtccctcagtttgtccaccctcctccaatcttcccctccccaaacccatgactgatcagtggcccccaacctaggctcccacctccatgcaggtcttggcccctcggctgacctccctccaacctccccctctgctcttaattttgaataggtagtgactgtaaaagtatccctgggcttctatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatcagcctggagggaaacctccacccccgactttgtaggactgacatctgaagacgtcagagactgcggtcacaaccgtcggtacctccttagggcgcttaacagaggtcaaagatggccctcgcaccctcctggcgggagaaagcccaggctcagggtggtcttctacaccaccgcctctcccgggtccacttggaagcgagtcccagcgaactactcgacctaggaaaccactgggccgccacttccagcctcttcggaagtcgaggcaacgctcctgaacgttgccacgggaacagctggaggcgggcggatatgccctagcgttatctaggggctggcccggggaatggcgtgggggcggcggggccaagcaagcgccacctctgattgggcaaaaccccctcccctcacctgccaatagaaaccggcccactgtacagacgcgcaagtttataacccgggaagagctgctctcagagcggagggagaccatataaccctgggactctgccgtacctcctagaggaacagagcgcctctcaggcgtcagaggctgctgcaaatgcgggtcagcgggtcacggtcgcgcctgtcttgctgatgctcatgggaaatgtagttcaaagggcatgggcggtgccttcggtgcaggcgagagattggtcagcgcggcgtcgccggggcaacacccggctgaggcgccccgcgttgtgcggcgccacatccgggaagcggcctccaagcaaccgctccgggttgaggtgagcgcaggctgccagagtgggcgcagcctttccaccccgtgggagggcttggggtcgccctctggggcctgaacggctcctgctgtcggcgccctggagggcccgcccacttcccgacaggccgcgcgcgtcacctcagccttcgctcaggcctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggtgggcgtctttcactgcagaccttcagggccgggatgctgtggccatccctcgactccgcgcaacgtggagctttggccccgtttttcttggcctttgcttttcgttttcacatgcacgggccccggcagtgtgagtcgcccacggctcgctgtggtcagcgagcacgatgtccacgtgccccctccccagagccattcctaaaggaggtcccacccagtcaacctccccgagattgtggagggcgactcgtccccgtacattacagcctggccccaccttctacccgcccaccctggtccactctcctcgcacctcggctagacactgtggctcctcagcctggcgctggaactctgtgatgactgtctttctccacctctttagcgtcatctcccagcagtcccctgctggacccaactgtttgcaatttccaggaagctccctggacaccttgcgtccaagcatttgtccctgaggcttcctcctgctctcatttgccatcattgtttgggtcctgtgaccctcctccttccatgaagctttcttggccttatctcttctggcctcagagtacacttggtcctggtctcagccccctgggctgagcctggtgtctgccttcccctggccagattctcttggctgacattccgacccttccttttctgtaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctgggtgagtgtggctggcatcagcttcttggagggatagaccctggctagagccattgtgacctacctcttctcctcagatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtgggtgaggttggggtcccaccagagatgagggactcctggaggaagtgtggacattcctggctagggtgggagtcccaggagaggtgtgtcaaggctgggactcctgaagtgaatgtggatgtccctgtctgggatggggacctgggaggcaggagccaagggctggctacgtgccatgtcacacagcagaggagctcctcatctgccatggctcatgtgggcagcccctgacaccacccttccatctgccccacttttcagcaccctccagccctccacttgcagcacagtcccctgaggggaaccatggacaccaagaaccagcctccacatccttccacccacccaggattcaggtgagcagccccaagtgggaagtataggccccaggtgtgagaagggactgtccccatggctgccctctgcctggtggttttccaggctccttgactagtggctctttgcttcccagaagtggagtctgtaaaagctgtacccctccacaggacctggggcagagggacagactggtgatctattattgaaaaggatttggggctggacatggtggcttacacctgtaatcctagcactttgggaggctgaggtgagcggatcacctgaggtcaggagctcgagaccagcctgaccaatgtggtgaaaccctgtatctactaaagatacaaaaattagccagaagtggtggcaggcgcctgtaatcccagctactagggagggtgaggcaggacaattgcttgaacccaggaggcagaggatgcagtgagccgagattgtgccactgcgctccagcctggtcaacaagagcaaaattgtgtgtcaaaaacaaaaaaaaaaaaaaggatttgggcctcaagccatggaaacccagtttagagtggctggaactagtgggcttggcttcctcacctccagagaagtcagctgggaggtttgctgctcccagaggtcctgagccagacctggggatttgaacttttgtgtgtagctggggaggggagaagatgaccagctgtggcaggactccccccacacctgagaccagatggagacactctccctgggaaatgcccgaagtcccttctctcctaggggtttcttcagaggccacctgttaggcctggaagctcagcttgaggcctcttctacctggatcgcttggttcccaagtgtgggtagcaaggtcttttcctctcccggctcctctaacaactccactggggagcttcagcagcaacattgctggttgagatgtgtttcgaggctaagaagtccttccaggctccctccacagccccatggcacagtcagaaagtgaggcagggtgggtaggctgcacttcccagtgtcctcacctccagccagcaccatctctagctgtggctcctcacagctgccgccttcctgcccctggacttgccacagcttgtccctcaggattatttttcccaacccagcaaagccccagatgatgggactcaggcagcaaggagggctgacccccaatcagggagttcattcctcgataaagtcactcaggtccctgtgatgctgccaaacctgccctctgagcaggatggtgtagtagagggggatgagtgctggcagcagcactggtcaggtgatctgaaggagaacctctgcacttaacaaacacacaccttgagatcattctcagcaggaggggcagatgaggcgtaggtaacctgctgactcttccgggtaataggtaagaatgtgaaccagacagggcagggaaggggtggaaagacgcctacagtgatgggccacatccgcaggaggagtgggggctgctggaccggtcacagaaggaactgtactgggatgcgatgctggagaagtacggcacagtggtctccctgggtgaggaccagccagccccaccccgcccctctccctggggcctgcacccaccctgcagcaggcctagctgggcagggcctctgtgctaccagccctacccagctctcccaccttccagaggaacaccctgtcacctaccagaaccgaccccacccctccttcatgcaaaccccatgcctaactgtgccccccacccgggcagggttaccgccccaccagccagaggcacaggcccagtcagagctggggatgctgctcacggggacaggcgtctgcagaagcctgcgctcgggtgagtgccccacaccatccagcctgaatcacccctcctgtatcggtgggacctgagccacccactcatggggggacgggagcttgtgccacggccacaagcctgagggaggggttgctgagtgccgggactcacctggtttgcccctgcccccaggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataatatggagtttctgaataagaatcctgatttctggcttctgctggtcgggaaataggcagtttgctgtctctgcccagtagctgcagcacagggcagttgagcccagaacggccaaacctctgttgccacagaacccaggtcccaggtccccagcctcccttgctccttgccgcccacatcactcaccagcctcactggccttggaactcatcagtcccggcttgagagacacaaaggggatttcctttcgaagtacggctggacaagggggacctctgagaagaggggctgcaagcaggggttgcgccaaggccatgggtacttctaggtcaggccgcaccctccatagttagctggtcatgcagcaggaaggcaaaaggtcagctccctgggaagcaccggatctctgggcagtcactggggactcgccaatgcactgtattagttttctgttgctgctttaacaaacttggcagcttgaaacaacagattctcttatagctctgaaggtcagaactctgacatgggtcccactgggctaaaatcaaggttttgttttgttttgttttgttttgttttgtctgagatggagtctcgctcagttgcccaggctgcagtgcggtggcacaatctcggctcactgcaagctctgcctcccgggttcacgccattctcctgcctcaacctcctgagtagctgggactacagacacccgccaccacgcccggctaatttttttgcatttttagtagagacggggtttcaccgtgttagccaggatggtctcgatctcctgacctcgtgatccacccacctcggcctcccaaagtgctgggattacaggcgtgagccaccgcgcccggccaaaatcaaggttttaacaggactggttcctcttgaaggctctaggagagaataatccattttgttgccttttccagcttctagagtcagcccacgttcccccttttttttttcttggtccattcctccgtcttcaaagccagccatggttggtcacgtcttccttaggctgccagctctctgacacccatcgatcctttggcctccttaaggaccctcatcatatcttgtcccctacctgcacacttagtcacaccgcagagtcccttttgccaattgagatgttcacagcttctggggattggaatggggactccttgggggccttgattcagcactcttctccttcctactctgaaaacaaggggcattttcacaggggatggtttcaggaaatgggtgccctctcggaaggagccctcgccagctgctggtatgtgcagcatgtgcacaagtcgcaggtggatgttgagggtagctgcgactgtggttaccccaggaggggctccctgggaggggcaggaaccctgctgcggcctgaagctgggagagggaggctctcctcagaggcccatcttccccatccccttttatgagggccttctaacccgttgctcccatgtgcagggctccggaagcagggccagtttggagatggagctgggggtgggtgatctgtgagcaagcaggaggcgagagctgtgctggggacagagaagaagaagacagagcagtacccaggggctccagctaggccccagcccagaagggagagtcagggtatagaaggctgtgaaagggccagatcatgcaagaaaagctgcagggggtgagggcagtttttaaataaactttttcacatttagaagcaatttatgctcacttagaaaaatttgaaatacacaagatggcaaagaagatcatgaaaatgttccctaattcaactgtctcatggcaatgcttactccagaagtttacatatagaagtggttgaatgtaaagtttcttttaaggcaacttatgttgtttcactttgggagaccacgagttcaagaccaatctgggcaacatagtgagaccttgtctccaaaaaaaaaaaaaaattaaaaataatagtaggctgggtgtggtggctcatgcctatattcccagcactttgggagaccaaggcaggtggaccacttggagttcgacaccagcctggccaacatggtgaaacctcaactgtactaaaaaaaatacaaaaattagccaggtatggtgacatgcacctgtagtcccagttacttgggaggctgaggaataagaatcacttgaacccgggaggcagagctgcagtgggccaagacggcgccactgcactgcagcctgggtgacaaagcgagaccctgtctcaaaaataatactactactaattagccaggcatagtggcgcatacctgtagtcccagggagactgaggtgggagaatcacttgagcccaggaggttaaggctgcagtgagctctgataacaccattgcactccagcctgggcaacaggatgagaccctgtctggaaaaaaaaaatacggaaatgggagacggaagggtaggtcagagagagggatgatggatgaaataactgcaaatattcacaataggagagggatgaccccaccatatggaatgcttcacaaatttgtgtttacccttgcacaggggccattctaatcattccaattttagtgtatgtactatagaagtgagcgagcagttaacttttttcttttcatgcctggatgaatctattttctggctggcaccatcatttctaccaagaccaaagaatttcttgttccctcctcaccctgcagtacccagtgctatgattaattctcttgagtaaacacttggatactactgtggctatttctgtagtataaatttctcaaaatgggattggtgagttacagggaacatgagatttatttttgccttaaaacagcaaaaacttattgtacaattctggagaccggaagttagacaccatctcaccaagctaatactagagtgttggcaatggctgggcacagtggttcactcctgtaatcccagcactttgagaggctgaggcaggaggatcacttgaggccaagactttgagaccagcctgggcaacagagtgagaccccatctctaaaaaaaaaaaaaaaaaaaaaaacacacaattaaaaaaaatttttttagctgggtgtggtagtgcacacctgtagtcccagctacttggaaggctgaggcaggaggatcacttgagtccaggaggttgaggctacagtgagccaagatctcacgactgcactccagcctgggcaacagggcgagactccatctcaaaaaaaaaaaaaaaaagtgttggcagggctgcattccttctgtaaacactagggggaaaattgttctgtagctcatggccccttcccccatgtggtggctcacacctgtaagcccagcactttgggaggcaaaggcgggcggactgcttgagcccaagagttcaagaccagcctgggcaacatagcaagaccatgtctctactttttttcgataaaattttttttaaaaaattttaaaaaccaatcagccaattttccccaagttaatctataaagtaaatgaaatgcaaataaaatataccacatttcagccgggtgcagtggttcactcctgtaattccagcactttgggaggccaaggcagggagattgcttgagcccaggaattcaagaccagcttgggcaacatggtgaaactccatctctagtaaaaatacaaaaattagccaggtgtggtggtgcacgcctgttgtcccaactactcgggaggctgaggcaggaggatcacctgagccttgggaggcagaggctgcagtgagccatgatcgtgccagccggagcaacagagtgagaccctgtctcagaaaaataaaaagaagcacattttatatgatccaacaaaaagattctaaaatgcatgtggaaaagtccaagaattgctaagacaatttggaaaaaacgacaagtagggaagaattgtcatattgtaaataaaaacactgttaagttatataatattaaaatagtgtggtggctgggcacggtggctcatgtgtataatcccagcactttgggaggccgaggcgggtggatcacctgaggttggagttcaagactagcctggccaacatggtgaaagcccgtctctactaaaaatacaaaaaaaaaaaaaaattagccgggtatagtggcacacgcctgtaatcccagctactcgggaggctgagacaagagaatcacttgaacccagaaggcagagattgcagtgagctgagatcatgccactgcactccagcctgggtgacagagtgagactccatctcaaaaaaataaaatattgtggtattggcacaggagtggacaactaggtcaatctaggaacagaccttttggaacttgatatacatgaaatgactcaaccaatcagtgaagacagggtggatgttcactgaatattggagaaaactgaactcccccatacaaaagaaaacagatttccactttacacacactcaaaattaaattccagattaaatactaggatatttttaatgatttattaaatttttttttggtagagacagggtctcaatatgttgctcagcctagtgtcaaactcctagcctcaagcaatcctcccttctctacttctcaaattgctgggattacaggctgagccaccacacccagcctgatatttatttttaaatatcaggaaaatgtaaaactttgttttgtttttgtttgttttgagacagagtctcgctctgtcacccggggtgaagtgtagtgtgaacatggctcactgcagccttgacctcctgggcacaagcagtcctctcacctcagcctcctgagtagctgggaccacaggcacatgccaccacactcagctaactttctttttttttttttttttttttttgagatggagtcttactctgtcacccaggctggaatgcagtggtgtgatctcggctcactgcaacctccgactcatgggttcaagtgattctcctgcatcagcctcccgatagctgagactacaggcacgtgccaccacgcctggctactttttgtatttttagtagatggggtttcaccatgttagccaggatggtctcaatctcctgacctcgtgatccacctcggcctcccaaagtgctgggattgcaggcatgacccaccattcctggcccacactcagctaactttcagtttttgtttgtttgttttttgagacgaagtctcgctcttattccccaagctggagtgcaatggggtaatctcggctcactgcaacctccgcctcctgggttcaagcgattctcctgcctcagcctcccgagtagctgggattacaggcccccgccaccgcacccggctaatttttgtatttttagtagaggcggggtttcaccatgttggccaggctggtctcaaactcctgacctcaggtgatccgcccacctcggcctccccaaagtgctgggattacaggcgtgagccaccgcacccagcttttttttttgggggggggcggggagagatgaggtctcgccatgttgcccaggctgaaagtaaaaattttatgacctcaagagttgaaaatgatttcttctttttatttttttgagacggagtctcactctgtcgcccgggctagagtgcagtggtgcgatcttggctcactgcaagctccgcctcctgggttcacgccattctcctgcctcagcctcctgagtagctgggactacaggtgcccgccaccacacccagctaatttttgtattttagtagagacggggtttcaccgtgttagccaggatggtctgaccttgtgatccgtccacctcggcctcccaaagtgctgggattacaggcgtgagccactgcgcctggccgaaaatgatttcttaaataataacacaaaaagtatacagacccctaaaaccctgccaataacaagtattggttaggcagcacagaacaggacctgtgaatttgatgagttatcactcctgtgatttgatgatgtcatatggcatagttgcccttgttttgttttgctttgttttgttgagacagggtctcatttgttgcccaggctgcagtgcagtggtgaaaccataggtcactgcaacccggaactcctagtctcgagcaatctgtccatctctgcctcacgactaaagaaacaactggcaagtttaataaatcgaacttaaatctctgaaaagacactgtaaacataaataaaagataagcaaaatattggaggaaaacataaaccaaaaaaaccctcgacaaacccagaaggtatttttaaactccaaataagtccaggcgcggtggctcacgcctgtaatcccagcactttgggaggtcgaggcagggggatcacttgaggtcaggagttcaagaccagcctggccaacatggtaaaaccccgtctctactaaaaatataaaaattagccagccgtgatggtgggcgcctgtaatcccagctactcaggaggctgagacaggagaatctcatcaacccaggaggtggaggttgcagtgagccgagatcacgccactgtactccagcctgggcaacagagcaagactctatctcaaaaaacaaattaactacaaataaatatgaataggactaaaatatgatagaaacatggagaaaggccataaggcaggaatacacatcagaagaaactaggctgatagaccagaaagaaaatatgcttagcattacatgcctagcagtaatcagagaaaccccagcactgtgaggacagggcttcacctgccttgctcatggccacacaccctgttcatggcactgtgagggcaggacttcacctgccttgcccgtgaccacacaccctgttcatggcactgtgagggcaggacttcacctgccttgcccgtgaccacacaccctgttcatggcactgtgagggcaggacttcacctgccttgcccgtgaccacacaccctgttcatggcactgtgaggacaggtcttcacctgccttgctcgtggccacacaccctgttcatggcactgtgaggacagggcttcacctgccttgctcgtggccacacaccctgttcatggcactgtgagggcagggcttcacctgccttgctcgtggccacacaccttgttcatggcactgtgaggacagggcttcacctgccttgctcgtggccacacaccctgttcatagcactggttggtattcgtagcattgtcaacaaaccagatacacatcaatataacgtgatggatttctcagccttcaaaatagcaagttaaaaaccctgccaattaaaagaaaaggcataaacatgactatgataaaaaaaaaaaaaaaaaggctgggtgcggtggctcacacctgtaatcccagcactttgggaggccgaggcaggtggatcatgaggtcaggagattgagaccatcctggctaacatggtggaaccccgtctctactaaaaatacaaaaaattagccgagcttggtagcaggcacctgtagtcccagctacttgggaggctgaggcaggagaatggcgtgaacccaggaggtggagcttgcggtgagccaagatcacgccactgcactccagcctgggtgacagagcaagactccgtcaaaaaaaaaaaaaaaacaaaaaaatacaaagtgccaatagcaggtattggtgaggaaatgaataccaggacctgtgcatatgatgagctactgaaactgcctttgcaaaattatgactaagacagtgaaagagatctgactaaatcaattccatcttgcttctaacctctaagctgtcctagttcattcttgggcataggctgaagtaactttgagagaaacttatagttcataaccttatggtttatagtttaaaacacagaggataacagccctttcccaaagcagacctccttcttgcctggggaccagatggcctttgtaggactaacattagccccaagattagaaactctggtttaggagtcacgcagctggaggctagaagattctgaccctccctcaactgctcctaagatcagcgcttgggatattttgcagactctgcacttgatggatcagctggccccacccagatccataaaatggctcatctgatcttgtggcccccaggaactgactccgcgcaagacgacagcttcgactctgtatgatctcatccctgaccaatcagcactcctggctcactggcttcccccaacccaccaagttgtccttaaaaactctgctccctgaatgctcagggagactgatctgagtgataacaaaacccttgtctcccgcacagctggctctgcgtgaattaccctttctctactgtaattcccccgtcttgagaaatcagctgtgtccaggcagcaggaaaggtgaacccactgggcagttacgctaccaatcctgtgatatgattgtgtcacatggcatggttgcccttttttctttttgacagtcttgctgtcactcaaactggagtgtggtggcgcgatctcggctgactgcaacctccgcctcccaggttcaagcaattcttgtgcctcagcctcccaagaagctggagtacaggcccacgccaccacgcctggctaatttttgtatttttagcagaggtggggtttcaccatgttggccaggctggtcttgaactcctggccttggcctctcaaagtgctgggattacaggcatgagccaccgcaccagccgtagttttgttttcttgagacaatctcactctgtcacccaggctggagcaaagtggtagagtcatagctccctgcaacctagaactcctgggctcaagtgaccctcccacttcagcctccccagtagctaggacaacaggcacgtgccaccagacctcgccttttttttttttttttttttttgagacagagtcttgctgtgctgtccaggatggtctcaaatttctggcctcaagtcatcctcctgcctcagccttccaaagctctcagattataggcatgagccaccatacctggccccatagttgaacttaaaatagactatatgattatctgggggtgtgggggggctgatctagctacatgatcccttttaaaacatggagctcttggcgggcatagtggctcacacctgtaatcccagcactttgaaaggccgaggcagtcggatcacccgaggtggtcggatcacccaagatctataatttgagaccagcctggccaacagggcaaaaactcatttccgctaaaaatacaaaaattagccgggcatggtggcacgtgcctgtaatcccagctacttgggaggctgaggcaggagaattgcttgaacccgggaggcggaagttgcagtgagccgagatcatgccactgcaccctagcctgcgtgacagagcaagactccatcttggaaaaaaaaaatacaaaaattaggccaagcgcagtggctcacgcctgtaatcccagcactttgggaggtcgaggcgggtggatcacgaggtcaggagatcgagaccatcctggccaacatggtgaaaccccatctctactaaaaataaaaaaattagccaggcgtggtggtggacgcctgcaatcccagctactcaggaggctgaggcaggagaatcgcttgaacctgggaggtggaggttgcagtgagctgagatcatgccactgcactccatcctgagcaacagagcaagactctgtctcaaaaaaagagaaatgcctatttttattttttttgagacagagtcttgctgtgtcgcccaggctggagtgcagtggcatgatcttggctcagcgcgacttccacctcccagattcaagcaattctcctgcctcagactcccaagtagctgggattacaagcacaggccaccacgcccggctaatttttatatttttagtagagatggggttttgccctgttggccgggctggtctcaaactcctggcctcaagggatctgtctgcctcaccttaccaaagtgttgggattacaggcgtgagccaccactcccggccccatacatttattttaaagtaaatttccacatcttgcaataataaaataaacagtatttcaagtcaccttaaaatagataatgtctacattaatagatgttcatccacacagccccgtttatcacctggaaccatacttgagaagtcctgcctaccagtgtccatcaccagctccattcctctgtagttggtgccatctgcaagaatcgagccccttcctggggtttgcacaggctgcagcctcctcctactacagcagatgccaaagggcactgggcatggtgtgggggtcagttcactttcacacagggcttgtgttttccgtggtctcggcaacaccaacagtgtctgaacatgactgcacagacattggtgcccgccgctgcttgtgagctccaagaccatctctccttctgtgggtgccccacttatctcactttttgacccctccccaggtctctggaaccctctcttcagtcttgacttcctgctggcctgtctggaccaggtctgtcagtcctactccccagcaccagatgggccctaagaatccccctcctgccacacctgctatttcctcatatccagcctctcaggctacgatcaccacgccacccttccagaaggttccttccaaccgcccttccgaaaaggccctctccatggccctcttgtcaatgactcactcccagcatggacagcagagacgtgacccacacctctaacccatgaggctctgcccagccctccctggacatgtcagaaaacagagagaccctagtcactgtgggtccagaggcaggaccagcagccacgtccatgccttttcagagcaccctcaccagggtaaggcaagttctagcaaggcagagagggatctgtgtgaggaggtacctctcattaccaccactgttaatcatcattgacttattcattcatagagaaaaagtcatcttgaaccatcaaacccgagagcataatgtcggatacggaaagtcggtgggagaagtcatctgtcattaggggtgggagcggggaacttaacacgggcatccaggaaaaggcaggatgagaagaaaccgtggacttggtaaagtctgtaagaaacgtcaccatctgagccatcgctacagcatctgcctgtatttctcacatgcttacatgaaaggcattatttattcacttggacaacaaaggctgcttttcgtgagagtcactggtcctcccatgagggcatccaccgatacttcaagaatccttcctggggccgggcacagtggctcacgcctgtaatcccagcactctgggaggctaaggggggggcggatcacgaggtcaagagatcgagaccatcctgggtaacacggtgaaacctcgtctgtactaaaaaatacaaaaaaaaaaaaattagccaggcgtggtggcgggcgcctgtagtcccagctactcaggaggctgaggcaggagaatggcgtgaacctgggaggcggagcttgcagtgagccgagattgcgccactgcactccagcctgggagacagagctagactccatctcaaaaaaaaaaaaaaaaaaaaaaaaaaaggaagaaagaaagaaagaaacaatccttcctaggacagtgaatcactcctataatcccagcactttgggaagctgaagcaagacgatcgcttaagcccaggagttcgagaccagcctgggtaacacagtaagatcccaactctacaaaagaaaatatgttttttttaattagcaaggcatgatggtgcatgcctgcagccccagctactgggggggatcacttgagcctaggaggtcaagggtgcagtgagcgatgatggtgccactgcactccagcctgggtgacagagcgagaccctatctcaaaaaagaaaaaaaaaaacaaaaaaaccagtccccacactagcagccacccataagaatataaagaaagcatggtgccctccaccaccttttacttctatacctaaccagcaattttggggggaaaagacataaatgggaaagagttctgacacatgactagctaagaaggttttgaaataaaagtaaagagtaggaattccgccaggtgcagtggctcacacctgtaatcccagcactttgggaggccgaggcaggtggatcacctgaggtcaggggttcgagaccagcccggccaacatggtgaaactccatctctactaaaaatacaaaaattagccaggagtggcggcatacacctataatcccagctactcaggaggctgaggtgggggaatcgcttcaacttgggaggcagaggttgcggtgaactgagatcaagccactgcactccagcttggacaacagagagagactccttctcaaaaaaaaaaaaaaaaaaaaaaaaagagagaaagaaaaagaaaaaaaaaaaaaaaaaaaaaatatatatatatatatatatatatatatatatatatattacaagcctatgctaattacagcagcttgggacaggagaaacagaaagacttatagaatgaaattaagaatacgctgggtgtggtggctcacgcctgtcatcccagcacgttgggaggccaaggcgggcagatcacctgaggtcaggagttcgagaccagcctggccaacatagtgaaaccccatctctaccaaaaaaatgcaaaaattagctgagcctggtggcacatgcctgtaatcccacctactcaggaggctgagacaggagcatcacttgaacctgggaggcagaggttgcagtgagcccagattgtgcaactgtactccagcctgggtgacagagtgagactacgtctcaaaaaaaaaaaaaaaaaagggtgcagtggctcacacctgtaaccccagcactttgggaggccgacgtgggtggatcacgaggtcaagagttcaagaccagcctggtcaagatggtgaaaccccgtctctactaaaaatacaaaaattagtcaggtgtggtagtgtgtgcctgtaatcccagctactcaggaggctgaggcaggagaatcacttggttccgggaggcggagtttgcagtgagccaagatagtgccactgcactccagcctaggcaacaagagtgagactccatctcaaaaaaaaaaaaaaaaaaaaagaagaataaaatgtgtgtcaccagcccccagcacatcccctccacaatagtagagtgtagggtagggctctgcctgctcatttcgccccaggaggccaaccctccctgatagtccaggatatttttggaaaaaaaaaaaaaaggtgcttttccgtctccccaagatcctcaagttcaactagacatttcctatataaatgttttgttctgcctgttcattttggtgggtgcccttttctcccttccccaccacccgtgctcctcccagtctgcccctggcctccagccctgaggatcagttgaggtagggtccctggtattccgtaccctcctccctttgtttctgttggttgtcactcctgctgaatgtattgctttttaatactgtactgcaggttttttttaaataaaattgtttggaaagtaaaagagaaaaggaataacgtgtgtgatatattgaataaaaaacacttcatagatctgtagtctagtgggggaataagaaaaagttttaaaatttttatttattttagagacagggtcctgcctctgttgcccaggctggatggagtgcagcagcacaatgatagctcactgttacctcaaactcctgggcttaagccatcctcctgcctcagcctgcccagtagctaggactaaaggtgcacaataccactcctggctaatttttttacttttaattttttttctagagacgtggtctcactatgttgcccaggctgatcttgacctcctagggtgaagtggtcctccgaccctggcctcccaaagtgctaggattacaagcatgagccactgcacccagccaaaaattatattattatttaaatttatttatttatttatttttattttattttttgagacggagtctcgctctgtcgccaggctggagtgtagtggtgcaatctcagctcactgcaacctctgcctccccagctcaagagattctcctgcctcaccctcccgagtagctgggactacaggcatccgccaccacacccagctaattttttgtatttttagtagagacggggtttcaccatgttggccaggctggtctcgatctcttgacctcatgatccacccaccttggcctcccaaagtgctgggatttcaggcctgagccaccgcgcccgcctatttattttttctgagacggagtcttgccctgtcacccaggctgcagtgcaatggcgccatctcagctcactgcaacttttaccttctgagttcaagtgattctcctgcctcagcctcctgagtagctgggattacaggcatgcaccaccacacctggctaattttttgtatttttagtagagacggggtttcactatgttggccaggctggtctcaaactcctgacctcatgatccactcacctcggcttcccaaagtgctgggattacaggcgtcagccactgcacccagcctcaaaaattattattattattttgagacagactctcagctctgttgcctaaagtggagtgcagtggtgcaatcttggctcactacaacctccacctcccaagttcaagcgattctcctgcttcagcctcctgagtagctgggattacaggtgcataccaccacacccagctaatcaaatattattttttaatccttgcaaatgtaatagcaaaaactatgaatgccccaagctagctagggcttagggaggcacggatttgtataaagtgctggtgaacttgtaaagctgaggatccacagtgagatatttctacaacatccacaccctctgatccaacacctgcaacaatgggcttggcaagtaactcatggggaaagcacctctcttggctggggcttcctcaactatggtgggagcaacacaacacaactcatcccatgagatgtggtgaagatatcagctctaggccaggcacagtggctcacacctgtaatcccagcactctgggaggccgaggtgggaggatcatgaggtcaggagatctagaccatcctggctaacacggtgaaaccccctctctactaaaaatacaaaaagaaagccgggcgtggtggcgggcacctgtagtcccagctactcaggaggctgaggcaggagagtggcatgaacccgggaggcggagcttgcagtgagctgagattgcaccattgcaccacagcctcggtgatagagcgagactctgtctcaaaaaaaaaaaaagtatcagctctagcctggccccaggtgagtccacaagggttattcttctttttttcccactatactaacaaggacgtgagggttcttttttttttttttttttttttttgagacggagtctcactctgtcacccaggctggaggagtatgaaggaactggacaacctactgtgtgcgtgggaggatccaagtccagttgtatgaaagggccagggctcttcagggaacatgtggggctccactggccacacagggcacagaaatagcaagtcacaacaactatcacttcgcagaagagaattacagtgcacggccaccaccaatgacaaacagatgctcatagtgggaccccaactgaaaaggatactgtctcagctccaggctgcagggctgacaggaagagcctcgaatgctaccaggaactctgtgaagcccagctgcctcacagcccacgtggggtgctgcctgcactgctcccttcgaaggctagttctgtctcaaagtggcccatagcctgatgaggaggctgaggcacgggagagcacagtattgtgccaaacccctactgactccaatggggacggcaccaggttcaagaggccgaagaagagactaagagccagcaaacaagatgtagggttttactgggggcttacataccggggagagtccaggggcggtgggctgggcaggagaaccacttgcaaaaagcatgcagtttatatggcattttcacttaacatcctccccctggcaaccttcatttaactgaaagcaaaaggccaggatcccttataccaccagcattccatgggacagggctaaggacccagatgttcctcaaaaataaggaatgaatctctgagattccttagctgggaactctgaaccacactcaggtgcgtctgccacacagggccattctcaggtgtgcttaagcattgctgtggggtgtgtttactatgcacacgagaagggatgggcagggtcgcagtctgcagcactgcccacggacagccctttgcatatggcgtttactgctgtggggttccttttctcaccatcatcaccccagctgtgctcccaaagttaacccatggaccaccggcctggcaccaccacaactgttccagtgtctgtagcctcaccttcagttcctactgggccgagaagccttggaggcagaggctcagcacccacacacccccacctacatctccactaggcttcgggtagcaggtccaactcctgagactgtgcagactcccattttccagaggcctctgctcccactgctccccacctacaaagcttgccccagggcctctacacgtgccgttcacagtgccagggacactcctcccccagttacctcctgcttgcccttctagcctcagtccagcaacctccaggctttgtcagattgtgtatccacagcacttcacaggggagttatccacatccactggcccagccaccgcctcagtggcccaccaaagacccacagatgagaatcagagttctcatctctctacctcagagcagctgcgaggctggccagctcctcccacacccttggcgttacacagacagggtcatcccacagggatggctgaggttctttgctgggagacagggaagaccctaaaataaggtcttcagggcactagcccctgcactcctccattgctccttcatccacgcagacatacagacttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcaggggccggaaggactgggcccggttgtccagtacaaacagagggtcaaccacgatccccacattgaagccctcacgcaccaaccgggtcttcatcagtttgaacgtgctggtgacctccatggcgtcctgcagggcagtgaccatggtccaatcactgtgacatccacccgccccctggctatgatcttccacccacccaccaggccaccctgggctcacctggatgcggatgaaatggggggtagcgtaggcagggagccaagcgcgaacgtgctggtacaacttctccccgtcgaaagtctggccgggggctagctgcacagcagccatgcccaccttaccctcacaacctagagagcagtctggtcactctcggctgacccatctcgagggcccatagctgaccctccagcctcgcccagctctgctcactggctgtgagagccagcaagtctctaaacctctctgggccctagcacttccccacctgtaaaatcagaataacgacccctccacccacaaagctgttggaagtttaaaatgagaaccctccgcacctggcacgcacacgccatacacgttaacctgttgcaagaagtccacctgcgacaacacgccctccacctcgtgcgtggacacgttctcgcccttccatctgcaaggagggagccggcgcttgtgaccacgcccccgggaaggagaggccccgcctcttgcccccgccccgccccttttggggatcaggaggcccagtcagccccgccccctcgaaaatcgagaagccccgccttcgcgtgagaagtcctgactccaagttccgccctcttacgacaggaaagtcccgcctcttcagcctgactccctctaggatctgaaagcgtccgtggccccgcgccagccccgccccgagaaaccctgcctcggaccggaaggtgtccccgaggcggtcgcggaagtagaggaagccttcgcggtccatggccagtacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacaagaacccctggagcccaccagccaagccccctgctggaggttttcaacaacggtggactcttcatcacccagcaccctgccaaggacagacccaaagacacagacagggagatccagagatgagagagacattcagagaccttgagagactgcgacaagcgacacagaaaatgagagagaagtatagagaaggcggtatggggagcccatgagaaacaggaaaaggataacaagggatggaagacggacagacaaatggcagtgagaatagatatgaccaggaccttgcaaggccctgggagaagacactaacagaaggtacaggacaagggaccaatggctggaatgccgtcttccacagaaagctcaagagaacaaatcagatggacacccagagacccagtaaatcagagcaagagatcaaggcaggggagctggacagagccgagaagctgaggcggaggccccagatggtggtaaggcaggccactggctcagggtccagatgaaggctgcagacccctctagtgagcaccaacgtcaagcttttgagcagctcgttccagccaagcagaagactgagggtcgccacccctgccacccaggaaaggctcctcaacccccatacctagccctacagggatgcagaagccctgattgtccctcacaggctccgccgcctccatgtcgaactgcaccagctcaaagggggacagcatctggggtggagggtggagtgttgacataggtcctgtgggctcagcctcagggcagctgcacaccaggtacccgcacactcactcggaggaggcagctcatcttgcccagggccccgcagcgccccacatagttgactaagcccatgttgccttctgtggagccgtagacttcccagatccgaataggaccgaagcgctgctggaaggtctcccacacatcagcccgtagtccattgcccattgccaggcggactgtatgtgtccggtcctctggttgctacaggaatgtccccagaagggtgaggaggaggtgctcttggggcatgccttggaacctttacctagagggggtgttatcctgggtccttaccttgggagttacctggaaggtgatgggggacctctacctaagggatctacctgggttacttacatgagagtagttactggagtcttaaatagagggttacctgcaggggcgacctcagagctttgcctgggggacgttaccagaggtgactggaggcctcatctggggtctcacctaagagtagttacctagaactttaatttaatggaaatttaattttaattaattaatttttaatggaaattctcatgataggggtaggggctattatccctgttttccaaatgaggacactgaggctcaaggtagcacagct

SEQ ID NO: 599 - DNA, 232688 bp, Homo sapiens
tgaggcttctagaatgaattcagtcttccctacacttttcacttaggttttgctgaaatattttagcatttatttaaatatttataataatgtgtttcctgtgtttcagcaattcttacattctgttgctgatgtgcagacattttgcagtcattcatgaagattcaattattgtctatcttatccactgcagtatccccattgtcaacaactaagtttggcatatattaggcattcaataaatatttgttgattgaatgaattaatatgtatgtatggcaaggctcattgtttattttttttctattcactctatcttttctttggcttgagttcttatttttggttcagttatattttatctcgactgtctcaagtatttttctcagaggggttacatggatgactcacactttgagttgttacctatacttgactatctttattcaggtgactaatatcctggctggatatggaactcttgagttgctatcctttttctctgatgtcattctatcatcttttagtttcttatgtttagagatggttattccagtggcattatgattcattttttctcagtagataatgcaatctctcttctggaaggttataacaagtttttatttatctattcgattttaagaattttacctacaaataactggatgactatcttttctcagccgtctagcctggacccctgtgaatactttgaatatgcagactcatgactaggttcagcctgagaaatgtttccctggaatttgtttatctattgcttctactgtatctgctctcttttctcctcacttattgcccagatatttaatttcctggatttacccttcaatcttttatcctttctcttataatttccatatagcttttggctctatgtttgacattatttcttgcacttggtctttgggactactaacttgggtctcaaaagggaccattacttcatgtgcggaatatattaatttttaagtcatgtttttagttttttttgttgttttgttttgttttgttttgttttgagacggagtctcgctcttttgcccaggctggagtgcagtggcacgatctcggctcacttcaacctccacctcagcctcctgagtagctgggattacaggcacatgccaccacacccggctaatttttgtatttttagtagagacagggtttcaccatattggttaggctggtcttgtactcctgacctcgtaatccgcctgcctcaccctcccaaagtgctgggattacaggcgtgagccaatgcactgggactcaagtcatgtttttacgacaggaagtattttctgtgcagccctttggtctccctaagtacacaatttaattgaagttttcatctgtctcttccccagtacttctgtttctttattaccatggcacattttctgatggcttaactgtttcttctcttgggggtagctggacactcttaggtgagctgttgtctttctttgtagcttatttgggacttagattttattgatgagatagaataaaggacactggaggcaaatggttgttaggatatgggacctgtgatgaaaaggtggggtaccaggcactgcaaaatatttctgcaatctcctaccctgaatgacaaggcagaggcaaattagccaatccactgtctcctggtctctggacacttagtaaggagggacctagcacactcacctggaatcaaggtgggcatatcttcaagattttcccaggattaattgccccaggttttcactccataatccaaggaagccccacaccagttatcaccaaaaggatcccacagtgcgtaaggcctcaaccacaccccagggcccacagactccagagatacctagcttaagagagtctagtcgcttcaaattgaagtagaagaaagggagttgtattctgatcaccacattcctagaattacctaaacttatttaaccacagaacattctcattgaatgacacctattaccatcctaatagccaatattcagaattaaaagtttgaagaacacactttggaaaatgcagataaacacatcgtgttagggagcatcattaatgcaaattgacttgtcaggttaaaattttttcacagtggctttggtcatggtcaatatttcaaaagcagtgcttttgataaaccaagaaagaaaatcattaaaaaaggaaataaaagtaaaataaatgtctctaagttcacacaatgttatctgcatattttgaaaacaatttcactatttggtgggaagtcaaatgaagccatacacaaatttaatactcaaatgaggggaaaaaagttggcatcagggcatttgctgcttgccaagctgaaagaatgttattgaagatcccttacataaatgttccttgacctttgagtgaaccaacaggtcttaaaagttgcatttgccaaagcaagttcccatagcaaataaagttttcagatgagtgcatcagatttttttccctcttcggcctaaagaggaattaccatcagccatcaccaggaagagcaagttaacttttcaggttgtttctcagagaccatttaaagtctgtgctatagagtaggcatggctccagttccagaaggaagacttgggtcaagtagctcacaggcaaatgacttaaatgcttcttataagatactacctgaaacaatctctgcttaaaacatccgatctccatattgtcggatcttcctataactctgggatggcagcttttagtagcagctaaagatgtaagtattttaaaatctattacagaaatgttttatttgaaaatttaaaatgtttttatgctgactatattagatttctgttataaataagattagtagcctagaagaagattaataattgattattctggaatttatagagcttttacattaacactttggtcacatgtttaaaaggtttcatctcatttcccagattgcctctactccctccctgttctactccagtgtggcataaaaatgcaagctgcttaaaattctcaaaagcatttgtatgtctggagtttcattgtttatttatcaaaggataataccaattatacttttcacttatctggatttaagaatggtgtttatagaaaaaattaaaaagtaataccaactatgcccaactttccccctaagtgttaacagttaatttaatgacaaacttttccattcaagtaattaggtcctgaagacaaatattaaacttcaaaacaaataaatagttcaaatatactgggagcatagcaggaaagctaggattttagttatttaaggctatcgcaaaagggaagtttgaagtgctatggaattatagtgatgctgtatggaggttccaagaggaaataatgaataacaggctgaaacccattcactctaaggaaccatcattgccattgctgtggcttaagcaactttttattctctcttcctctgttggatcatttagtagtggctaagaataaatttgattgaaacaaaagcaaaaacaaaaacttcccatatttaaaataccttctgtagatttcaccaaaaaacaaaggactttcaacatgatgactgctccttgtggtttcttctaaattctgttgttcctgaataagcagaactcagcaagtgggcctctccctccactggcctccacatattgccacccccaacccaagcagtatgaccacagcagtttctgttcactccacatttgcttcttccaaaagaaaagtagtatactttagtggttaaggagctttggaatcaggcaaacgtgagcgccaaaccttaacattttctaggcagcctctaagttttcatgttctcatcaataaaagagcctaacaatagtcctacctcacaggcttaatgtgagggttaaatgggaccatgtttgtaaagggtttcacatagtgtataagacataataatgactcatgaatggtagttgaaaatgtgcaccctcacttatgagtctcttttcttcttccttttctccttcccctggagacacttagaaaagaaagcacgaccaggcgcagtggctcacacctgtaatcccagcactttgggaggccgaggcaggcaactcacctgaggtcaggagtttgaaaccaggctagccaacatggtgaaaccccttctctactaaagatacaaaacttagctgggtgtagtggtgggcgcctgtagtcttggctactcgggaggctgaagcaggaggatcacttgaaccagggaggtggaggctgtggtgagccaagattgtaccactgcactccagcctgggagacagacagagtgagtctcaaaaaaaaaaaaaaaaaaaaaagaataaagaaaaaaaagaaaaagaaagaaaagaaagaaagaaagcgaggcactgcacttcctttttctgacgcatcaagctcttgtccttcttctcatctgttctacagttttggaggcaagagttcttacagtcaggctctgacctctttctcagctttatcttctgcctcttctccaccccaaatgaacttccttccaactgtccaaccaaacactccaaatattttcaaacctctatgcaagttgttttccctgcctagagtgctctcctcaccctatttccaacaaagtcatgctcatcctttagcacaaatatcacttattttgtgaatttgaaatatacctctatcagccttctgagctcctctcttgtctgtattcccacagcactttgcactcaactttattaagttacagatcaccttggagtttgataatgaatgaattgctgtttttctttactagaagaatatgagtctttacaagacaagatctattgcttatatccccagagtttagcccagtgcctggcacttagcattcaatgatatgttgatacttaaaatggacattcaactttcttatttccccataaattctatctttcccggtggcctcaaatctcctgtaatctccactgtgatgtgtattgcccttaaaacatgaaagataggccaggtgcagtggctcacacctgtaatcccagcactttggaaggctgaggcaggcagatcacaaggtcaggagatcgagaccatcctggctaacacggtgaaaccccatctctactaaaaatacaaaaaattagctgggcgtggtggtgggcacctgtaatcccagctactcgggaggctgaggcaggagattggcatgaacccgggagacagagcttgaagtgagccgagattgtgccactgcactccagcctgggcaacagagcgagactccttctcaaaaacaaagcaaaacaaaacatgaaagctagatactgacaccctgtctcagtttggctcccccaaaagcagattctgcaacaaggatttttaatgcaagcaatttatttggaaggtaatccccaaaacaagggagggtgtgtggttggggggtagtgagaaaagaaagggcagccaatgaagggttagttgccatgtgggtgactgggtctgattcctgtgggaaaacattataaaagagaatttcctcattcaagggattaaacagctaacaaatttatcctcaatttccagatagttattagtggtagctgctcctggagaatgttcattccccagctcttccacctgcatgtacagagtagctacacttggctttggagaaaatatcaaagagatacagacttggcctttctccagccttcacttcaagagaggaatgggcaacatacacctcaggtgttggctccctattggaaaccatgatgtagcccaatcagcagccaggctctgatttcaacttgctgcagagtgacaaacatggaatttgaatagcaaaaattcccttcccagagagagcaagccagcactgacagagtaaaaaggatttttggaatagctgctccttatttatactttacttctaggattgtgggctagaaatatacataaatggatcatctgaagaaaaatatcatttacatgcaggggtgatcctgtcacagtcccagtggtctcaaggcaggaagggaaaaatctacttttttgatgatctactccaatatttaaatgtccttgacttcaaacaacaaaaataacttatatttgttggacatttactgtgcatcagagtgcaaagctgagctcatttaatcctcccaaccacctcatgaggtaattacttctattatctgtattcttcatatgagaaaactgaaggtcagatgaatgaagaaatctgcccgaagttatctactgctattaagtgtttggagctattaaggatactgtaacctgtctttttgaatccaatatgcacaaccttaacttacatttattaagttcatttttgcatgccctcaataaagagaaagacccagttactcagtgttgtccacataattcttcaaatacccttttcttgaagctatccatttctttatctatttctcttatatctttctttcttttttttcttttttttttttttgagatggagtttcgctcttgttgcccagactggagtgcaatggtatgatctcagctcactgcaacctctgcctcccaggctcaagtgattctcctgcctcagcctcctgagtagctgggattacaggcatgtgccaccacgcccagctaatttttgtatttttagtagagacagggtttctccatgttggtcaggttggtcttgaactcctgacttcaggtgatccgcccacctcggtctcccaaagtgctgggattacaggtgtgagccaccacacccagcctatttctcatatatctttcttgttgccctgtctttactcgtgtatgcttctctctgccaacttcttaattttgtatattcctcaataaaatatgtcaaagttctatgtatacaaacttcatctagttcctggcaagtccataaatcacaaatctattgttcaaaaattatccataagcataagcatttatttttaaatattgaatcaagctagccaaataaaattattattaaatttattccctgcttaaaaattacagcatgtgcaacatcaagcaattctgaagcagagaaaagtcattataatcctccaaataatgaagtgttgctttaggtgatgaatgtattctgattatgctcataaaacaggctaacaaagaaaattcattcttcaaccattatgtccaagaaaaactatgtcttaaagttgacttatgtttacaaatgtgtggtgggttctttcagcacagcatatttccccagctccttaaactggcaacgtttttaatttcactttgcttctttgccatttgatctagggcatctgacatacacagtgtggcaaatttcaacttttcttaaagtttaacattattgtcactctgtaggtcttaaatgtcagctgtttccaaaaatgtaactgtacactaatcaaaatcattgtttttgatatgacattttaactccctaaagtataaccacaatgtgagttcaacaggtgagagagtaaaagtatggggcatatgtttatggtacttaacactcattcttatgtggccctgaataagataagagatgcaactactcacttgcctcctcatgacttcagtgactcttggtgcatttgttggctttgtctgttctcccctctagatccaccttctccatcttgctctgtgcctttaggggctgacctatgtggactctatcagtgggatctcttgccctctgcctttaagttggttttgtgcagtgaagagcactgattccatctttaggtaaatttgtagtatcattttacagcgatttattcattcattcatataataaatatctattgagtgctgactatgtgactgacacattctgtgcttgtcattggagatgcagtggtagctagataaatgtagattttaggtctaacggtcctaacattttcccttataaatcccatgttgaaagtatttgccatttttttttgagatgatgatttacagacatttagcatgcctcagtcaatcggaaatagcaaaatagtgtgtaaagatcaactctgttagctttaattcaagagggaaaacaggaatccactggaatagagaagcatgccccagatcctgcagaggagaagacgggcaagcagtcccattgatggcattctactgataaaaatcagtacagtacattgcctgaagcaagagacagcttctcccagtaaacaaggatcaagtatatacccaactgtgtaggctgcagccagctcttatccataagcaccatccgctgactggagattaaactgcacagcacaatagaaaatctgctgacagaagtacacagcactggactaagtttcctgacacctctgcattctggccccacaggaggcagtgagcctactcacatggccagtacatcactactacaaccagcatgtgggaaagccaccaaaaatgctatctacaatcaaggaacttatacatactgttcactgaaagaacctagaaccaaagccaaaggactctacacaacatacattatagacacctcctcaaggggaggaaaacctcatccaaatgaaagcaaattcaaaacataagaaagagagatagcttacccagacgacaataaaccagaaaaacatactggtttattaaaattcatactcaacctgaaagtatgaatagacagatagaaaaccacccccaaaggatcacactcatgctctagcaatggatcctaactaatacgaaatatttgaaatactaaataattttaaattagtgattttaaaaaagctctattatattcaagaaaaagttgaaaaccaacacaaagaaaacaaaaaaattcaggatatgaaaggagacatatcatttttcaaaaaccaaacagaacttctggaaatgaaaaattcattgaaagaaatgcaaaatatagctgaaatctataacagtagactaggctaagtgtaagaaagattttcaaagttggaaaacaggtatttcaaattaacccagtcagataaaaataaattaagaaaaactttttaatgaacaaaggctttgcaaaatatgaggttacataaagtgtccaaacctgtgagttatacttgttccaatggaagaagatgaaaaagtgaaaagtacagaaatcttatttgaggaaataaatcaggaaaacttccttggtcttgagagggatttagacatcaaggtacaagaagctcagagaactcctgaaagatacattgccagacaacctcaccaaagcatttagtcatcagactatccaaattcaatgtaaaagaaaaaatcctaagtgtcaagagagaattgtctaattacccacaaaggaaatcccatcagactaacggtggacttctcagaaaaaaccttcaggtcagaaaagattgcgagtctatttttagcctccttaaagaaaaagaaaatgtcagtcaagaattttgtattctgccaaactaaggttcataaataaaggtgaagtaaaatctttcccaaacaaatgctaagggaattcatcaccactagaccagtcctacaagaaatgctcacaggagttctaaaatggaaagaaaaggacaatactcaccattataagaggacacataggtacagagttcacagatcctataaaacaattacataattgaaactctaaggcaaccagctaataacactatgacaggaacaaaacctcacatattaatattaaccttgaatctaagtggcctacatgctctacttaaaagatatagagcggcaaattgggcggggtggggggacagtgtgaggaacaagacccaaccaactgctactacaagagacccacctactagctaaaggcagctatagactcaaagtaaagaagtggaaaaatatatattatgaaaatggaaaacaaaagcaagcaggagtagccatccttatataagatgaaacaaactttaagccaacaacaataaaaaaagacaaagagggtcattatataataacaaagggttaaatacacaaagaagatgtaactattctaaatatatgtgcacccaacaccggaacacccagattcataaaacaaatactactagacctaagaaaacagattgatagcaatacaataagtggggactttaacacctcactgacatcactaaatagatactgggatagaaactcaacaaagaaactctggatttaaactggactatagaaaaaacaaacgtaatagacatttatagaacattcattctatccaacaaccacagaatatacgttcttctcatccatgcatggaacattctccaattgaccatacacttagccataaagcaagactcgaaagagtcaaaaaaattgaggtcatatcaagtattttctcagaccacactgaataaaattggatatcaataccaagcagaactctcaaaactaaacaagacatggaaactcaacaacttgctcctgaatgaccgttggacaaataacaaaattgaggcagaaatcaaaaaatgtttcaaaacaaatgaaaatagagacaaacacaacataccaaaacctctgtgatacagcaaaagcagtgctaagacaaatgttaataacattaaatgcctacatcaaaaagatagatctcaaattaacaacctaatgtcacacctcaaggaactaggaaaacaagaataagccaaaggcaaaactagcagaaaaaaagaattaacaaagatcagagcagaactaaatgagactgacaacaagaaaataatacaaaaggtcaaaaaaacaaaacattagttatgtgaaagataaacgagattgatagaccacaaggtagattaacaaaaaaaaaaagaagattcaaataagtacaatcagaaattataaaggtaacattacaactgatatcacagagataagatcagaggctactatgagcacctctatgtgcacaaactagaaaacctaaaggaaatggataaattcctggaaaactacaatctcccaagattgaaccagaaagaaacagaaatcctgaacataccaataacacttaatgaaatcaaatcagtaacaaaaaaacttccaaaaacaaaaataaagagccagaactagacaaattcacagccaaatttcaccagacataacaaagaagagctggtactagtctcactgaaactattccaaaaaactctagcaggagggattctttcctaactcattctacaaaactagtatcatcctgataccaaaatcttgcaaagacacaacaacaaaagaaaactacaggccaatatccctgatgaacatagacacaaaaatcctcaatgaaatactagcaaactgaatccacaagcacatcaaaaagttaagttgccacaatcaagtgggctttattcctagaatgcaaggatggttgaacatatgcaaatcaataaacatgattcagtacataaacggaactaaaaactaaaaccatatgatcatctcagtagatgcagaagaagcattagataaaaatcaaacatcccttcttgatggaaattctcaacaaattaggcattgaaggaacatacctcaaaataatgagtcgtatgacaaacccactaccaacatcatgctgaatgaggaaaagctgaaagcattccccctaagaactagaacaagacaaggatgttcaccctcaccactcctattcaactggaatagtactggaagtcctagaagagcaatcatgcaagagaaagaaataaaagatatccaaattggaaaagaggaagtcaaattatttctgttcaccaatgacatgattatatacctggaaacgcttaaatactcttccaaaagactcttaaacttgataaacaagtaaaatttcaggataggctgggcacagtggctcatgcctgtaatcccagcactttaggaggccaaggcgggtagatcaagaggtcaggagatcgagaccatcctggataacacagtgaaaccccgtctctactaaaaatacaaaaaattagccgggcgtggtggtgggcacctgtagtcccagctactcaggaggctgaggcaggagaatggcatgaacctgggaggtagagcttgcagtgagctgagattgtgccactgcactccagcctgggcaacagagcgagactccatctcaaaattaaaaaaaaaaaacaatttcaggataaaagatcaacatacaaaaatcagtagcatttctgtatacccataacatgtaaactgagaaccaaatcaagatctcaatcccatttacaatagccaaaaataaaatgcctaagaatgtatttagccaaggagatgaaagatccctataaggagaactacaaaatgcggatgaaagaaagcatagatgacacaaacaaatggaaaacattctatgatcatggactggaagaatcagtattgttaaaatgaccatacagcccaaaacaatctatatattgaatgtaatttctatcaaattaccaactttatttttcccataattagaaaaaaataattctaaagttcatatggacttaggatagccaaagcaatcctaagcaaaaagaacaaatctggagaaaaaaatgccacattgcctgacttcaaattatactgcaaggctatagtaacaaaaacagcctggtactgatacaaaaatagacacatagatcaatgtaacagaatagggaacccagaaataaagacacatacctacaaccaactatcttcaataaagtctacaaaagtaaataatggggaaaggacatcctattcaataagcggtgctgggaaaattggcaattcatatgcagaaaaacaaaactggaccccatctctcaccatatacaaaaattaactcaaggtggattacagacttaaatgtaagacctgaaactataaaaatcctggaagaaaacctaggaaatcctcttctggacgttggcctaggcaaagaatttatgttgaagatgcccaaagcaaatgcaacaaaatcaaaaatagacaaatggaatttaatttttaaaaaatctgcacagcaaaagatagtcaaatgggaattaagtatacaaaaaaaaaagaaagaaagaaaaagaaaaacctctgctcagcaaaagaaatcatcaagagtaaacaacctaccaaatgggaaaaaataaaatgcaaattatacctctgacaaagaccaatatccagaatctacaaaggagtcaaacaaagaaaaaaacaaccccattaaggagtgggcaaaggacatgatcaggcatttctcaaaagaagaaatacaagtggtcaaaaaacataggaaatattgcttgacatcactagtcatcaaagaaatgcaaattaaaaccacaatgagatctctttacacaaattagaatagctattattaaaaagtcaaaaaggaaccattgatatggtttggctgtgcccctacccaaatctcatcttgaattcccacgtgttgtgagagggaaccagtgggaggtaattgaatcatggggccaggtctttctcatgctgttctcatgatagcgaataagtctcacgagatctgatggttttaacaagaggagttcccctgcacatactctctctttttgcctgctgtcatccatgtaagatgtgacttgctctccttgccttcagccatgattgtgaggcctccccagccatgtggaactgtaagtccaatagacgtctttcttcagtaaattacccagtctcaggtatgtctttatcagcagcatgaaaatggccaaatacaccatccttttcttgggattgcactactttccaatcagtgcatagtgagggcagtactactaatgcgtacacaacacacctgcatcaactagagctttgctttaccttggtgcaatttttggaaaaatgaaaacctgctaaaaataagaaaagtaatcaattttgtatcttttaaaaaatgtaatgataataataataaaagtcagaaaaaagaaaagggaaaacttatacactcttggtgacaatgtaaattagttcaacctctatggaaaacagtatggagatttattaaagaactaaaaatagaactaacatttgatccagcaatcccactactgagcatctacccaaaggaaaaaaaaatcgttacgtaaaaaagacacctgtatttgtatgttcatcacggcactattcacaatagcaaagtcatggaactaacctaagtgtacatcaacagttgactggataaagaaaatgtggtacatatacaccatgtaataccagacatacaaagaagagctggtactagtctcactgaaactattccaaaaagtctagcaggaacaatttttttctaagtcattctataaaactagtaccatccagccataaaaaagaatgaactcatgtcattggcagcaacatagatgggggtggaggccattatcctaagtgaactaacttagaaccagaaaataaaacaccacatgttctcacttataagtggaagctaagcagtgggtacacatggacataaagatggaaataataaacactggggattccaaaaggggtgggggcggtgagagaaagggcaagggctgaaaaattacctattgggtacaatgtttcacgatttggataataggtacactcgaagcccaatccccatgattatgcaatatacctatgcaataaacatgcacatgtgcgtcctgaatctaatataaaataatttatttttgaaaaaggaagtatttgtctatggactatatttattaagtaattttccattaaaaaaattagtcaaagatcatcaagagattaatggattttttaaatgtgatatatgcatacaatggaatattatccgtaaaaagaaatgacatactgatacatgctataatgtggatgagccctgaaaatattattccatgtgaaaaaaaagccagacataaaaggtcacatattgcatgagtctatcttcatgaaatatccataataggtaaattcataaagacagaaagcagaatggtatttgccagaggctaatgggagcaggaaattgagagtgactgctaaatgggaatggggtttcatttcaggtgatgaaaaggttttgtaactagatacggaaagtgattgtacaacgttgtgaatgcactgtcaatgaattgaatgctataaaatgattaattttattttatgtgaatttcacctcaatagaaagaattaaagataaatatactggccaatcagcattctatcaccaaagataatcagaggttactatattaagatgagtttattctagctaaaagcaaaattttaaaagatgcttgtctgtaaaccaatcttttgtcctcattaaccagacagctttctttgttgttgttgtttcattttggtttgcttttggttttggttttctttttgagacagagtcctgctctgtcacctaggctggagcacagtggcacaaacatgactcactgcagcttcgacctcatgggctcaagcagtcctcctgcctcagcctcctgagtagctgggaccatggacatgagccaccacacctgactgatttctttttttgtaatttttgtggagatggggtcttgccatgtttcccaggctggtcttgaactcctggactcaagcaattctcccatcaaggccccccaaagtgctgggattatatgagccactgtctctatcccagacagctttctaattactggttctatatccaaattatgtttaaactaagaaatgaagtagccttgagaagttacacaagcattccacgcattataccatgttcaattataaatttatatattaacttttgggtttatataataaaaatactaatgataagaagaagaaccacaaaagtaacattagcataaacaataactgtaacatctaatgtttactgagctgttagtattgccaggaattgggctaagtgcttgaaaagcatcatttcatttaagcttcacagttccctatgaggtactattactatcctaatttttcagataatgacactgagactcacagagttcagataacttgaccaaggtcaagatctagtaaaatggaaaaccagaacttcaccagactgtctccagccacgtgtgtggttaatttctctgctaaattgctacacataaagcttttattggtctgccacgctttgtttagtcttcctgatgctggacaaattcaagcactaacaaaactaagtttctaggccaaaaagtgagggccagaccattttctgtgacagcccagggtcttaaataagccctgacttggtatgttgacaagctgatatacccagacagtgtttctatctagttgttctttaatgttaaatttatgaatctttaaaatattaggaataacatgcccaaactaggaaatctattaaaaaaatgacctcttaataaatattctttcattcaataacttatttaatgaatcactaaaatatctgagtatatctgtaaataggtttttccattttagacacataaaagtatgtttataaagacatattcaatgttggcaataaaggcaacagcaatttgggacctgtagatttgtatcaccccagacaattcttctgatccactttgccctacaagtagcatgctggtgacaataacaaggttgtattatactcacagcattggttctacatgtatcttatttttaaaagtagttgtaaaataaagcttccatttatttgatccttctgagaaataggtcagtatttttgtcaaatattagtccattgaaacttctatattacagtacaaatgactcttcatctgaaattcacaaaggaaaatattgattacccaaattgcttatgggagtaggaatcctgattaagtattctggattataagaaaaccttttacatttatttaatgatttagtcactccttaagaagtatttgtgttgactttaatgaattagtaaatatagcaaagaaaaatgatgatctctgagacctgagaattttgtcaattcctaaaatgcattcttaatattctcaccgtaattaacacaaagtagacactcaaaaaatgaattgtggctgggcgcagtggctcacccctgtaatcccagcactttgggaggccaaggcaggcggatcacaaggtcaagagatcgataccatcctggccaacatggtgaaaccccatctctactaaaaaatacaaaacttagctgggcattgtggcacccacctgtaatcccagctactcgggaggctgaggcaggagaatcacttgaacccaggaggcggaggttgcagtgagccgagattgggccactgcactccagcctgacgacagagcaagactcatctttaaaaaaaaaatgaattattttttctccagaaatatcaatttcagtcttggaaatttggaagcccaaagtgactagatagttgaaggttttgtggtccattgcatccttgcattaaagtcccattactaaaaaaatcacaagatactaacaaaagagtagtactaaataatatatacaagtttcttctgatcaaccaatgtttaatgattatttaatttgaacacaatcaacccatattttattgtatagacaaaatggggcattagaaatagcatggcctttggaatccaaatcatgtttaaatcaggattcattgatgttaaaattaccatttaataggatatcagggaatactagacaatttatgaagatcttcactgagcccaagtcttccatattgaaaatgggtgtaataattcctttttgacaggttcttacaaggaaaggatctagtacatgacctgtcacacagctggatctcaagaatgtttgttccaatcctgaaacaggcaaaaatgttgagagtcaagaaagagagaaaggaaagaggtcttaaaatggtaacagctattattacttgagtactaatattgatctttctgttcattttataagtgacacttcaaatcaggtcatactttccaagtctagcaaatagaattcagaaagggaatatcgtctctgttattctgtctattgccataagaatccaggaaaatcagagagaaatcaaaacatgactaagaaatgtgacatcttataaacttttttgacctactttgtcagaattttcataggtttacctttggtttcagctaaaacatccttattttgtctaagtaggccatcccaattcttcctaactgtaaattcagctcatgctctcagaataggatcctttccccctaaggcctttgctttccatttaataccctctgatacttttctccaaaatccctataacaaatattaacttacatgcaaggaaagcaagcagagtttcaaaataggccaggggtggcattcttaaaaataactctgaggaacaacatttgtatccaataaaaacatgagcagaattgaaaatacttatggtgtgggacttgtacatttatctgctctttgaaaaggtaaaataaactgaaaaattccataaaaatccaaaccaaaagtcacctgccatcaccaccactctgccctttccaataaacacttattggcagaagcaggagggaagtctatgtttcttgcctcttgaagtgacaagcacattctttcctcattcaccaagctgcttttctccctccaaagctccagctgttctcaaaacccagacattgttcccttcactggctggcctctagctctaactctcagccaagactgcttctccctgaaacctctcagggacactaacagccaggacttggaaggctgtgcctacttaaagaaagttgagtttttggcagggagagaaagagggagagaaagggggagagagatgaatgggaaacactttgtgtcagcacaaaaactcaaacaatcgtgtttggacaatgcctggtgctctgaggctgccaagtgatggttgatgaatctcatagtggttttcagattttgaggctgtgggatcttttctcattgttgtacacagtctgggacccccaagttctactgtggaaaatatgaaatacttacaagataaatatgccaattatgactacaatttctttctgttatcatatgaatatgaacacccataggaccatgagatatttggagaggcgggggcgtggatttttaaaccctttcatgtatataaataagctccccaaaggacaatgtgaattaattcttcctcaaagattataagaagtggcttatttatgtttctccaaattaatattcttccttcattggtcgtaagtgtgatggtgatgggagaaaaggaataaaaggcacatttgttcacttccaagtccaatgaaatcaacactcagaagaaaaggcaaatacctgcaactttttagaaattctggtttttagaaaatgttaaagctgtcctatactcaaactatcctgacctggctagtaaccaagaatcatttttttaactttacacaaagctgttaatcactgtctacagcacttcttgaaattacaacacattgacttgtcatgacattcagaagagatgttagccaaagactcaccagttgaactagttagaatatagatttgttaatgtgtgaaaaggacctaaaaacagaggaaagactagtttctttctcactctcataacggtatgactgcgcaccatgcagagccaagaattctggctgtttctatctgtttcaccatcccaaggacatctctgtcatctgcatggtctaagatgatcttcatttcagccaagagaagtagaaaaaaggaaaaaaaaaagggagagttcaccacttccttgtaagaaaatttgcacgtatcattcccacctacattccaccaaccataacaaggtcatgtggccatagtctgaaaaaatattctttattttgggcatccatgtgccagctaaatatcaagaaatctattgatttagcataagaattggcaagctatatccatgagccaaatctggttttaagtgagctgcaagctaagaatagtttttacatttttaagtggttaaaagaaaatcaaaagaataataatattttgtgatgtgaaaattatgtgaaactcaaatttcagtgtccataaatacagtagtacccactcatccacagtttctgcttccatggtttcagttaccctacgttcaaccgtgctgggaaaatattaaataaaaaattccagaagtaagcaatttgtgagttttatattgtgtgctgtactgagtagtaggatgaaatcttgtgctgccctgcttcatcctgcccaggatgtgaatcatccctttgtccagtgtatctgcactgtagatgctacattactcattagtcacttagtagccatctcagttatcagatcaactggccattttgtggtatcccagtgcttttgttcaagtaatccttattttacttagtaatggccccaaagcacaagagtagtgataccggcaattcagatgtgccaaagatcagctgtaaagtgcttcctttacatgaaaaggtaaaagctctggactcaggaaagaaaacaaattgtatgctgacggtgctaagatctacagtaagaatgggccttctattgatgaaattgtgaagagtatattgttataattattctatttttagttattgttcatcttttactgtgtctaatttataaattaaatcttatcataggtatgtataggataaaaatatagtgtttatagggttaatactatctatggtttcagacacgcttggggctcttggaatgtctccccttcagatcagagggactaccgtaaatttttattagaagggagccatggtccatttacatgttgtctatggctgcttttgtgctacaatggcagagttgaatagttgtgacagacatcatatggcccacaaagcctaaaatgtttattatttggccctttatttaaaacatttttccgacttcactttggaggaaagaataaatcaggtattgctggacaactagctaactcagccataccaaagtggtaaaattgattggaaaagggggtgggctttgaaaggggttgcaaatgagctgtatttgtttaaaagcctttaatatagtagcattgtttatccatttatgcattgaaaattaccccaaaacttagtggtttaaaacaataaaagtgtattattcagtttctgtgagtcaagaattcaagagtggcttatttgggtggccctggctcagattctctcataaagttgcagttaggatgttggcatgggataaagtctcatgtgaagggttgactggggctggagaagcaacttccagattgatcattcacgtggaagctagcaggaggcatcaggtgcttgccacatgggcttgtcctgcatggctgctagcttcttccacagtgaattacgagacagagagacagagtaagcagtaagccacagtgccttttatatcatcttcaaagtctcatgttgtcactttcattatattattttcattagaagaaattcattaagcctactccagcccacactcaaggtaaggagaattatcttccacctactgaagggaagaatgtcaaataatttgggggcatttaaaaatcatcacaacagtatttgagattgttttaaaaagcagataatttgtcttcagataatgctacagacatgaggctagtgattatgaaataagcctaagttatttgaccaggagaaaaggatagaggcttatgttagagatggcaatcaggttttagctctctcacctaccacaattaattggtagtagttgcttagagtactatgttgataaggattctgattagtagctatcaaatacacatattttctatcagagtaaaaaaacaaaagttcaaataatgagaatttggagaaaaagcaatttatgaagcatgtcaaagtctccagaaagcttataaaaccatggctcttgggcagcttgtccaggatgtttctctggagtcctggtttcccaggagagattccctttctccttccctcccttccttccatcaaaccatccttccttcaacaagcacttattgagtacctatgttttagacataggtattctcagctgggtgcagtggctcacgtttgtaatctcagtgctttgggaggccaacgtgggaggattccttgaggccaggagtctgagaatagcttgggcaatatgatgagaccccatctctaaaaataaataaataaatttaaatttaaaataagtcataggtactctggctgccagagatagaataagaaactagataaatatctccctctcatggtaaaatacaaatttctgtcttctgtaaaatgtctgaaattttattttccttttaagaagccatacatattatttctgattaccatctcattacactagatattttagattaacattaaataatagtggtgataattcttgcttccaatccctctattgcagggtttaccagaatatgcatcatgtaacagcatttccactgggtgttaatagacctcatttgaatagaagggtttcatgatcatataaggctgggaatgctgaattttaaaatgttaaacagatttgtctactgtaggcaactttaatgtgcccatggtccaaaaagatggtgtaacatgctatactccccaaagttatttgagtttaaaatgttgtgtgtttttgttttgcttttacaaaacgcttgttcaggtggtctggaaaatcctgcaggaggaaatctaaagtcattaagtttctttatttccctttcagtcacatcagctctcttttgtttccctaagattgtagagttcattgaaacacataaatgtccatttctacaacaatatacaaatcctagctagaaaggaaatagtggtaattactctcatgtagtaattatttaatgtctgggtattttaaaaccaaacaagtatttaaaaacacataacatcattataaattcattacaaatatataggatgtttgcacatacatacaattatataaagaaatgtgtgtatgtgtgtggtgtgtctctgtctgtgtgtgtgtggggtgtgtgtgtgtgtgtgtgtgtgtgtgtgtgtaacactttggagtcaaaacaactctccagttacctagaaatatatatttattaaacgtgcacaattgtcagacaacttattagtcattaaatacaataatgagaaagagagaatgcattacaaatgttaattcattcatataattaatagctcaaaggattgtagggagaaaatcactaagcacatcattaccataatggctagctcataaataaagtacagaattcaaaatgaggacatgtcaagggctctgcaccatttaggatttatgtgtactgtatgtaacagatatctgatgacagcggcttaaccaaacagcctcgcataatttgccttccataaaaaggaagtgcagagaaaagctgtgcagtggggtcatggtgtcagcagtggcgcacgatctatttccttgtcactctatcattcttattatgggacttaacctctcatcttagctgtgggacggtctcaagtggactattacattcaacctcactatctttttttcaagcaagaacaagaaggaagaaagcgtaaaggagtagaatctggcaggatttttttttttctcaattattttatcagctgaaaatgtcatgtagttactcctaactgcaagcaagtctggtctggagaagtacttcagctgggcccatggatgcactgagaagaattcggtctctcaaacaagaaaaagtgaatacatatttggtagatgactcgccctgtcttttccagactcttacctagtccttgagggtcagagaaggttaaagctaacaataataatatttcataagtagatatatttgtttctttctaactcatctcctatttattatacttctaacttaaaaatacccttacaatttaatttagcaatttacttttgtcataaacacaagttttcatggaattcctactatttcctttaaataacaatgaaatgactgtgtaaataatttccattaaatgtttgaaatgttcaacttcactgtgttaagaaatggtggcttgcttctgtttgtatttaaactgttcttgccagcaaaaacaattgttcatattggcagaagtagaacatttgccagcatgaaaaagtgctgtatagcactttttttttgtatagcatttaacataccataacacatattttcttttcctcacaaatctggtttaaaaccttaatttttttacatagctgtggcctcaatacttcagaattttaactttttttcaaccttgtagaatataaaagtacgtgtgtaagcatataatgccaagaaaagttttcttaaagttattgcatttctacttgaaattctggctccattttgcatagaacatggtgaatgccttcttatctagaagacagaaatatattagtacagtcactaatctctctattaacaccttaaatatctctttgattcttcttgacatccaaagagcacttttcactccttttaaaatttttttagagaaatctaatttcatgttatcaactttccaatattcatcttctacaaatggctggtagaataggtattgggtaactttcatttttaacaaatttatatgtctatgaaaatcaagatggttgtttctagaaaccatattccacccccctaaatttaatgcattaaagtaccatttatgaagaatcaagttcaaattatccacaaaagtgcatgcctctcaatgttcaaccatggggaaatgacttactatacatatggtgaattatgtcaccctgtaaaatgataatgataaagaccatttaacaacatgtaaaaatgtttataatttatgaaccggattgcaagtttagaaaaattaaatcactaaacagaccaaaactaggaggtaatatgcaataataaagtaattatggtagaaagtctatatatatatttttcagttccttacatttttctatacagcctgatttttctttaatgtgcatgtgttattttgataattatgaagaaagtggtaaaaacaacttaaacaataaataaaatcttatttctagcatcttccttttctgtactttttaacgttttttggtgggggggcttttttggaaatgctcagcagtctcctctgtacccctctgccacttcccttaaaaagggagcccctcggctgggtgcggtggctcacccctgcaatcccagcactttgggaggccgaggtgggcagatcatgagatcaagagatcagtaccatcctggccaacatggtgaaacctcatctgtactaaaaatacaaaagttagctgcgcatggtggtatatgcctgtagtcccagctactcgggaggctggggcaggagagtcactggaacccagaggtggaggttggagtgagcacaaatagggccactgcactccagcctgggtgacagagtgagactccatctcagaaaaaaaaaaaaaagggagcctcttttggcacaccccttcagagacttaccccacttttacaatccttcaaattcctatgtgtcccattttcactggccctacccactggctaggtgccttttaactatctgtttccacttggatattttaacaacctacctgaagtttagtttcccaactgtaaatagtgataatacctcttcatatagtcattatgaggattaaggaaagtaatagatataaagcactcaaattaaggtgcccaccacagttgccaccattacacaataccagtagcaatatcaataacagtactaataatacccaaatacatatatgtgtattttaacaaagttttggtcaaaagagacttcaagcaacagaaaagacctgtggaaaagttacttcaaccagagcacatggtaagaaacgttaaaaaagcaaatgagattcagagtctaagggattacactcaattccccagctggcgaatggaagaacagagacaggaaccccaatgtccgggctctgagtgtattgctctctacatttgaacatcctcatcagtgctcagcacttgcctggatggctagtacagctgtctgccaagaagatgtccttgtgtttttcctcattgctgtacatacagccttcagacaattccatagctccatggacatttgaccacccacaactcaagaacaactttccttttgccattggctcttagcacacataaattgctaatcctttcttaaactgctaggtgaacctcaaattctcatgggactcaaatttcttccagagggctcattaggtaaagggagattccaaggaactctttcctgattgttcctcactggaacagttcagtgtgaaaaataatgaccactcctaagttcatgtacctaattgcctctgtctatcctgtggccttcaattaaagtaagatcaccatccggttttttccaactttttgtagcaagattgagaagggatggggtgggttttattggacactgagaggaaggttcctgtaacagccacataaagaggtaatgtgggaaagccaaagtaagcagacggatttaaaaccagctggaacaccaccaggaaagaggttaacaccctaagctttccatgaacttttctactgcgagtcctaagccagaggatccttcatcatcagaaatgattggaaacctggtttcaaactccctggaaagatgagacaagaaatgcataacagggaaggatttacttaggttaattgattaattaatgaccacacttcaacggctcaagcttactttgtgggtgtaaatgtatgagtaatactcaaaaccacaaacctaggagcaataaaagagcttgggttgaaagttctactttcagaattatcctgattttcctctgggcaactagggagacgaaaataaagaaaccaacaggaaaactcataaatctgtgactctggaaggagagggtcacattctacttggagagaagacgctttacccaggtccagtaggaattactttctgtgatgtgttgggaagtgaatccagagcagaaaggtccttttcaatttgtatctggactcgtctacctcgccattttgttcacccacacattaccactgcctttaccccaggtgagctccacacaccaagtcacctttgaaatagaattacacttctgatggacctacctcctaaatagctctccaaccagggatgagtacctggggacccagtagaaccctcaatttgtattgactcagaacccaaaagaaaacagagaagaacatgtgaaattatcaaggtttttggtcaattctctggctatgagttagtaatttctttccaccagatttctggcttctccttgttatggttgaattgtattaaccattacccaaattcatatgttgaagttctaacccccagtacctcagaacgtgaccttatttggaaatagagatgttgcaggtataaccggttaagatgaggatatactgaagtagggtgggcccctcatccagtatgactggtgctcttataaaagagggacatttggacacagacactcactgaggaaaaatgatgtgaagacacacaagagtcatgtgatgacaaacgcagagattaagagtggtgcgagccagggaataccaaggattgccagcaaatgccagaagctaaagtggtaagcaaggattcgcccctacagactcaagagggagccctgctgacacctcaatttcagactttcacactctagaactgtgaaacaataaatttctattgttttaagcaacccagtttgtggtactttgttataaaagtgctattttaagaggccgggtgcagtagctcacacctgtaatcccagcactttgggaggtggaggcaggtggatcacaaggtcaggagatcgagaccatcctggctaacatggtgaaaccctgtctctactaaaaatacaaaaaaaattagctgggcgtggtggcaggcgcctgtagtcccagctacttgggaggctgaggcaggagaatggtgtgaacccaggaggtggagcttgcagtgagccaagatcccgccactgcactccagcctaggcgacagaacgagactctgtctcaaaaaaaaaaagaaaaagtgctataaaagtaacacagtgatctatcactgaaatttctgtaatgatctatcaaacggacatatttgttaaacaaatatgaaactagctcactttgaaaaatatttgttacccactttagagtttcactttctcaatttctgagagaaatttcaacaatgaatttgccaaaatttatcaaataactatttactttttactctaattacagtctccttgtttaggaactaaagttagataaaactagggcaaaatcaaccctacatatcggaaattaaacattttagcttcctcctccccactgattatgtaaagagatagttttttaagagtaagatcatgactctcatataaagttataactctcatataatgttaacacatgttgatatggttaggctttgtgtccccacccaagtctcatcttgaattataatccccataatcctcataatctcctcttgtcaagggagagactaggtggaagtaattggatcatgggggcagtttcccccatgctgttctcatgatagtgagttctcacaagatctgatggttttataagtgttcggtagttccttctgtgttcattctccctcctgctcccttgtgaagaaggtaccttgcttccccttcaccttccactgtaattgtaagtttcctgaggcatcctcagccatgtggaactgtgagtcaattaaacctctttcctttacaaattacccagtccgaggcagtacattacagcagtatgagaacaaattaatacacatgtcaaaattatatttaactgatttattaatgagggaatcaataatatacaaaagtaactgcttcaaaagagaattcaaatagatacagaagtaatcaggtatactaaaatgaattttctaatcgatgcataaggtgagatcagttgtaccttttttttttgaaacagggcctcattccatcacttaggctggagtgcagtggcataatcatggctcactgcagccttgactttcttgagctcagatgattcacccgcctcagcctctcaagtggttgggactacagttgcgtgccaccaagtttgggtaattttttgtattttttgtagaaacacggttttgccatgttacacaggctgttctcaaactcctgggctcaagagaactgcccacctcagcctcccagagtgttgggattacaggcgtgagccatttcactgcatttctaggaacaggaactaccatcaattttctacaactaagcattataaagtagctcaaaggcaatgaaggtgcaaattttcataggatcaggtaaactagaaggatgcattaaacatctagcatcccactgaaaagattttcactaatctcttctcacccatttcaatctctttcacaagttttcctggaatatttcttccctatgatcataataatctcatattgttgtgatcataaaataagactcatcaactttggtctagttatttatataagtgctgtaagagtgttgattatattccaacagcagcatctatagatttggctacattattctcttcttgaggtccccaaaatttagtgaggttgctgacctgagaagaagtgatgttccttaccatctgaaaacctggaactttgggagccagatacaaggccagtttttgggaaggagagtggaggtacgttttggtggtgaaagtaaagtcaacctttctaccttaaatcatgtatgactggtcatacatgattaactgagaatagaatcattcattctccaatacaatactgcagataaagccttggctacacaatcgatttgcctaactctatcttggttttgaaaaaaaaaaaaaaaggcggattcttactaaacctatgcaaataattatattgtcataaaaagttaggagactcagtaagagtgtctgatttgagttcaaaataggcaaagaacatagacaaataaaagctcaattgaattctctactgtctctcactcaatagcgaatagatttctatcatctatttacagatattgacaaataattagaccaaaaaatcaaattcccaatcactgttgccactagaaaaaggaataaattattggccctgctcaaatcaaaaccaaaaacagaggccgggcgcagtggctcacgcctgtaatcccagcactttgggaggccgaggcaggtggatcacgaggtcaggagatcgagaccaacctggctaacatggtgaaaccccgtctctactaaaaatacaaaaaattagccaggtgtggcggcaggcacctgtagtcccagctactcaggagactgaggcaggagaatcgcttgaacccaggaggcagagcttgcagtgagccgagatggcaccagtgcactctggcctaggcaacagagcaagactccatctcaaaaaacaaaaaaacaaaaacaacacaaaatcagcggggaaaaaaaaaaacctacaaaaacagagtctctaaaattcactctataagccaagaagagagcttgatctgcccacacctgggcttcatctgctcatgaggcttacttctccagcagtgctatcaacctggctttttcaggtggatctaggtggtatctcagtgagacccatgaaattataaagggataatttcttaagactaaaattatgaccctcatttacatttcaatgaatatgtgtcaaagcttttttgcttttttgcttttttttgagacggagtttcactcttgttgcctaggctggagtgcaatggctcttggctcaccacaacctctgcctcccaggttcaagcgattctcctgcctcagcctcctgagtagctgggattacaggcatgtgctgccatgcccagctaatgtctgtattttcaatagagacggggtttcaccatgttggccaggctggtctcgaacttttgacctcagatgatctgcctgcccttggcctcccaaagtgctgggattacaggcgtgagcccccatgcctggacgtgtcaaaggtttttatttatttattagtgaaagaactagtaagagattaaaaaattgttcaaagaagaattcacagaataaacacatagtcaatcaggaatgctgaaataaatttgctaataggtgcaatagtgtgcttgcctcctccataagacagaaccaattttaccatcactggacaaaatctgtttgcatttctatgagcagaaatcatttgcactaccatcagttttttacaacattaagagttgtaaaacagttcagaaacaatgaaaggtgcagttctctatagattcaaatgaccccaaaagatgtgttagccattgaaaactattctactgagctgggaggttgagagatgcttggagtcatggtaccagtaaggatcctagcagtggtcagatgccaaagacccacggctagtctcccaccctagtgctgatcttccttatccttctattcctaccgaagggagattcctgttctgagtaagaaatccataaatttatgacctaacattcttactgcctcctgccctttagcttccaggacatcaaggagatgggggccagaagtaaagagttctgggaatgaaactaaaagatcctttagtttatacatgagacaggagaaaactaagtgtgggattgtatagatggagaacagggacgataaaggcaaagctaaagggtgagttgaggcttacttgattgtgtgtatttgagaagtgagaagaagggtagataggggacaagagagatggaagggggaagacagagagagtctcagtcatcattctactgtcaggcttgacagtcaacagagattctaaagtccttaccacagtgagtgtctggcatagtcagaacttagttcgtaagacacagacatggccacagacttgtaaggatgcatgggatagacggggaaaaattatatgaacttaaggggaaaattaactactcaaaaaaagattttcaaatttgtgggtgaacctgttgacatagcttcataattgtcaaactttgagacttaaaatgtagagccagagagttatcagaagttgtcagaaagagctacctctttgcttccttttctttttcttattttatttgcacttaaaaataatgctgcagtgaatagatctgtatacataaacgtttccacgtattatataactttcttgtaaagaattcctgaaagtagaataacaatgacaaacactgaaacacaatactgttatgtaaatataaccatctaaatttccaccaagcagtgcaggaggtcatattaactctttgaaatgaatgacctacatgacaataaaaagctagggtgtgaactgatttaggaaccactcatgttccttcccaaaaactgcactgtactagcttcttgtccactatgtctccattttggagttcctggaagtgacaaatgtgagcactggagctagaggaagctttggcctgaaatataccaagagctcagtaaagcagaagtagctagctcaagcagaccagaagttctaatttgaactgttctatttctttgattaatcaagaatagaaaacagctatcttataataaattctttttgttggtagacgttaccgctgaaaagcataatagggagaaataactagaggaagatttggtgacgaaagaaggtggagaaaattactttaaatcaatgttaaatcatgctaactagtcaaacaaaaaataaccaaacaaaaaaaaatcgtgttaaatcatgatgcatgcattttgatggaaaagaagggcggctttagccaagaattgaaaagtgaaagatagcatctgtcagcagataagaaaaattgtgggcacagggggaattaccagcctccactggagccctgaaatcacctgagtgtagctgactcaagtttctcagcttgttagaactattaagtcacagaacctgcttttatcccacaaggacctgtttactgggttgtgagtgagcccattacacacgaataccatggcctactgattcttgtttccttggaaaagtgtgcttcctgctttgaaccgtcctgtaccttggctccattaggtttccatctgcttaggtcaagcgtgaatcatacacttaataggtgcaatgaaaatgcatatggcaatgtggcaaggtagtgcctcaaactttatactcagatatacaggggggaaataaaacttttattttaaagctgatctaactcttatgccaattaaagacatctccatatcttcctatttctttcaggttaatttttttttttagtaagttctcagtcctcttagaatacttccccttcacctttctcctctctaaaatattgtctgctgatatgagggaaatcatgattttaagtaagattgataaagtttctcacctgtaggcttctatgcatctcctcgtagctgggtctttgaagttgtgaagtcaggtttagcccctgggcatttgtgatgacatccattgacatgtggctggtcactcctggccctatgggagcatcatgcagacatccactgctgaagtcagtgggcccagccattggcttgtttttaggaagtccccacacattgctgcctcattgcgctgagcccatgtctctagttctcactgtcttcacatctcctgcactgtggaatcaggcacacctcaggttcatttctccatcctccacctgtgtttctttccctcacaccatgttagatgtggcttaagccaaaagcaacaatgtgcataaagacctgcacatataacccatagctatctggatggctttatggacttctctcaagactcaaacccaggagagaggataacaatgttacaggtacctgaccagcctgtcctaccttctcctgtcttaaacatttcatgcttttgtcagttctaacacacacattatttcacattttaacattacttaacagatctttcactgacttgtacaagaatttctcttggataaacatcaaagaatatgctagaccatagggcataacaacagtgaacataccacttcacacaccacaggacaatattaaagtacctatcaccacatgtcctgaccaacatttcctatgcacatttgtaacagttgctgtcccaatagccttaacatggcatctcactgtagctttaatttaatttctctggttacagcatttgagctctctttatgaacttattaaccattcagatgttcctctttaaattgctttctcatatcttcagccaattttttcattagttttctagtctttttcttattaatgttgcaattgatgcctttctatatattagtccattttgagtttcaggcactgtagcatctttctatctttttgtattttcattcatcttttaactttgtgtatggtgtctattgaaaagaaattcttcattttaatatggtcaaactgaacaatatttttccttattatgtatttttgtttcttatataaaaggccttttaccaacactcaggcacagaactattttattcaattaccttcataatttttagcttgcagaaatatctttaattcataccgaattgcctctatacggtctaaagtagggaactgagcttatttttcttcatgagcaagaattttcctaatatcgctaaaatcattactttgttcactatttttaatgtgttactttattttttagctattttttaaagttttccatatatacaggtcaatttctgagctttttattctattccattgatctatttgtccactccttaaccaatatattttttaaccatattatcgttgagtgtcttaatatctggtatggtaaatgctctcctttctctttgttttctaatatggcttagctatccatggacttttattttttcaagcatattttagagagagttttttaaattcttttaaaaatattgataacattttgaccagaattgtattgagtttgtagattcctttgaggtaaattgacttctttgctacattaaatcagtctgtttatttaaaatctcttgggctgagagcggtagctcatgcctataatcccagcactttgggagaccaagttgggtggatcacccaaggtcaggcattcaagatcagctggccaacatggtgagaccctgtctctactaaaaatacaaaaattagctgggcatggtggcgggtgcctgtaatcccagctactcggaagactgaggcaagagaatctcttgaacccgggaggcagaggttgcagtgagccgagatcgcaccattgactccaacctgggcaacaagagcgaaactccgtctcaaaaaaaaatcttttctatttttaattgagtttttaaaatttctccagaaagagactggctttctttgtaaggtggatttctagaaacttattcatttggagtaatattataaatagcatattatttctattatattttctagttaataattgctgatatgggaagatactattgatttttataagtcgtcctgtacccaaaactttgctaatctcttttacttctaatagttttctcttaatctattggaatttatatgatcatttcatctctgaactaatattgtataacactaacacagcactatgttcattgacattttagtgggcatgaaagaacactgtatattctcccttttccttcaagctatatatgcagaatcactcaattgacagaaaatttttttcattaaaattaaaaagagcctgtagccaaaatgtgaaaatttctctacaattctcctttcctgttctgttgtttggtttgttttcttttatcttctttattttcagattttgaattttcttgaatttcatatattctgtttctataactttagttgttacccttgcaatttccacacggacagtttgacttaaaattggaaacaatttatctatcttcttcctgaataataaataataaaaagtcttcaaaatcttttactccaatcactcctctcctattttacatgttataatgggctagtatttgatttccattttgtgttttcatccaatttaatcagaattatttttattttatatagtgttaattatgtatttccacgttcatcactttcttttgtcacactgcttcttccatctcattcccttctacattcaatgcttttattcctaaagtacatcctcgtgtaattttttcagtgagaatgtctaactattaaattatttcaagaatgtctttcttatttcttctgacctctagtgttgccattgagaagtcttttgtcaagttcatctaagtacctactttcacaggcaatattctttcttcgttgttcttttttccatttttctttaattgctgtcatatgatgctttgcaatttggttgtgatgtttccgggtatggatttatttatctgttttgtcctccttagttctcacttatcactaagttcaactttaagctgatgattattaacttgctcttcagaagtccaacatatgaggagctagcctaaggaatgtactatcaagacattccaatctggaatactgtacatttaaacctcattagcttaccacactacaaattacatgagttgagttacatgttggtgtcatgactttagctttcatcagggttcaacataagccatatacataatatttctatgtagcctataaatcatagtttaaagcattatattagaaaactgagaggtcaacagttccaaatttctctacctccaccccaagtattaatcattctctccttccaccctggctctgagaaacaagtgtctcttttcctctccaaggctcactcatcttttcttccactatctctcacacttggctcagtaattatacctttactctgaggtcatgtatgacttttccactccacccactctttccttacagttaaaaaaattcacatttcacactttctaaaaaataaaaactttccctcatccctgcctgtctctcaagctaattacctctctttctcactctcacagccaaaattcctgaaggagggagaggttgtgtcccctataccacctacccagccccacatgcccatttcatcctagccctgctgcaatttggcttcttctcccatcacttcatgcaactactccaggcaagattactaatgacttcctgacctccaaagcctaaggagtcttttcaggacaaatcctgttttggtgctccaaagctttggacatcttttcctaatttgttatcgacccttagaattcttctatggtttttcagattgctccctggattgctttatcatactatacttactattcctctgccccgctttaaatgagggaggcctatgggtattcctgttcctcttctcatacccacttccctggctttttagctcatacttataagttgaagactcttgaaatatttatctctaacccttgcctctctcttgagctccaaatccaatttctcacagcttcaatcgacatcttcaacaggatgcccaatcacatctcagattcaatgtctccaaatagaagtttgtttctttttctttcaaatttttttcttatattccctattctgatgtgcaattgtcattcactgtccaaatttaaacagagcaattctctagtccaacattgtcaaatagaacttccagtgatgacggaaatccagtatggtagtacaagccacctgtggctatggagcacttgaaatggagctagtgtgaatggagaactgaatttttaatatatttaatgttaactaatttaaatttaaatagccacatatggctattctgttggagagcatagctatagtctttcctctcacctaaattatttttgccaccatgtcccatggtttctatcttctaaatttatttgggaaatatccttttgaaagcactcattcttttctattgccactgtaccacttgcaaatgtcaatctgtttatttactttccctgccctaagcatcttcattaatctcattttatattttgtacaagatgatatctaaatgtctattcatggcctataaggcctttcattatgtggtctactttcctccccagctactcccagtgccctctgtgaccaccacgttcagctcttcacccttctcctatatgcccagtaacacctcctagctcttgaacattctgtacttctgcctacaatatcactcctctttatcttttccatgaatttccactcatattaaagggccaaatcagatgccagctcctcattaatgtcattcctgatcatccatggaaatcttgttcctgctttctttgcatttttataacatttaacagatcctctatcatagcacttagcactgtgtcctatgtttgcttgtatatctgcctcactcttctgcagagcaaaaacaatatcctatgtaaccttctcactcctatctgtgaataaatgaatgatcataaaattcacaattcctcctataattaagagtcaaagatgcttcacctgaaaaacctgagtgctgcctttatttagatagctaaagttataaacctatttttttcttattgtgtctgagagcctttcattatcagatgcatgataatagagctttctttatttttctataatttaatttaggtagatcacataacacccctagctctattatttattatctttgcaacataatccctctaagtctcaactttcccatctgaaaaatgggagtaatgattgaatggagaggactaatggtggaaaaggaaagaaaaaacagaaagagagagaaagggaggaaggcataaaggaagggaggcaggaaaagggacagaaagggagcgaggaaacatactgtaaactctcaggtggagatacacttttccaggcctcccttattgctcacaagaatataccgatgccaatggtaccactgatttggagtgaggttttcccagatctgagaagaattgttttttttcattctctctgtgaagaattgcaggtcaattcctaggcaacactgggtgtcatcagagctaggtctgaggcattcctaaaaatcaattgcccagtccatttgggatagttttgatagtttgcaaatagttttgattctgaatttgatctgaagatcataattacacattcatttatctacaatagttttctatgcctgctacagtttcatgaggactcagtgagctcttaatgtgataatccttttaaagcgttttgcccatagtaaaggctcaatacatgatagctatgaatattatttatagtattccataatcctgcatgttctgaaactgcaatatttttgaatgctgaaccataactttcttctgctcaagtgctaaaaagttcacagtaactaatggctgatatttgtgtatatgcagcacttatcgttaccgtatttttatttgtgtgtgtatttgactgatgtctgtctccccctctaggctatatctccatgaaagcaagtgctctgtcagttcttggttaccattgtatgcccagcacttaacaaagtgcctagtacaccaggagcactcaataaatatttgctgaaataatttgttcacttatttgaaaaacatttcagagactgtgctagacattagagataccaaagcatttcaatgaaagttttctgcctcaatgaatgttagttgaaaaatccttataaggagggtatcaaaccagtcaggatagaggggatagctacgaaatgctttccagagaaggtgacagttaagctaatcttgaaataggcaagaaaaagagaaagaatagtctagaaagagcaagtacacacacacataaaaatgataaagaaaggaaagtctttctgtttaactggaaaagggtctgtgagaaagagaataacaagaaacaaggtgaaaaagtaaagagacatgggaacatgtattgtgagccatattaaagattttgcatttaattatgaaggcaatctggagacattgaaggatttgacacacagaaagagaataacctgaaaaacaaatgaggtggactagatctctaaagtgtctccaattttagcagtttgtgattcagaaatgttgaaagctaaattgaatactcaaatacaggttatgtgtgtctgtgtgtgtgtgtgtgtggagagagagagagagtagttagattaaactgctataacaaacagactcaaaatgtaatgacaaaaaaggttcatgatgctctcatatgcagcccaggtctgatgttcatgattgccttttatggaggagagaaaggatcagctcctcaaagtccctcgaggctaacagagctctgccataatcaacatgtggcttccaagatcattttggttttcatgtcaccattccatcctttgtgaatggattatagcatatgactcagatctggaaatatcacacatcacttccattcattaggatgcagtcacatgaccacatctatctgcaaggaagtctaggaacggtaggctagctgcttgctaaagcaccctctgccacactattttaatttagactaaggcactctctgccacactattttaatttagaatttggggtatgtttgtactctgtttctcctaagtggttttataattttttttctgttttaatcctcttagtgtttgtagatttcattataagaggtctcaaatccatttttaaagcaagtagagtgcaaaccacaaataaagcaacaatcataaatttgactaatgtcaacaaaagtttatagtattttatagttcacaaagcattttcacactctttagtttgtttttttaaagcaaccctttgatgtaagcaggaaactgtagttactaacaattttgaaatatacatgttatttggagaggtaagtaatttacgtgaagttgcctaattacactcattctaacagttatttaaatgtagagaacatttaagtgtctttcaaatccctcttaaaatgcagaaggattttttcaagtctcataaagaacagtttctccttattttaaaataaaggacatattcattaggagcagatatattctgacaccttgttaaaggggttaaggtggtatattcgtttcctagggctgccataacaaagtcccaaaaactgaatggcttcaataacaggaatttattgtctcatggttctggaggctagaagtttgagaccaagttgtcagcaggccatgcccttctgaaggcactaggggaggatctgttccaagcctctcttctagcttctggaagttctttggcttgtggcagtataaataacttcaatcttcacagaactgtgagacaatatatttctaattttctcatctttggcttggatttagtcaatgagacaaaggcctacatattagggaattaacaccctgcaaggaaatgaagacagctttcctatgcccaagaaggacttggaaaatgcggcagtagaaagaagccaacaaaaaaattccaaatgctctggccatgttaggtttgcccttcaaaacattttaccagcatttggcatgctgcccccgaccagcccttccctggaaaggaacagtgtgtgagccccccacatctatgtaagtttcccacttgtctccactgagcaacattcttcccatgaggtcatgttcagcccccatctttattccagatgacttttcaattcttttggtacctagcttttatatatttcaactgtggacatataaaacccaaaccaagcacaagatagggtacagagagcccagctgttctatagaaaaacatctttcagtactttctcccttttcaccagccccacccaacttccccaccctgtgtttttctaaaaccccaaagaagaaaggaggacagagagtaaaatgtttttactgttcaccagtgaactgggaaggtgttgcttctgtgaaaactcatgccccggtacctggcacactgaacactctgctgcttcatttgtctgactgccttgttcacacttgccaagccaacatctgtggattgcatgactttttaattagaggagatggagagtgtgcgtttaaaaaaaaaaagaaaaaaagaaacatctgataggacttgcacctcaaacttctacccacctttctcttccacaccactccaggatttttttcccccaaattaacctgagagatggaaccacctctggtccagcttgaggcaaatttggcagctttagaggttgaatggtgacaacttactaacaatctgcttttctctgcaaattgctaaggcagtggcatttcttggccaattcaaaaatcaggtgatttccaaaaaaactacagcacatttttgtctagagttctcatccaagagccaaagcaaggtgctgccagaggctgctggtcctgactctactgctgaaatgcagtcttaccaggaggttggcattcctgagctatttcttctagaaagggatagaagttaaggcaaaaatttggaggattacaggataaaaggcagaggaaaaggataagaagagaaggtaaatgtctactaagatgtggtacttacatgaatgtggtcataagaaaggccaaattaggcagcaattttatagagttatcacacccagatgtgaataggctgcattcaatatcaatccgcaaagaggaactctgcttatattgtctccttcttgtaaacaccagggtctcagttgcaaatgtctgttaggcccacctgaatcagcttctctttgttacacttcctaaaaggattttcttaaatgcaagcacaaatatgtcactcccactgcttaaaacgctacagtggaaactcccactgcttaaaatactcctgctcttaaagttcaagctctcacccaccatggctttaaaaaccttgcttctagggcctttgcctaattctacagcttctccttcccaaatgcattctatgctccatccatgcccagttccttgtagttcttttaatgcatcctgtttgtctgctgtcctaattcttgccttccaccccacccttagctctcttcaggctgcttgagactatcatcccctcctccttctcttcctccctttttttgtcttatggtcagttggctaactcccacttaccctacaggccttaatgtcaatttcagttactctggaaagccttatctgccttatttgccttgcaaatctgtgttaaacacccttcccatgagctttcccagaaccttgtgttttccctttgatcaggtgcaaccttctgtattataacttcctggtcactcatctctctcctattcttacacccgcccaccctaactcgggactactgactccaacaacaagcagcaggccaatcttgcgcactaggaccctagcaccacacagtgtcctgaacatataggtgatcagtaaatatttgttgatgtgatcagtcatttattcaattaaaatatcccatgctccaatagtggagatagaaaagtctttggttcatgtctttggttcccaatctttctatgtaacccttgatcattatatttcagctgcagccattttataaaaagaaacagtgggataaaagatgaacatcaccaacaaaaccactttctggctgagcgcggtggctcacacctgtaattccagcacttcaggaggccaaggtgggcagatcatttgaggtcaggggtttgagaccagcctggccaacatggtgaaaccctgtctctagtaaaaataccaaaaaaagttagccaggaataatggcgcatgccggtagtctcaactactggggaggctgaggcacaagaatcgctcaaacctgggagatggaagttatagtgagccgagatcgcaccactgcacttcagcctgggcgacacagtgagactcgtctcaaaaacaatagcaacaacaacaaaaccccactttctttccttccacagttgttaaaagactcagagtgtttcaattttttttttaatttttgtagagacagggtctcgctatgttgcctagatggtcacaaactctggcctcaagagaaactctcaccttggcctcccaaattgctggaagtacaggtgtgagccaccacacccagccactcagactttcttttttttttttgagacggagttttgctcttgttgccaaggctggggtgcaatggtgcttggctcaccacaacctctgcctcccaggttcaagcaattctcctgcctcagcctcccaagtagctgggattacagacgcccgccaccacgcccagctaattttttgtatttttaatagagatgggttttcaccatgttagccaggatggtctcaatctcctgaccttgtaatctgcctgcctcggcctcccaaagtgctaggattacaggcatgagccactgtgcctggcctccactcagactttttaaacaagctatataagctcaatccttgttttagactcttctcaagctcagattttcactgattatcagttcatacttggctgagactaggattcctgaatcctcaacctccttccataattacagccacccccagagactcaagaccaacttatccattacagggtctagtgtccaaaatatgtttagaagttcagaaaatgtttttatttcttttaagatcaaagagaaaaatattttaggtcctaaaaatttaaaaataatataaatatatttgtccttacaccaacacgtcataaaatataatttttaatactttttatagaggaagagggtcaataaagtcaatagtacctaaggcccattaaaatcatgatttagccctactgagtgcctgaaaagtgatttgggcacagacaacaaggaaaaggagcagaattgtctcattaccctggagtctcaatggagcccttggtgagagagctgaaccatgtgagcaattcaagtagtgcttttgtccctcttgtctaagggactgtatcacgaccagaccgaaacttctctcactcttttttctcaggtgtttatggtgactgtcagcaacccacttcacctcaccatctaccaaataaaattgcttctattactagtaactaacaacaagtttcatactctaatccctcacctctttacatgcaaacagcagcatattaaatgatatttctcagatgggcccattgctccaagtcagatgcatggcccttcacaaagttcacacccatggtctcaagtgaacagggcaaactgggcaacaacctcttcagacctagggaaagacccaaaaatcaccctcctaacctaactggaaaacacagaacactcccttatagcaggtgagtgtcacacaatccattcacagaatagaagtgggtaaatccatgcttgcttatatttccaaacatgtttagagccatcatgtacgagcagaatgcattctggggcaaaggggaaaatggaaaagttcagaaatccatctagaagaaataggatccggtaagttacaaaatgaaaaatgttcgaacatcacatcactgtaagattggttactaaaacctgctctctgtaaatgtgcatccaagctgatatttggtccaactgggtcacaagcaaaggcagacagtgagaatttgaaatcctttgaacacatggaatccacaaatgaagaattgtttgttgagataaaaatttgaacttgctcatgattatagactactaataacacaattataaatataaccaaaatatccaaaagcaaaggagcatacgaacaaaggaaaacagagacaaagaccatgtccctactatggtcaaaaacctgcagtagtttctcatttccctcagagtgaaagccaagttctttgccatgtcccgcactgtgcccacagtctggcccacttcacagctctgagctcatctctcctggcacagctccaaccacactcacctccttgctgttcctcaaatatgtcaagcatgccctgcctcagggcctttgcaaggagtgttcctgctgcctggaattctcttccccaaggtacccactgggctactccctcatctccttcaagtcttcgctccaatgtcaccttctcaggtggccctctccctaaccattattgacttattacactatctccttgtgcaacaacaaaggtcaagaccacagactttttccagttggctcatagatggttcccaagcacctaggatagggcctgatacataggacataatgaataactatttgttgaatgaccaaaacaagactaaaaacaataatttagctatataaaaagaccaaggtgagtaatcctggaataattcaagaaattttgatgggatttaataatttacaaaaattaagtacatctgattagcatttcaacaggagaaaggtgatttctcaaactaatattttaagaaaacttcagcaagcgatagtatacagtcatccccacagtatctatgggggactggttccaggatgccccatggataccagaatccatgatgcacaaatcccttatataaaatggtgtgctatttgcatataacatacacacatcctcctgtatattttaaattatttctagattacttataatatctaatacaatgtgaaagttatgtaaatagttgttccattgcattgtttagggtaaaatgacaagaaaaagtctgtatatgttcagtacagacacgactatttatttattttttctaaatattttctctctgcagttggttgaatccatacatgcagaacccacagatatggaaagccaaatgtgtatccaggagtattatctgtatgggccattgaatacatagaacttaatgtgacttaaaacattatattataaattaatttagcatctaaatgtatgttaaattataagcggactcttattttttaaataaacaaataatcatgattctgctataatgttttcttttacttgtctgattttcactcagggactcactagctatacagttagtgaaaaagtatcacccagaacctgacattttctcttcaacatgcccagctttaaggacagtctcctttctgccacggatcaattcaggaagtacaaagtcacaggatttaggtgagaagaaggaacataagcttgagagaaggctgattttgcagagctaaaaagttgcaacttttaaattttttggcatctatttaaccatatcactacatgaagtgtatttggtatactataattaaatgttgagtccttgttgtgtttgggagaagtcatccaacaatttctagaaaagcagactgatgcttaaaagccttcagccacaagaaacaattttttttttttttttgagacagagtttcactgttgttgctgaggctggagtgaaatggtgcaatctcagctcactgcaacctctgtctcctgggttcaagtgattctcctgcctcagcctccccagtggctgggattacaggcatgtaccaccatgcctggctaattttgtatttttagtacagacagggtttcaccatgttggtcaggctggtctcaaactcctgacctcaggagatccgccctcctcagcctcccaaagtgctgggattacaggcgtgagccaccgcgcctggccgaaacaactttcttattactttgcttcaccacaaaaagaattcccaaaacactgcttcacaagaagtagttctcttctctgcctagacaaaataaaactatcattaggcagatttaaactgcagcatatatagaagagaaagggctgcccaaatccaacaaaagctacccaaagtggttattcatctctctcccatgtgtgtaagcttcacgaaggaaagaactgtatctgtcttatcactgcatctcatgatttacatatggttggctttcattaaatagttgttgaatgaatgaatggttcaaaaaaaggaaccaatcactgctctctgggttcaagatgggaaataactacaaactaaacactgagcaccttctcataattctaaaatatacatttacaatttctgtccttttttgattcattattaaatctcattaatatttcttgtatttttctgaattgcttacttttgtcttttggaataacttaattcttttatctttttcattcattcaacaaatatttattcatcctgagccaaactccctcctacagagaataatgaaagaacaaatgccttaaaaacagacttgcagatctaaatacctattccaccaatctccagtgaagtggcttcaagcaacctgcctagcttctcctagcctcagcaactataaatgaaatcattgaagtacacagtttgaggactaattgagatcatgaatatataccataggtatttcataagttttcattgtactccctgcttccattacttatttaaatggagaaatttaatatctgatgagcaaattcaattcaagctcccagaaatcagaaaatgtcagcctgagagaactcttctaatggcagagaccatgctatgtgtcatgttgatcccaattcattttcctctgggaacacaggaagactacatttctcagttctcgtagtcagtgggtcatggagcttagttctggccaccggaatgtcggagacgtgacatttgccacttccaggcctggtctgcaactgaagcccagatgcagggaatttaatggaggaatccaaaccccaataagatggtagaggcgtggaatggaaggagtctagggccctaaatttctgcatggagtggatagacccttccgctttcactaacctgcaacaaattgtgatatataaactgtacaatttgggacttgtttggttatgttttctttctacagcagttagcctaccttgaataattcatcccacaaacccacaccctagccctaaaactgaaaacctagaaacagattaatattatactttatcggttctgtcactaaagtttttgagagctaagactggttcttaacttcttggtacccaagtcagcacttaatacaatgccctaaataaatgagctgcatattagctctatgtgtattgaatattgccacaagaaaggattaaatatacctacataattatatttacacaaagatatattttaaacaaagtccaccatctatacactatctattttaatttaaaaataaaccttattttctgaaatcattccagtttaggaaacaactaagatgagatgaacattcaaatggcaataagaatatgacaactgttttcccagtcacttgtgagagaaggtctagcgtggggaggaggaagttacagggcgtcagtaagaatcacagtggtgttttgacactgaatcctgaacttcaaaatccataacacttctctgtctcactgagtcctggaggatcatttctccctggattatgttttccaaccaattctgttattgccactgtcatttctattcttccttccagcagtcatgcttctaccattgctggccaacttgttaagcaattctcatatttcacttttgttggtggtctctttccagcaaacaagcatccattccccaagtgtatagaagtatttgcttgagcactaaataattgtttatttcaatttttatggttctttccctgatgaaacttgagacacatttacgcatagctatgttagagaatatttgttactgatgccctcaacaacatttctctccaatagcaatcaaacgatatccaagctctgggacctgtaagctatctccagctaaggctcctacatatgggtcatatttctgccagaaaccagtagtcaatatttgtctccctttattgtttaattgcttgaaccccagtggcctcggcgcctgccgttaattttttatgtaaattttgttaagtatagcatatattcagaaaggtacacacaacacaagtgtccagtgtggttaattagttgactagttagttacctagttagttttctttctccagaagtcttggagactcctttgcagaaagaagtcctgctaacagtccctgatatcctaacatctttgatgtgagcaggaagattctctaggctcctctactccctctcacacatattcccacaaacttttactacataaataatgaattagaggtagcattgctaatctatgtcatggagacactttgaaagtttgctgtttagtttgtatgtattgattttggttaagtagcatttcttatttacacaaaagcatctcaggaatagaatacatattggcacgatgcacaatactctaaagaagagaaatctgcatggatcgctagagtcatgtttgtaatggacttcagtcaactaaagaaaaggggcaaggggaactggccacacatcagaccaagaaatcctttcatgtttctatccacatatttaccccatgctgtgctccttctcaccactgcctccaaataacaagagggaaagatgctgaatccacagccagatgtaaatttccacacagtcaaatcttctctgccttcttaagcatgtccatatttaaacactataaaaacataagaattattccaaaaggtggtattccaatgttttgaagaagacagttgtgcctataggtaattcacaggaaagtgggtggtgatggggaaaagaaaaagcattcttagaatgagccctctaccctacaatacacaaacaatcatctctcttttttttaaatcttcaaattctggatttaattaaaatatcagccttttattttctgaaactatctatgaagttggcttatcctagctgtaatcttacaactgtctatcttcagacagagctataattcctatttaaggaatgctgtggaaatttttaaatctcattcacaatcaaacaatatttcctctttaattttttctttctctagccaacatatttccaaaattaataggaacaaaacaagaaagtctgaaacaggcattattttgtagattgctagatattttttcccagaatgtcattccctgagccttttctccctttaaaatgctatcattaatttatttgctcccatgtatgtaactacatttaaaaacaaattataaagctcaattcttcacatctatgctctctccacactaccacatcatcactaccatggtagctttgcagagaacaggcctgccaggatttttaacacatttataccactgctggaatgtctgaaagtacggatcatatgagcatctggggctccaaatgtgcgtcgctcctcaatatgaagatgaatcttttggagctatgtgtatatccctaacagatttatttcactgctcttagatgaaggtaagtggatcctcttcccccacatatctaattgtttttataaattttcctgcaaaaaaagaactatcttctagcctaagtgattccatttcaccattatttgggtctaataatacaaacatgaaagacagacctggagtgatctaacaaaagaccagattttaggaaagaacagcagcaccctctgagcaagcaggaaatctgaatttataagcaagtatcaacactcttaaaacatgctgctgaatttaattctaatcttttatacattcacatatagattttaagttatgattatttaaaagttttacagagcagaggatttttggaacagtgaaactcttctgtgggacacaataatggtatgtacatgtcattatacatttgtcaaaattcacaggatgtacaacaccaagcatgaacgctaatgtaagttacagactttgggtgtgctatagactgactatttatgtccccccaaaattcatgtgttgaaatcctcactcctaaggtgatagtattaaaaggtggggcctttgaaagtcgattaggtcatgagggtggagctctcgtgattgggattagtgcctttataaaagagatactagggaactccatcacccctttcgctatgcgaggacacagcaagaaggcaatcatccatagatggtcaggtaagggtcctcaccagacagtaaatctgccagtgccttgatcttggagttcccagcctccacaacaatgagaaataaaattctgttgtttataaaccactaagtctatggtattctaacagccagaaacagatgaagacagagtgataattaatgcatcaatgtagcttcattgcttgtaacaaaggtactactctgatgccagctcttgataatggggaaggctgtgggtatgtgggggaagcagtatgactattttttttaagtttgatatctggatattttttcactttaacattaaatcatatggaatggatacataacaggaatgtggcttctccgggctctcaatcttctctagttggctgggggatcctattgtaactgcattcatcatcaatacaatcttgagcaaatcactatttctgaaagtctcattttaaagggctttttattcttttcttacataattcctgcacaaacacctctccttctcattgcatgccacttcattttctctttgtggcatcttgcctatcagagataaaatcagcttttctaaagcctgcctttatttttaccagcattttaaagtctgtattaaaaaaaggaattacagacttagataacactggttcccttctccccagtcttctcccaccacccaccacgcagtcagttctacaagctcctatcagagacagaattgtaaagagtccatattcaatcaagcgatttcttggctggcacacccacctgcctttcaggccatgaacacctgtctcagtctcagtctgacctccttgccatttccccagtggatcatgacactttcccatttccatcgccttgcctttgtctctcctccttccatgccttttaaccctttttacctggaaaaaaatgtttacaaccccttacatttcaacttagcttttcagtgcaactctccttaacactccctcccccaagataatatcaattaacacaatccttcttctggtttatatcacttgcattattgcttattatattatactatgattagttatccatgcagctgtctttccagtggactataagaaacttggggcacaactgaccatagtcatttttgtaggtccaaacttctacttgaggggctggcattgagtagaaggctaggcttattttatgaaagtattcacataatcaatatctatgagtaatttatctgaccaaagagaagagccaagattctctaatctcacccatgaaaggagcaaataaagatttttccttatttctgtctggttggctagaatacatattttatttgtattacagtctttcaagtatataatatgaccttttctttcctcatcaatttagtttagaatagcacagttttttcccttgtatatgaaggtctgaagaattggatatatctttggagttaaaggttggccctgtctgaaaatggcaatgtaaacttgaacaatgattattcccaaaatttcatccatctattcagtcactcaaacattttatatcttccatatggaacaaataaagttcttctttttatccattaattttacaccagatatagagaacaggactatttagatcaagctcacaagtagagtacaaaatgcctccgaaaatccaaaattttatgaaaattttaacattagccagatctaaatctcatgagttccacaagaatcagcccctgcagcactcactaaataatgctttcctccagcagcctgaagccaaaaccagactaatggtttttaggaaggagtagtaatttcagaagatgggaaaatatgaggaaatatgatgatctactgaatgttatcctccattgctgccaccaacactattcaccccccattcacccactgtcacacacacaaacacatgccttcatataactctcctgagcaaggctgccgtcagaggcatgtatcagtagttacagtagttttccagccttgcttatatactacagaaaccaggttaaatgggggcagccaggttccaaaaattttcctgacttacagaaacttttgtttccagaaacccatgtggaaaagacatcaggttgaaacatgtcagagtttgatgggaaacccattgagctggcagccactggacctgaattctcatgctggttctgccatggtgaactttagcacatctctttttatttctagatctcagttcactcatctaccatagaacataatttccaagattgtgtttatttgcactggggtacacacacttctcaaggtacatgcacatgtgctaggtgcaaaataagtaagaatataacttggagttttccaaagttacaagatttttaaagaaaaaacagtagacatcaaagacatagtatgctcattctgggtggaactttctctgtgcccccaaacatctggtgaatatgctctttttcctctgctgttagaagtcctttcgtcaaaatgatggcaaaatactgataaatgctttccaaagtcctttctatatattttcatcctatgattctctgaattaaatggcaaacagccagtttgccagtttgatttaaaccatggttgtaatttactacttaaacacaatgctttgcatgtaaagaagttaaaattccaaagtaatatcacaatccaaactcaaatgtcctgtcttggtggtgagggaaaatagagatataagagagaaaattcttgcaagagtgcacctgattcttcacaggtgagaaagaaaagcagaagtgagaagaaaagataatatgttgaactagcctgaaaatgtggctgggacaaaatggaaatcccccagagagaagaagcagagaaggtgttcccgtgaggggaaaggaatcaccttctccccgcaagagtgttcaaaaactacattctagtaaatatagcctaggtagttcgattactttggttctggaagtctgagaaataaaagctatgaagagtaaaataaatttttcatagagagcttctccaaattatgcttctctccttgtccatgtttcatatgcacagattactataatcataaatcttggtataagccactcagtcttcatttcattactttgtggagaatatgatgctttttgaataccgtgactcaccataatacatccggctgattccaatatgtctttcaaaaccaagaatgtaaatccccacagaaaaatacagtatgtttaggtcttttatcttggcaacctccatcagccaagaagagtatgtcccattgtcccattgtcattcgtcaggatgcttagacttttataaagtgggagttttcagaagaaacatatctaaattaagacccacaaaatgaagacgcatttttagggagacatatatatgggaaatattttcttacattttaatttctgctaacattttgataatggggtttgtgtcataaatactaaacaaggaaccagtttaaagactgcactcatatgagggaacactattgtagtcaaagccttccttataggcagaactgaaattcagctgcatgacacgtgacaacacagtcatttgtatatattaagaaaaatgaatgagaagaatagtgcactgaatagattacccatgatttatgaaaagaaggaaccattatctgctatcaaatttacaaacttagcatattccatgtgcctcattgtttcacctatttattaaaatgaagatgagaaaggaaaaacggaagacaacaattttctttatggcagagatggatgttgtaaaagggctggtaaaataattagaacagatacattcacaacaaactacaaacttctattttgtgcacatagttctagtgcacctggagaagaaagcattccaaagccttggctgtagtgttttctaaggagaacaataaagttctgaaaccttcactgggctctccaaacaattcagggtgttgcctttgatcttccaagccccaatatcatttgggttcaggtttccatagaaactgcctttatgtaccaccatgcctgtttcagctgtccaaagaacagctgccaagaggccttaggtgtgaataccaaaggctgtaagcaacacattttccatggagaaattccatctttggaattcactttttcagttggtttcaccaagtgcagtatattggccttcaggccatagaataaagcccaattacctggtacttatgggactatttgctggtaaaataaacatcaagtcacaatcttattaagatggaataagtagcatggcctaaattctcaaaattctctgacttccttctgaattgctccaagcatgccaatgtgtgttgaaactataattaagtcttcccgcttctctgtgaaaaaaattcaagtctgcctaaataataaagattattttgcagatgcagggtgttttataacaattggcagtgcatttaaaaataaataaataaagctctcagaattagaacatttatttgtgttgcaaatctagagagctcaggtagaaacacagaaaattccaccaaatgaactggtttatggagataccaagggaatgatcaacctctttctccaacgcatgggagcacagtttgcagttcagtctgagaatagcccaccatcttcaacaaatagatattttgccatgacaaagggaagtattaagtatctaaatctcaatcaaagagaaaatctcatcctttctcaacaatagggctttaaaagtgttctttggttgcaaccttgtaccagtaaatgaataaataaataaataaataaacacaacctctgagaaaaaaatgtaattaaaaaaaaaccaagcttattcatcaaagctcaaacagtactatatttaggcattcctgtagaaagcacaatgagctaacaagagaggcagctgactattctgcagaaaatgggctaagcctcaaaaagtatcacagaaaaaaataaaacattcatttaacattttttcacattcacttacaaagtacaatttattctcacatctctctcaaatttttctgcactgctcatacccaaagcctaccccatcccagtaaatggcactgaaattcattcaattgattacacttaaatcctaggaatcatcttttttttactccacacctcacatccaatcaatcagtacatcctatcaaccttacttccaaactatattccaaacccagctgctccacaccatctcctccctatgcagccaacccaagccaccatcatatctggtctggagtattttataatattctcattggtagtctccctgcctcaaatcttactccctgatgatcaaaaatctactctccaaaaaacaaatcaattgatttttttcaagtctaaatcagatcccaacatgtcatactaaaaacccttcattgtctttcctttgcaataaaaaaaaaagtccgaaactacttgtcagggcctcctgactctaggtgttctgtccccctctctgttctcatatccctccctgttcttttttctgttccttgtgtaaaattggtcatcttcacacttctgttctttttcttggatatatacaagttgtctcattaaggtaacaattcaaatgtcgtctcctcaaagaggcattccatatgcactctagctaaagtagtgctcatctcaacattcctcactagcacttcttcatagcagaactggcataagattcagatcagaaaacagaaaagataagatcagaaaacagaaaagataggtcaattgagaatacccagggaaagaaacagaaagaaaaactaatgaagaaaatgaacagagctggacacctgtaggaaacaatcaggatacctgaatacacataatcagagtcccaaaaggaaagaagaaagagaaaggtgtaaaaaaattgttaagaaataatgaccaataacttctcaaatttcgtttttaaaaaacattcatctacacatccaagaagcccaatgaattccaagttggataaactcagaaagcaggtacattgttcactgctgcatttgcagatcctaaaacagtgcctgacacatagaagaccttcaataaatatttgtcaaatcaacaaacaaattaatcttcatttcacaaaatagaaacctgaagcacaaaaaacagagtaatttgcccaaagccaaacagctagtaagtgatggaatctggttctaaatccaggaagtccagctacatgcaacagagccctcaatcttaatcccacactagtctacatcacgtaccagccctagtggtactaaagtgtttgaatctgcatcttctgtgtgaaacccatattgcataattaaacacctcctgctgttttttctgctttcatatgaaggacatgacgtttctgaaacatcactcctcagatcttcaaagacagtgaagtatagtgaaaagaaatggcctctagtgttacacagaccttgatttagatccctaattgggctgtatatgagcactgtcaccttagatgagtaatttaatgcgcctgccaattttcacatcttgttaggcatagacagttataatatttgtacaacacactgggtcaaagtagcacttggtcaaaggtaactggcttgggaatccaacagccccaagcccatcccacccatcgccagggctaagaacatctgagtagtcctacaatctatttgcaaacacaactctcagcacgctctaacttacccagctttattatctttaaaaatggggctttggttcataaaacaggataaatgatgtctacttcatagagtacttgtgaaatataaatgaaacatcatagacaaaatgtttactagtctctattaccatgctaggtgctcagttaatggcagtcatgatcatcatggtattaatatcagtggtagcatttgttcacaatttccatgggatctctataaccaaggagcagcctgggccagattcaccatgcgtgtccatttctctgcttctgataacaatgaaatattcttgcagattacttttcgtttactactgatggccgtggcaagccatctggagcagccattgtgacaggagcagcagtggtagcagtgggtcccctgtgccttatataccctgtgccccatatccctgaggcagctgactgtgccacccccaatctcacacagccaggcatgacctggccccaggcccagattcactgctgctccagaccctggccccacatcaccactctcgcccattgccattgcaggtagggcatggagagaagtgaacagtcccctgagccctcccctggaagctcccaggagcccaccaccctgggggctgctgcagtggggtgaggtcaagtcacctaccagctagggagcagcatggtcaggcacaaagtggtgggcagagaggggcctcgagacaaagctggacccgtggtggtactgcacctgcacaaggaacatggcagctggcccagggcacagagctggggccatgcttcaggggtcaggccaggaaatgggcgccacacccacttcaaggacctggccagcagaccagccaccatgcccaccccaacaacagtgccaggttcctgcacctagggaggatgctgtatgtggggtagcccagggccacatgcctagggtctgccccacatcacagtgactgcagagcctgaccctcctgatggccaagactggggcccacaatccactcctggagtctctccccaggcagggccaggagccaagggagggagagccctgggccacccctgagcacctggccatgggaagaactcacagcaatgtctcccctgccccagatgatggccagggtgcagggagaacctggagcccctgccccaaactgcaaggaggtgtgggcagggctgcatgctccacaaagccagtgggagccagggacaaatgggagtcccaccccttctgagttggcagggcaagaactccctgggtgcagctgtggccaccctgccaaggctgtggatccatgtatctttgcactcttgggagcccacaaaggcagccctgtctcctgtgggctcaagggtgcctgctgctgctgcctggcttctccctgctgttggctcctgctccaatcttggaacaagatcagggccgagcccaggtgctgtcacagcccaacggcagcgggggaacacactcagagcaatgttgacatgccagcctcctgccacctcttggcccctccggatttggggtgctgacaagtaagggagggaggttgaggaggggctgaggatagtcaggtgctggcctgcaggcacgccctggcacaaacagcctgggttccatgagctgtgggaggaggcagacagggttctgggtggaggggaccagtctggtgaagccccaccttcaagctggggagggcctgaagcctgggggcccagccaccagtcccctggactagagggggaacttgtggtgcttttccctgggcccacctatggccacccatggaacaatcagcacaacttcctccactctgaggcccataaaaaccccagactcagccaggcttgaggaaagagacaatggggagaccagatgcagaaaggagctgcccatcccagggtctcccctctgctgagagctcaggagacagagggatgaccaactgcagagaggaactaccctctctgctaagagctgaacactcatctggacaccctgactacagagtgaagctgcccactgcaggtctcctctgagctgttctactgctcaataaagctcctctttgtcttgcttacccttcacttctctgtgtacttcattcttcctggttgcaggacaagaacttggggcccactgaatggtgagactaaaagagctgtaacacgaacagggctgaaacatgccccttgcttgccatgttgcaggcaaagagaagaagaggaaagctgcagccctttggagagcccagacctgggagttcccccaagtcagggctgtgactccctttttggggccctgcatttcctggtatctccaagcttccaggcaccatcacataccctggtgccagctggggaagcaacttatgctgcacctggtccagccacagcctcacagagagctagcgcccatgccagcacctggagtggcccacccaatggcagcagctggtgtgtctctgcacagtggccataccccacattcactcacacacccctcgccactccacacctgattcacagtctcccttggagccatggaatccagggaggtagcgtgagctaagtgcagcctgccaggccaagtgggtggaacgagcccagtgggccctagcaaaacttgggcaaaggtgctaccagccacagaggtttccagccagaaaagtgatcccataagactacgtttgactgcttgttcactcagtgacaagacatagtactgtgcactgtgggagattcaagaaaagcataatgatagacttggaatagaatgagactactacactgttgacttgtttccctcaataccctgaatattttcaaaaactttcactaagtgaacactcagtcaatttttggataccgccattgatggggtggccaccatgtaaagaatcccattcaagcttgggacaaaatttattaaaaattcttccttattttgagtccaaatccgacctccttaagtttctacccactggccttttcacaatttggtgccatattgatgaaaaagataacactttaaaactcacacatacttgggattgtttggagacctgcaggctggacagacccatcagggtgttatttataggaggaactagagagctgcctggaaaagaagtcattatttctaaagaagagcaagctatgtcacaagcagcagacagaagccatcatctataaacagctgatgatgtcaactacctacttttctataataacttaatttgtgactaaaaatctaccctttcacacatcacatatttgtttgtagatgatgagagtcaggcaaatgagtagagcccagcgtcaatctcttaagtagtctttcaatcctgcctctatggtcgcatttttaagccccagggataggaagaaccttacaatgaaaaataagaaatggaaatttttctgaaattagataattactacatacatgtttatgctaatgaatttcaaaatctcaatgaaataaaacattaacaagaaaatatcgataatcaaaactgactcaagaaaaatatcaaacatgaaaagtttgataaaattgaaagaaattgaaagttatcaactaattttctcaaataaaagatttagaaccagacagttttactgggaagcaattcagttcattttatgaagttagcataaccaaaaatagcaaaagtgaccaaaaagtgtccaaaatacaaaagctgtaaatcaaccttactaatgtaaatttgaaaggacaaaataaaataagaatagagcaaattaagcagccgactgaagcaaacatttccataatcaagtaggattgatttcaggagtgcaataattgcttaatactataaataagtcaaaggacaaaaaccatataattatctcaaaagatactaaaatgaatttgaaaattaataatctattcattaggaaaaagtaaataactttcaaaaaccagaactagagaaaattcttttagtatgcaagtaaataaatattctaaaataatgacattacatgtaaatctttagagtgatttccataagcaaaaaataagtgaagatatccaaaatcattcttgatctgatagagctatgcaaatggagaggacaaattgtcattatattggaagacaatattggaatattccaatattatattggaaacaattaaaattgtttactcaaaagtcgtaaagatttaattgaaaatctcttcaattttagtattcaaatgtaagatacataaacatccacactttcttctatatcataaaatatgttagaaaatacaatagaatagatattccattaacaataacattacacatatatagaattcctagaaatatacagaattcctagaaataacccaaaaacaaaatgtgaaggacctatataaaaaaaaacacactttttttttttttccctgagacagagtttcactctttttgcccaggctgaagtgcaacagcacggtctcagctcactgcaacatctgcctcccgggttcaagcaattctcctgcctcagcctcccaagtagctgggattacaggcacatgctaccatgcctggctaatttttgtactttcagtagagactgggttttgccatgtctcgaaaccaacctggtctcaaactcctgacctcaggtgatcctcccactttaggcccccaaagtgctggtattacaggcgtgagccaccatgcccggctacaagacacttttttttttttttactataaaatgtaaagaagaaggagaaaaaggtataaaatgtaaagaagaaggagaaagggagtaaaagagaacaaaacatgttcagagacacatattttcttcattttttcccaaattaattcataaaattttcacaactttcatcaaaatacctgactaaaatccaaattatttttcaggacctacagaatccagcattgtctggcccccagctgccgactacatctctgccctcatcacctactcaccccctactgcctccaaccacagggccttcccactcttcctccagaacaccaggctctctaccacattaagacttctgtacctgtgttccctccacctgtagctattccttcccacccactctgctactttattcaaaggccacctcttcaaagaaacattattggacatcattagtatcatactcctcattttctttctgtaccctactttttctctttgtcacacctatcactacctgacattgcactgtatatccattcctgtttttgtctcttgtctgtctcttcaaagagaatgtggaccccatgagagcaatgaccacctgccttgtacacagtgacatctcattcactccccagcacctggaataatgaatgtctggcacacagaaggactccaccaatattggtttaatgatgtaatgaaaaatcccaactagataaaattattccaagtttattttggaattagaaaagataataaaatatttttaatgcagtaataaagttgtcttgcttcaccaaatattaacatttatttcgaaatcacagtaattaagtcaattttatactggtctaggggcaggcagaataataaaacaatatagacaagcccaaaataaccatagttcatagaataacctagtatataaatagccaacatcataaaacaatggagaaagtcgagcattagttaacaaaggatgtaagataaactgacaaacttttgggagaaaaaaaaagctattgtatttattttttaattatttattttatttatttatgtatgtatttatttttgaatcggagtcttgctctgttgcccaggctggagtgcagtggctcaatcttggctcactgcaagctctgcctcctgggttcatgccattctcctgcctcagcctcccgagtagctgggactacaggcacccgccacaatgcctggctaactttttttgtatttttagtagagacggggtttcgccgtgttagccaggatggtctcgatctcctgaccttgtgatctgcctgccttggcctcccaaagtgctgggattacaagcgtgagccacctcacccagctgaagctattttataaagtatattaaactttacaggtccctaaaatagtttttggataaaacaattaaacaggaaaatatatataaatattttgctgctacttgaatatgaatgatagtgctagaaaataacaaagaaaaacatgaaaagatttgagtgcataaaagttttaagtttgtacatagctaaaatattataaccaaaattgaaaaactacacaatgaagaaaaagatcttggcacacatataacaaaaggccattatgttgatcatataaaggaagattataaataaatataaaaagcattgaaattaacagaaacacaaaacccaacaaacatactaaaatgttcagtcttaatggtaattacaaaagtgtaaattaaaacaatgcatctatcatttcaaaattataaatgctaaaacttttgttaacaaagatatggtggaatagcttctcataagttgctgtaaaaaaaaagtcatgtttaataaaagccagtaattctactcctagaaattattcctaaagaaataatcaaatgtaggctgacatttatatccaagatttctcatcatagcatttcatataacaacaaaaatgtattttaaaaaaacaaattatccagtaatatggtgaaataatttatggtgcattcacataatggatgattatgtgggtattaaagatctttttcaatgaatatttaatgatatatgctagcatttattatatatataaagtttgagaatatgaaggggtcgaggaggaggagggaagaattccaaattatatacatagttattataggatattacagctgaacgggggctcagattctataggtaaaagaattgtcacctttttcaacaaagtagttgcatttagagcttaggtctatttggtggagctgagtagtaccatctgcttatataaatgtatacacagtaaatggtgcctcctgataagaaatgaaatggcccataattttgagaatctaaagatttaaaaatctgtctgattcactagtgtgggagagggtggatatatccaagccaaagcagacataaacaaaaacgttatgtcccacaaggaaacccaaataagaaagactaggctgccgatcaccagaactgagatccagggccttaggcattgaagggaatgcaggtttcaggatcagcatacatctaatgctggaacctgttttatctcagctcctcacacccaggccctgtgacaccatgaagtaaagttctgtgcagctcttagcattgttcctggcatgtagtactcaatgaatattttccctgaatgaaagaaaaaatgagggagtcaatgagtaaatacatgaatcaaaagttgtctacatggaccagacaatgttgctgtggacacttcaactaagcatcatgctgagaaatatctccttcaaacctcaaattgcagatccatagatatttttaccaggagcaaggacaacagcaagcagggtattaggaacttccctaacagctgtgacatcatagtgaagaaagtgcccaggggtaactgagtccaaggctgaactctcctgggagttaagagatgcagcctgtgaccctcagggctacattcaagtttgagaaggcagccagaggagagcaacaagaattagttgaggtatgagtgtaggtgttcaggatacttggaacaaagaaaccagggaaaagcctgcactgtgtgcttctttgtcagattggtacccaagccattttgatttggatgtttaacagaaagagtttgtattttgcagacacaggcttttaccaaataaattatttaaattacacaataacatgctgtttggtaaaagcaaaacatcttgtgtagacacatgcacaaaatctcaggcttgtgcctaagatcaagtgtacacacatgcacataggcatacacatgtacacgtatacttacaccacaacaggcacagagaaacatttttgtattataaaatttctcattgagggctttgaaatgattttgtaaatcagaaaatatttaaaacatagtttgtaaggtggaaaagataaataaaaggtgcacaacagtaaaattcctacttttctaaattctgtaagattttatgaccacaagttcatattgcatggtgtcatgctatagaacacagcacaagagaggattaataattctcctttttggatcacctttgcggtgcagaggcctgaggagtgaggtcgaagaggctacctctgcagaaggcgctggggaggaaccagattgatgggcagccctggtggtggtgacagcactggcaggagccagctgtccagcaggagccccacctgcctcactgctggggcaaagggaagcactgacccatcctgacagccacgcagactgatggaccagcgcatggaagaaaaccaaggcggactcacagaattagtttgaaaaaacctgggggacctgtagttctcacaaattgagtgaggaaagaacctgaaaatatgttttattattgtcatcgagaccccagtttcaaccctagactattgtggcctggggagaaagttttcaattgattgtcctccctggagcttttacggttgtgaaagaaataaagaaacacttgaaaagtgaatggtgttaagtcgtacaggactaagtggggtatagggaattgacactaaaattccctatgtaagagggaattccctatgtaagagtttagaagaaaattatctgaaaaccaaggggccagaaaattttcattaatgggaaagaaattcacaatacactagaactgaataaaatgagagaactggagatgggaggcagggagcattctagtggcatatttatcctacagcatcatcttcatggaaggttctagaaaagttatcctaaaaggaaatggtcacggttactagcaagttcaatcaatccttcgtacataatatatggttaaacatcatacaagaattatttattttccatgtaatcttataaaagcattcaaagtcgagatacattaaagaacaaaatatctgcctagtgtacccattattctgggaaagaaaaaatggaaaaagagaaaaggtataattacaaaaaaccggtggtgctgtatttttactgcatttggaaccaccacaatctgacagtgttgattgccccctggtggtgatattagtgaagattggtttcttggggaattttaactatttttttcatgggaaatggttccaaaagaagaaatgttatcattggcttgaattcttctacactacccctacattgatcggccagcaaatgtagctcttttccatttcttcccctccactaatacttgcttggtgcttccaaaaagcccctcctttcaccacagctatggtaaaatgaactcaggagaatttgtagatataggcaataatatggttaattccagatggtaagaaaatgctattacatatttctaaggaaaatactaaacatcatgaaaatcatatgatgttagttgtgggctaaaaaaaacaaacaaaacatcaagaaaatcagtggtatggaaagcaggcatatggacctcactcgtcactgtgagacttaggcaaaaaaactaattttccttgaggctgcttctgagttgtagtgaagattaaataagtatgcaaaacatcgagcataatttctgccatggagcagtaaacattattcttttccttgaataactactggtacatttctaaataaggttcagaaacaaaatagatttttcagaaaattaaaatgccatactgatggagaattgaaaatttcattatggaataatctattttctgcctattgcattctgcctcttagtttttgtgtgtatccttcactagcaacaactgaaaagagagaagaaactagaactatcatagtttctacctatcgaacccaataagaactcagttctctgctccttgcttgtgggacaccagcaaactaagagagttcatttgtccttggtgagatgaacaatatagagttttacctaaagtgaagttactaaattaaaagattatcatcgattctgagattaaatatttcttacctatttggtgctcaaatattcctttgtttgagacagagttacactcttgttgcccaggctggagtgcaatggcaggtgacctcggctcactgcaacctccgcctctgaggttcaagagattttcctgcctcagccttccaagtagctgggattgcaggtgcccaccaccctgcccagctaattttttgtgtttttagtagagacggggtttcatcatgttggccaggctggtcttgaactcctgacctcaggtgatccacctgcctcggcctcccaaagtgctgggattacaggtgtgagctaccgcacccggccaaatattcctttttatgaagcactggtggtgtgactgatggtttggatttgaagggtggcttgaatgtctcaccatgtaaaaaacatcaccaaccttaaactgacccacagatttttagtctatgaaattactgaagagctactgaaacttactgagagaggagagctgagcaggttggaatccagagacaggttgaccagggcctcactgcaggctctgttaattacagaccgtgtgatttatgtgtgctttgcttagtgactcttaattcaagatgtaattagactctttgtgattgaaatgttattgatcatgaaaaccacagatctcaaaattcctgtacttgctgatctctcaaggtccttccagcactgctttttagcctaatacaaggacatgcaccttggttccaaccccacatgatgccaacttggaaaaaaacacttgagtgatcaaattaaacttgacaaactaaaaacagtagagattctttatactcttgagctaaaaggtagagggacagacttgctatgtataggcatccagagaaagatattagaattctaacagaatgacttctgtgtctgcttattacacaaatattatatgctgatatgtacatgaaacagttgtttcatcacttctaaaaacataaactgctagtcataagttttaaaaatgctaaatttccccctgaggttttaccctcttgtgtcaattttctgaattatctgcccaaggagggagaaaacaaaggaaattgaaaaaaaatgagaaatgaataagtacagacccccaaattcactattttggtctttaacactgcctctctcatagaaattgggaagttaaaatcatataccaaaaaaaaaaaaaaaaaaaagaaaaaaaaaatcaggctattctctacagtgtcctaccgctgcctctccatatgtaggtcacaggcaccacctagaggcattaatcatctctaactctcatttcagggaactcatataagtcagttcaaaatccagttgagttctctctctagtcacagacttgaaaattagttaatcaaataaagtactcccatctctcagcttccagggcaacagagcaagaccaaatgaaaaggagacatgcaaatatacatattctgtcaaataattagacttatctgtctcactatctcatttgttaacacctttgtgattccacttgctgcctatacagcaagaaagacgcataacattaaggtatagttctactttggagagtcagtagataaactagaactacaaaaatcccaggtaagccttaactaaaaagataacattccattttgacaatgaaaatatgtctgcaggctgagcgtggtggctcacgtctataatctcagcactttgggaggccaaggtgggtggatcacttcaggccagtggttcaacaccagcctggccaacatggtgaaaccctgtctccactgaaaatacaaaaaattagctggttgtggtggcgcacctgtaatcccagctacttgggaggctagtcaggagaatcacttgagcctgggaggttgaggttgcactgagctgagattgtgccactgcactccagcctgggagacagagcaagactccatctcaaaacaaaaaagaaagaaagaaaatatgtctgcaataagtaacattaaatgctgccagttccaactgctatcagtgaaggacaagaagtttgtttccagaaggttccacctttatgtgccagctttatctctcagcaataacaaaatatctgcatgatgtttcaaattaatcttctgcacatctaatcttcgtaacattagctggagtaaataaaaagagttctgagattccaaggcttgtgtatactcaaggtattacaaatcaccatggaaagttaagggagagttgaaaataataagtagctatgagcttcctgcacataactgaatccacagctcaggactatgtttgacaaatacctggacttctaatatatgagcaacttaatttagaattcagctcagcttggcagaaatcatgttggctagagacactagagtcctaggttcttgccccatctttattactctctggctatgggatctggtaaaagtagatccttcaatatttgaagaaacctggtggtgtcagttttctcaatgtgactttcaccaactcagatgctttggtttaagttactgtaaaataaccataagtaaatgtctgggatccatatatcccatctactattccctcacaaatttgattaataaacctctgcagccaccagcctccctccctccttctccattttaggactcagtaatatctagctaaaatcagagacttgggcgcaaattcagactgagttccttattactgtttactatgtatccttgagcacgatatttaacctcattaagactcagtgtcctcatttgtcaattgggggttataatagccaataagcaagaaggaaatgagctaaagcatgagaagcattcggcacaggggctgacacaagtacagttcaacaggtatgtgatagatactatgttattaatattattattttattgatttaagaacctactaaacacattttatgtgttagccctaaggggtaaaaccctgcaccccacattgggcaggtgctaatgatgatgcacatccacaggcagttacaaaacagcatcatacatgccatgtagaatcgtgcaagagctatggctgcacaccactcaacacgcatgtgtgggacaagggaaagttcccagaagagtgatacctcagctgacggatgattaaagcagagagagaagcagtgttcctaggcatgtgaaaaggcctggaaaaaatagttcagacatagagtggttgggaagttgctcaagggatcctactgccttggcttcccaaagttctgggattataggcatgagccaccatgcccggccgaagatttttttttaagggataaatctataacaacattggatgacaaggaggggcatcatcaatgcaatagaaatgatgacaaagacatactcagaaaaggagtttgataagaggtgggaacaattctgagggcactctacacttgggggtttggtggacatggaggtaggcagaaacaagggcaagggtcaggctgctttggaggccattcaaccactttatcctggttatgacaaagaatagccacagaatcctctgttccctacaagaaaaatgaatggaaacccttgggtgggtgtgggcagggtggggcggggcaatgcagagaaaaagcagtgtcctggatggccaggtacacccaagaggaacaaggagcacctccctatacaaggagacttgcgggtccttccatctcacatcacgtcctttccccacaggtactgcaggctgctacaataacagatgctagcagagaaagttaaaccaaagacaaaagcacaaccaagaatcaccaaatagttcagcacaaccaacaccttgatatatgagcatccatctaaatatacagaagatctacttcctaaggaaatacaataaatacagcaaactgaaagtgactttaaaagaaatataattaatatcttcacaagcattaaaaaggacatcatataacaaaaaaggaagtgcttgaaataattaaaacaaaaatattataactgaaataaaactgagtagaagaactaagtggacagagctgaagaatagacacagctgatgggcaaatgagtgacctagagcacagctccaaagtcaaactgatggaaagtggaaggaaataaagaatgagagagtggagacagctagtatagacaacctaaattgtcttaaattgggactagaagaaagatgagagaagagagatagaatgacatggaatactgggcatatatagatttcaagagtgttgaatgatggaggagaagcatactggacaatagaatagtgccaggagagaaacaggggggaaagacagtggatatgaataaagtttgtaaattggtgtcaggaaattgagagagttaacatttaccacgtgatttttttttaacatgggtgagatgagtttttcttcctctttcattcctaccttcctggaggctgaaagcttccacatctaaggtgacagaaacaggatttctatcatgagtagaagacagtctttgaacataatgagataccaaagaagaggaatgtgttagcaggagataaacctttacaatacctgagctttttaaaagatttttctactctcagttcagagtaccacttttatcctcctttcctatcttctggacctatccaatagcagaattcttggggaacagaaaaggacaattattccagagacccctgcaacaaagtagactgggattaggatgagaaaaagaggagttaagaagatcaagggatggtgggagggctcaaggaggagagtccagaagaggtgctctgtgatgaaggggatggccatgtgggccccgtgagagtttataaatgaaagccgacccacgtgagtggagaataagatggggagtaaaggaagcccttcctaaattctcacccccttatggatattatgagttaaatgatagctcaaacctgaagtaagaactgaatggactttctttgcagctgcgttgtgtgtttttccagctgagaaagagtgtagggctttcccccaacaattaacagcagaggtctaaagttttctagtggaaaacaacttgtgttggaacaaaatgcccaactttcttttactgtgtctcttactgattgccacagccttctacctccaagttaagaggtagagtcaccaagctatatttgggggctcctacttggggtgttcccagaggtatctaacagagtgtccagtacatttgaaactaagttaagggacagtccatcatggaagcctaactagtcacaagatggtaacaagaaaagtgggtccaggagaaagtggttttgaggtttaggatatccagacagaaagagagagaaacagtataaatcattttgtgatcttctcattacagccagttaagaagactggaaccatgccttcttcaaacacaacaggtcagttcctttattgagcttccctacaatatacagacagtggcatgtagagccctattattggataaattatttgtccaataattgttttaagtctggatcacttctataaagggaagacccatcagagctggtagggcaaaacttgaccacatacaatggctgcatcagaaccaatgtgatgccctgtgatgatcaggggaaaaggtattgttgcctacattgaataatactaggtagaaaaaactaaagacctttgttaggagtgaaaactggttcccaagtgggagaaatttaaactgcagaatgtggagagtaagaatatggagcaagaataaaatgtatcagaaagtataaaacagaaaatggttatggaaatttactacctctatcttcaatgtgatatgtaagttaaatgccgaaaatgcatttgccttgatgcacaatggattggtgagcttaaagcaagactaaagaatattgagaaattttataccaagcattttatcacctaacaagagaggccaaagagacttctaattatttcacaaaattatagaaatgttatataaggtggtagagaaaggaagcatggaagaagacacaagacaccagatgttgctcatcaagtgttgccggtgagcattgacagcagagggaacattagccagcctctggctgcacactggactagtgcagattatctgggtggcaaaaggaacagctgaggctcttttaaaattactagctagtgttgtacaaaaggagagaaggttagcactccccttgacaaggatggaagaggcccttgggcctgacaacatgcatatggttaaggcattgccacctacttcgtggcatccaaccatcgtttttatggaacagaacagagccctccgaaataataccacacatctacaaccatccgatctttgacaaacctgacaaaaacaagaaatggggaaaggattccctatttaataaatggtgctgggaaaactggctagccatatgtagaaagctaaaactggatcccttcctcacactttacacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaacgggatttaattaaactaaagagcttctgcacagcaaaagaaactaccatcagagtgaacaggcaacctacagaatgggaaaaaagttttgcaatctactcatctgacaaagggctaacatccagaatctacaatgaactcaaacaaatttacaagagaaaaacaaacaaccccatcaaaaagtgggcaaaagatatgaacagacacttctcaaaagaagacatttatgcagccaaaagacacatgaaaaaatgctcatcactggccatcagagaaatgcaaatcaaaaccataatgagataccatctcacatctgactttttaatgtcaatcattaaaaagccaggaaacaacaggtgctggagaggatgtggagaaataggaacacttttacactgttggtgggactgtaaactagttcaagcattgtggaagacagtgtggtgattcctcaaggacctagaactagaaataccatttgacccagccatcccattactgggtatatacccaaaggattataaatcatgctgctataaagacacatgcacatgtatgtttattgtggcactgttcacaatagcaaagacttggaaccaacccaaatgtccatcagtgatagactggattaagaaaatgtggcacaaaaaaccaaacactgcatgttctcactcataggtgggaactgaacaatgagaacacttggacacaggaagggggacatcacacaccggggcctgtcatagggtggggggaggggaggagagatagcattgggagatatacctaatgtaaatgacgagttaatgggtgcagcacaccaatatggaacatgtatacatatgtaacaaacctgcacgttgtgcacatgtaccctggaacttaaagtataataaaaaaaaaattgctagctacaaggatagagcagccaggactatttccctgagttaactttaagtcatgatgcctgaaccacaactagttatctagttgcagtttttgcagctgcaccagtgccccgtgttctgcggcaggaactcctgagagagttgagggctcttttcttcagggagacacatttttctacttctgatgtgtgggtaagagggcatgcaatggcaaactgttaggaaatcccatctgagtactggaaaagacccaaggaagctgggactgatttagaatagagttcaaatttatacctgtcagatccctgctacctcaagccatgagtgttgatgcagccaggctgttttccccagactaggggaattaaagataagtaaaatccaaggaaaagcttgcaggttaagttggacagtctctattattttcctgtcactatatgagaagcatggctcactctcacctataagacctaacagaaaacttttgtttattgtgaggaaaagaaaaaaaaaaaggaaaaataaaagaaaaaaaaaggagagaggaaaaaacaaactctttctccaagtacctcctgaagtgttctttctgtctaatgggggatggcagaatatgccaccccaatatataccacttcagcataagaattactttgcattaaaggcgtttggaagccagaggtgcaggaagatggattctgacttcctcttttcttttcaaaagcatgagacaaaacgcccacgtgaaagatgccctccttataccagaagaaaagaaatatccttatcaccaggcacagggagtcgaggcagagagaattttgtacaaaaggaccttcataaaataactcttatctttctttcgtttccccatatacaggcaaccctcattttatagtgctttgctttattgcactttgctatattgtattttttacaacttgaaggtttttggcaatgctcctttgagcaaatgtattagtgctattttctgatggcatgtgctcatttggtgtctctgtgtcacattttggtaattctcacaatatttcaaatgttttcataattatatctgttacagtgatcagtggtccttgatattattattgtaattgtttaggggcaccatgaaccatgcccatataaggcagtaaatttaatagataaatgtatgcattctaactcctccactgaccagccgttccccatctctgtcctccttgggccttcctattctctgagacacaacaatattgaaattaggccaattaatagccctacagtgaactcgtgagtgctcaaatgaaagaaagagttgcacatctctcactttaaatcaaaaactagaaatgattacattcagtgagtaaggcaagtcaaaagccaaggtaggccagaagctaggccttttgtgccaaacagttagccaaattgtgaatgcaaacgaaaagttattgaaggacatgaaaagtgctacttcactaaagacacaagggatacaaaagcaaaacagccttattgctgaaaaggataaagttttcatgatttagatagaagattaaaccaaacacaacattctcttaagctaatgcctaaaccaaagcaagactccaatcgtcttcaattctgtgaaggctgagagaggtaagcaaattacaaaagaaaactcggaggccagcagaggttgatacatgaggtttaaggaaagaagttgtctccataacataatagtgcaaggtgaagcagcaagtgctcgtgtagaaactacagcaagttcttcagaagatctagctacgataactgatgaaagtgactataccgaaaaaaagattttcaatgtggacaaaacagtcttgtagtggaagaatgtgccatttaggattttgatagctagagaggagaagtcaatgcctggcttcaaagtttcaaaggacaggctgactcatattatggactaatgcagctggtgactttcagttgaagccaatgttcatgtaccattctgaaaatcctaagcccttaagaatgatgctaaatccattctgcctgtgctctgtaaatgaaacaacaaagcatggatgccagcatatctctttacagcatactttactgaatattttaagcccactattgagacctacttcttagaaaaaaatatttccttcaaattttactgctcattgacaatgcacttggtcgtccaagagctctgatggagatataccaggaaattaatgttgttttcaagcctgctaacatagtatccattttgtagcccatggatcaagaaataatttcaaggagtaatttttccttgaaaaatatatttcttaaacatgacttaaagttgaaattactgccatggttagtgattcctctgatggatctgggcaaaatacattgaaacccttctggaaaggattcaccattctcaatgtcattaagaacatttgtgattcaacggaggaaatcaaaagaccactaatagaagcttgaaagaagttgattctaatcctcacgggtggctttgaaatgttcaaactttagtagaagtaagtgtagatgattgcagacgatgaagaaattgccacagctaccctaaccttaagcagctgccaccctgacgaatcagcagccatcaacatcaatgcaagaccctctaccaacaaaaagattacaactcactaaaggtaaagggtcagataattgttagcattttgagcaacgaagtattttttaaattaaagtatgtacatagtgttttcttaaacacaaattcatttattataaaatacatgaaagagagtttcaactcaggaagttatcaacagaagtttatgtcaacagaagttatcaagagttagccacatttatttttcaaatataatttaatgaaatagaaataatagtaaagttaaaaagaaaatctaaagctatttattttaataagtaaattatcagataagctttgccaagtctaaacaattgaacaaaagagaataaacataataaatccataggaataaataatataaaatattttatattataaaagaataatctatttataccaatacacttaaaaataaaaaaattgtctaaaattattttaagaaatataaactaccaaaattggcttaaagaataaggctgggcacagtggctcacatgtgtaatcccagaacctgggaggccaaggtgggaagatcacttgaggccaggatttcgagaccaacctggccaatgtgctgaaaccctgtctctactaaaaatacaaaaattagccaggtgtggtggttggcacctgttgttccagctactcagaggctgaggcagaattccttgaacctgggaggtggaggttgcagtgagccaagattgtgccattgcactccagactgggcaacaatagcgagactctgtctcaaaaaaaaaaaaaaaaaaaaaagaataagtgatgaccttaagtaaaccaataattatagaaaaaaattgaaaatgtaattaggtccttgattttaaaagacactagtttaaattattttatgcagttgggtaatgtaaattttttttaaattatagaagtaatacatgctcattttaattaatgcaacatacgtaagtaaaaacatacctcaaaaacattgcaggttcatctctggaccaccccaatgaagcaaatatcaaaataaaatgagtcatgcaaatttttttggtttcccagtgcatataaagttatgtttacactacggtgtaatctattaagtgtgcaatcatatagagtctaaaaaactaatatgtacttggttttttgggttttttttttggtgggggggggatgaagtctcactctgtcacccaggctggagtgcagtggcctgatcttggctcactgcaacctccgcctcccgggttcaagcgattctcctgcctcagtccccctactagctgggattacaggcgtgcggcaccatggcctactaaattttgtatttttagtaggaacgaggttttactatgttggccaggctggtctcgaactcctgacctcaagtgatccgcccaccttggcctcccaaagtgctgggattataggcgtgagccatcatgtcaggcctgtacatagttttttaagacataatgcaattgcacatttaatagactccaatatagcataaatataactgttatataaactgggaaatcaaaaaattcatgtgactttactgtgacatttggtttattgcactggtacagaactaaaaccatatctttgagatgggcttttatttcatttacatttccacaattgcttctctttgttcaacctagtatataaagacttagcttgtgccacttcttcaggccttcattttcctttgggggttcccacatacatgtaaaaatctgtatgttttcctgctgctagtctgtcttacatcaatttaattctcaggcccagccagagaccctgaaggagtagaggtgaaattttgcttttcctacaccagtaatgatcataattacctccattctgaagatccacccactgagatgtagcccagcaatgaggagcagattctatctgaagaacaacctgagcccattatttatgaggaatagacccgtattaaggtctgttgctgaagagacagaaatggagttaggacccacagaccatacctccgcaaactctctgtctttgcttgccagagcatagaattgtaaaaaaatgactgaaggagcagatgctaaagtttctaggtaaatacattggcaaaagaacaccaagcttggatcaccaaggttcaggacagcctaactcctgaggtacaacccaggcaggagaaccagcaccaacaagaggttggtgcaacccagaaggggaacccttcctggtgtctttctcacatgcggccatgagcacaacagactgaaacctcgtttactaccaggtcagggagtcccaggattgtgtgtgaactaggaacttgtaaccatgatgtgctttccctttcttccctattctgaatgtgaacttttattgtaattttttcccttttactgtatattattggattcttatgtagatttcttaccatgtagaattttgtgaacctgactcaaaagaatacaaatcactcaaagattctggacgtagtaaattacaccacaggaaaactgaaaaaaagaaataaagaaaaaagaaaaaaaaggacagaaaagagaatttttcgtagtttttaataaccattttttaacaagtaccattataacagtactaatgaaaatcaaacatacttcaaaattattaaactatataagaaaaccctctccccaaaatccaactctacaatcaaatctgctttgctttctcaacctttcctcctgattttagtctttgtgcatacacaactgaacatgatataatctgaaaatttcacatatatatataatcttggagctaaaaaaaatcatagtttttgtcaaaaaagccaaaaagaccctggatcaaaagtgaatgtaagtcctggccatgggtggtggctcacgtttataatcccagcactttgggaggccaaggcagaaggattgcttgagcccaggagtttaagatcagcctgggcaatatagtaagatcctgtctccacaaaaaacaaacaaacaaacaaacaaacaaacaaacaaacaaaaaattaattaggtgcagtggtgcccacctgtggttctagcgacttaaaaggctctgaggtaagaggattgcttgagcccaagaggtcaaggttgctgagagctgtattcacaccattgcactccagcctgggcgacagagtaaatgcaagtcctaaaggataatttgggctatctccagttcaggaatactcacattatgttttacatttcatgtatatggaaggcttctcagcagctaaggagtgggatggagaagtcatgtatctttgaagattcattccatcccaacacatcatttggtttcactggacttacccagtcctgattctgggagtggttcatataacctacacctggccaatggactgcacccctcatccccaccatgattaaagcagttggctcagggaggggtaatcatcactggctgaattactttcctctaggtttggtaacaaattaccactgactccaatttttaaagttctactgtgggtaaaatgctatcaaacagcatagcatgccacagaaaaatctttcatgaaaggaagagtcaattgatgtggcaaacttcattgttgtcttatttggaggaattgccacagccaaaccaatttcagcctccaccacactgatcagtcagcagtcattaatattaatgcaagaccttccactagcaaaaagattatgactcgctgaaggctcaaatgattgttagcaatttttttagcaatgaagtatttttaaattaaggtatgtactttttaaaataacttttgtacgcactgagagaccaggaaaatttttgtaacttgctttattatgatatttgcttcattgtggtggtctgggattgaactctcaatatcctcgaggtatgcccatatatgttataaatatatgtttatatgtgtaaatgttatatgttattaattggttgacaaaaatattatgatgaaaggctcatatttcccctagggacaatggttcttcattcactaatttagggttcctgatgactatgaaacaaaactaccatgaataaaaagaaccaaatgtatttcaatctatgacatggtaatacagtcatgcgccacataacaatgttttggtcaatgacagactgcatgtattatagtggtcccatggatttttaatggagctgaaaattttctgtcacctagtggcatcgtagcccttgtaagatcatactgcaaggcattactcaagtgtttgtggtcatgctggtgtaaacaaacctactgctctaccagtcatataaaagtacagtcttgtgttacataacaacaaggatctgttctgagaaatgcagcattagttgatgtcctcattgtgcaaacatcataggatgtacttacacaaacctataatggtatagcctactacacacctgggctatatgataaagcctatcattcttagtctacaaacctgcacagcatgttactatactgaatattgtaggcaacggtaaaacaatggtaagtatgtgtgtatgtaaacatatttggctaggtgtggtggctcacacctgtaatcccatcactttctgaagctgagaatggaggatcacttgaggtcaggagtttgagaccagccagggcaacatagtgagaccctgtcgctacagaataaaaaataagaaaatacctgggtgtggtggtgcatgcctgtagtcccagctactcagaaggctgagctgggaggatacttgagccccaggaggtggaggttgcagtaagctgtgatcacaccactacactctagcccggacaacacagcaagaccctgtctcaaaaaaaaaaaaaaaaaagactatgttactggcttatgtatttactatactggtctcaaactccaggcctgaagtgatcctccctccttggccccttaaagtgtcccaaagttctaggactacaagtgtgagccaccatgcctggccagggttttttctttctagagtctctgagggagcatctgttctgtgtctgccttctagcttctggtggttgtaggtaattcttggcatttctttggcttgtagctatatcatttcaatttctaactctgttcttcacatgaccttcttccctgtgtgtcctctgtgtctctctattagcactattctcttctttctcttttaaagacacgagttgtaaatttatggcccaccctaatccaggctgacctcatctgaacttgattacatctgcaaagatcctatttccaaatagggtcaccgtcacacaggtattggtggttaggacatcaatatatctcttctggggacacagttcagcccactctaccccgttttcagttaaattagcttaagtgggtatctgctcttttcttgttctaagactctcaaagacagaactccagtgaccttcagcttcactcttcagtcacccattttcatagctcttaccaagacccaaagtgagagttgatagttatctctcactttccacaggaactttttaaacctaatctattccatttataagtgtttctctttgtcttcccatgctcattgatacttcacttcctttctgtggtgagtagagaggtccccactaatgaaggatgtggtaggtttcagttcaatatcagaaagtgctccacctgatatatcattttttaattataaaaattttcaaagagtggagagaacagtatgttttaccctaatcacctttaacagtataaattcaaacaccccactcttatcaaagccatttactcttcaaaatgtcccacctggtttctcctgatacatctgctctttgatctcaccacagccttcagcctctgctttctctattttctccctttttattttctttctacatagcttacattccctgatccaaaacaaacttaatttttactgtcaatattttcctcttaaaagctgtggaaggcaggtgaattcctaggcaggcagggatgtcagaactaggctggaagtcagaactttaagccaaggatagtctaaggcttgaaaactgagatgccagttctggatagaatccacggaccagagtgaggactcccactcccatctggcatgcttctttccaattggtccttacctttcaacatatacctatctttctgtgattggctgtgggccgaatgttcatttgcatagagtgaaacgtcactccagcccccaatcagttgtgggccgagccttcacttctgccttcaatacgtttttttacactatcgtttctctttctgagtggtgctttttccaaaacagcccccagaccagtcagcacactcctccttccttctcagtccataaagaccctgaccatagccctgcagccagcaaccatcttttggatcccctctctgctgtgagctttttctgttgcttgataaatcctactctgctttacacactctccagtgtccatgtgccttattcttcttggtcatgggacaagaacccagaactcaccaaactgcaggagcacaggaactgtagtgctccagctcactgagctgctggtggcaggactaaaagggctgtaacacttcctccaacttgccgaaatacagaagtgaagaagccactgggcaccactccctcccgctcgctggacagtggaagtaggaaagctgcaacactccattgatcccttgcccttcaattgcatccactggaaaaattctaaatccagatctgtctaattgccttcttcatgcctatacttgtgcccttgagggctgctagagaaaattacaccacttaggcgggtatacagttctgacttccagcctagactctcacgtctgcttggcagtcctacagagttgatagttatctctcaccttccatgggaactttttaaacctaatctgttccatttataagtgtttctctttgtctccccatgcccactgatacttcacttcctttctatggtgggtagagaggtgcccactaatgagggatgtggcatgcttctctgcccattccattccccaaaccaaaacagacagacatacagatacacacatactctctctcttcctggagccagaggcttctcaaggttaggaaaagtaaaaggagaattagagtagctatacaagtttggggaaaacctgatcttcttttagtattacaaagtacaagaaataccttagcagtgaggaccatgtggtgtctaaggcaagtgcattgttaccacacactgtgctgcagccaacctcatgggatgttccctctccaggctcacccagtaccttatgaattaactgacgtcctggatagacttctctctgccctctggggagctgtcattggatcttatgattcactttgagagccttcatcctccaaattcaaatccttaaaaacaacaaacaaacaagcaaacaaacaaaaaaatatgtaactcccataacatctctagttctctaagtgaatgggacagaggcagtgtttgagcagaattcttccaagggtctgtatttgctgagatacttgtgccccatatacctcacagggttacagtacaattggggattgtcaagagaaagtttaagatttacctctttgaggtgcccactgctttaaagtctcttctcttgttcttccaaagacttaccaaatataatgagattgcctggatacaccactatgtccaaagaatttatattttcagatattctctccatatcaactgctggggtagctggggtcccggagacacagcttcttttagacttggtgtttttcttccacctaaagtagggttgactaatttttttttctaagctagatattttcttttctttgtttgttttaatatttttattgaaataaaactgctattggctggtctacagggtttttcttccattttacccccaagtatattcagatattacatgctcacttccctgagtctgaggcaggtgtcttcaaataggtctaaaatggcatcagcctcctgagtagctaggattacaggcatatgccaccatacccagctaattttgtatttttagtagagacggggtttctccatgttggtcaggctggtcttgaactcccgacctcaggtgatccgcctgccttggcctcccaaagtgctgggattacaggcatgagccaccacacccgtcagagaggtcagattacaaatcagctaccattagccatgtctctgcctgcatctacaacaatgatccactggagggaagtattctgtcttgctttctttggggaagaaattgtagactcagggtgatatttagtcaatcaaaactttctttcctccttcagtatactgaagagaacgtgtttgtctttttttttctctctctctccactgtaggcaataactacccagagctctgttagcataaattttatgcaaattttattcaacaatgctaacctggggaagaagaacaaaatttgtatagtggcttaacagcgtcaattgaagtttacgtagttcggagaattagtcaaggattttctcctaccaataatttgtgcagattagcagccaggatttgggaaatttcgatttttttcaacaggaatggaaaatagctgggatctgaggtcatgtatacaagggagtagagaggaatagttgcagaaacccagtggaagattcttagtccttcacaatctcttatgttatttttaatataataaatattttaatatgcaaaatatataagatgtatatatattatttacatatctttttatatgtcatatttatatattatatataaaagacaagcaagcatattttacagacaaaaagaaggctatttcagaatgattttagaagcattacatattctctttcctttagcattatgtactcttagaaggaacatagagattcttgcaatatattgttgaagaacaagagatactgttcataatctactaattcatctgattccatgagaaggaagcatcgttttgtggtaatatctcccataagaacaggatgaatcctctggaaaaatacccacttaaaatgtaaaattaaaaacaaattaaaatttaaattaaaaaaattaaatttaaaaaagccaccaccaccaatgtaaccactaccatcatcaccaacacaccactagcaccactaagcactggctcagcaggtagagcattttacatttttcttttttttttttttttgagacggagtttcactttttttatccaggctggagtgcaatggcacggtctcggctcacagcaacctctgcctcccgagttcaagcgattctcccgcctcagcctcctgagtagctgggattacaggcatgtgacactatgcccagctaattttgtatttttagtagagacagggtttctccaggttggtcaggctggttttgaactcccgacctcaggcgatttgcccaccctggcctcccaaagcgctgggcttacaggcgtgaaccaccacacccagccacatttaaaattttcaatgtgaaaaactgatctatttttaacaaactgtctcatgccatatttcatatgtatcttaagtttgatggattccaaactccaaatattatgacattaatacttagttaatatggtcaagtgagtaattttctataataaaatggtttttctagaatacttcctagaaagcagagagctttgtattgcaatgttgtttctttttttttagcagggtatattaagctgccagctgatcccagttggacaagctgccttgtctttctctccttccttgctttaggtgttttccatcatttctgtgctgaattccagtgttctttcttagatggtctgcatgctattttagcacgtctttgtctcatcaaacttctttaatgttattattttgaattccttttcaggcattttatatattgtactttcttttttttttttttttttttagagacagagtctctcactctgtcacccaggctggagtgcagtggtttggtatcggctcactgcaacctctgcctcctgggttcaagcgattctcctgcctcagcctcccgagtagctgggactacaggcacgtgccaccatgcccaggtaattttttttttttttgtatttttagtagagacggggtttcaccatgttggccaggatggtctcgatctcctgatttcgtgatctgcccgcctcggcctcccaaagtgctaggattacaggcgtgagccatcacgcccagcctgtagatatatttttcattgcaatctgttgctggagagtttttgtgttcctttggaggcatcatatttttaattttgcttgtgtctttatattgatatctgcacatctggtataataatcacttcttccaattttatgaattggtttttgtagggaaatacttttttttctgtagatgtatctatagcattgattggatggggtactttggctttgattctagatggatgccatagtgtcgtctctgtattatttcttcggctctaattagtggcagtggtgtttgtgagttcctcagtggcttaggctatggtattcagtggaggctgtggtgaagctttgctagggacagggacaccaggagggcctggtctttgggccacattggtggaagtggtgggctgaatgggccaatccttgggtccctgggtagtgtatgcaagcaccagtaatatcaggtcacagcaggttgatccttgacccttcaggtgccttgaactggtgctagcagtggcaggactatgctctatgggtgggtgggttcttgggcccattgggaagtgttgtccatgtacaagtgaataaattcttgttgatctttcagtctagttgggttagcaggtatatctgcaggtgagttcaatcaatctcatgcaacaggattatgtaagaaaaacatcctgggtgaacttggcaaggcctcctcctcagttgtcagggatatggacaggagttttttcttcccagaaaatatccccaagtcatcttgaagccatggtagcacctcctcaggttgctcctgagggaaacatttaacacattttaaatctcattcaatgatggagaacaaataaatttcatcttatatcttgcttttccaccacttgatttgattacaagacctgttttgattacaaaaaataccaactaccagctgggcgtggtggctcatgcctgtaatcccagcactttgggaggctgaggagggtggattacctgaagtcaggagtttgagaccagcctgaccaacatggtgaaaccccatctctactaaaaataaaaaaattagctgggtgtggtggtgggcacctgtaatcccacctacttgggaggacgaaacaggagaatcacttgaacccaggaggtggaggttgcagtgagctgatatcacgccattgcattccagcctggatgacaagaaaaaaaaaatacaaactaccaaattcaaactaggttaagcaaaaagggaatagatttattcacataaccacaaagtctatgggtaaggttggttttaggcatgggtgagcctaggagactacacaatattctttggactacgacaattgttttctttgtgttttgtttctttttttgagacagagttttgctcttgttgcccaggctgctggagtgcaatggcgtgacctcagctcactgcaatctccacctcccaggttcaagcgattctcctgcctcagcctcccaagtagctgggattacatgcatgcgccaccacacctggctaattttgtatttttagtagagacgaggtttctccatgttggtcaggctggtcttgaactcccaacctcaggtcgcccacctcagcctcccaaagcactgtgattacaggtgtgagccaccacacccggcctggactgtttttctttattgttcaactttgctttcttttggattggtctaattcttaagttccaagtacaaataaggctactaatagatgtaggctcagaatatcccttcagttagtgcttgctttacttatagcaaatgttccagggaagaacataattggcttgtgtgatagatggaatagtgactccccaaagatgtcacatcccatcccagaacctgcgagtctgttaccttacatgacaaaagaaactttgaagacgtaattaagttaaggttcttgagatgagatgatcctcactgagataacctcccctcttgacattatcctggattatccaggtgggccccaagtaatcatagatgaaaggcaggaggtcagagaagagaagaggtactatgctgttggacttgaggatggaagaagggagccatgagccaaggaatgcaggtggcctagaagctgtaaaaggcaaagaaacacattctctccttgagtctgcagaatgaacgtagccccaaggacccattttagattgatctctagtactgtaaaataataaacttgttgctttgttttaagtcattaagtttgtggtaatttgttaccaaagcaagaggaaagtaattcaacctttgatgattgcccctccctgagccaactgctctgattgtggtggcgagtgagaggtagtccattggtgtgggttatatacaccaatccctgaatccgggttgggctaagtccagtgaaaccaaatgaatgatgtgttggggtggaatggatcttcaacgatacgtgacttctccaccctactccttatagctgcctagcagccctttatacacatgaaatgtaaaacgtaatgtgactattactcaacagcagacagcccaaattatcctttaggtcctgcattcattttgaatccagagccttctttttttttttttttttttttgacaagatccataatttttcattccatgaatctacaataaagctccaagattatatatgtatgtaaaattttcagattatatcctgctcagttgtgtgtgtatgaagattaaaataaaaaaggttgaaaaagaaagcagattggtttctatggtgggttttttgggagaggtttttcttagtttattttgaaatatgtttgatttccattaatactgttatagtggtacttgttcagtaaatggttattgaaaactatgaaaagttctctgttctctttaatcttgtttttcatatttccccagttttattgtggtataatctactacatctaggatctttgagtgattcatattcttttgagtcaggtccatgaaattctacatggcaagaaatctacataagaatccaataataaatagtggaaggaaacaaaaaattacaacaaaagtttgcattcagaagagggaagaaggggacaagtcgatagcacacacacatcctggggggtccctgacctggaagtaaattaggttttagtatgttgtgctcatggccacatgtgaaatagacactgaggaggcttccacttctggtgctgtaccaaattcctcttggtactggttctcctgccgaggaggtacctcaggagttaagctgtcctgagccttggtaatccaggcatgggattcccgtggcaatgtatttaccttgaaaatttagcatctgcttcttgattcactttttcacaattctatgctctggcaagcaaagacagaaagttggcagaggtatggtctgtgggtcccgactccatttctgtctctttagcaacaggccttaatacaggtctatttcttgtaaacaatgggctcgggttgttcttcagagcgaatctgctcctcattgctgtgctgcatcgcagtgggaggctctttagaatagaggtaattatgatcattacttgtatagggaaggcaaagctttacctctcctttcttaggatctttggctgggcctgagagttacattgacataagatagatgggcagaagaaaatcatttggatttttacgtgtacacagcaactcccaaagaggtggcaaaatctaggccagcctaggaaacatagtaaaaccctatctctacagtgcttacatattaggttgaacaaagagaggtaattatggaaaagtaattgccagaccagggcaataaactgaatatcacgattaagtcacataaatgttttggtttctcaatttatataaaagttatgtttacactatgttggactctattaaatgtgcaattgcagtatgtcttaaaactatgaacatactttaatttaaaaatactttattgtggctggcagtggctcatgcctgtaatcccaacactttgggaggtggaggtgggcagatcatgaggtcaggatatcgagatcatcctgtccaacatggtgaaaccccgtctctactaaaaatacaaaaaatagctaggggtggtggtgcgtgcctgtagtcccagctactcgggaggctgaggcaggagaatcgcttgaacccaggaggcagaggttgcagtgagccgagatcacggcactgcattccagcctggcgacagagtgagactctgtctcaaagcaaaaaacaaacaaacaaacaaaaaaaccccaatttattgctcaaaaatgctaacaatcatctgactctttagtgagttgtaatctttttgctggtagagggtcttgccttgatgttgatggctgctgattcctcagggtggcggttgctgaaggttggggtggctgtggcaatttctgcatcatttttgcagtgactttctctacttaagtttgaatcccttgaagccgcccatgaggattagaatcaatttcttccaaacttctgttaatgtttatatcttgacttcctcccatgaatcacaaatattctttttggcatcaagaatggtgaattcttttcagaagggtttaaatgtacttttccctgatccatcagaggaatgactatctatggcagctttagccttacaaaatgtatctcttaaatatgacttaaagttgaaattactccttgatatatgggctacagaatggatactgtgttagcaggcatgaaaacattaatgtccttgtacatctccatcagagctcttgggtgagcaggtacactgtcaaagagcaataatatttgaaaggaatcttttttttgagcacgaggtctcaaccatgggctttaaatagtaaactctgctgtaaagagatgtgctgtcataccggcttcgttgtttcatttacagagcacaggcagaatggatttagcatcattcttaagggcttaggatttttcagaatggtacatcagcgttggcttcaactgaaagtcaccagctgcattagtccgtagtatgagtcagcctgtccttggacgctttgaagccaggcattgacttctcctctctggctatcaaaatcctagatggcacgttcttccactagaaggctgttttatctacattgaaaatcttttgttcagtgtagtcactttcatctgtcatcttaggtagatactctggagaacttgctgcagtttctacattagcacttgctgctgcacttgcactattatgttatggagacttctttccttaaacctcatgtacctacctcggctggcttccaagttttcttctgcagctttctcacctctctcagccttcacagaattgaagagagttgggccttgctctagattaagctttagtttaagggaatgttgtggctggtttaaacttctatccagagcattaaaactttctccatgtcagcaatccagctgttttgctttcctgtcatttgtgcattcactggagtagcacttttaatgtccttcaagaacctttcctttgcattcacaatgtggctgtttggcacaagaggtctagctttcagttcatcttgggttttgacatgccttccgatttaaaatgagatatgtcggtcttcctttcacttaaacacttaagagtccactgtaaggttattaattggcctaatttaaacattgttatgtctcagtgaataaggaggcccaaggagagggaaagggatgggggaatggccggtactggggcagtgagaacatacacgacgtttatggattaagttcactagtcttataggggtatgtttcatgacaccacaaaacaatgatcatagtaatatcaaagatcactgatcgagctagacatggtagcccacacctgtattcccagcactttaggatgctgaggtggcaggatcacttgaggccacaacttggagaccagtccaggtaatatagggagaccccatcgctacaaaaaatatatatacatatatagtttattttaaaaaataaaaaaataaacactaagatctctgatcacagatcaccataacagatataataatgaaaaagtgtgaaatattgcaagagttgccaaaatgtgacacagagacacaaagtgagcacatgatactggaaaaaatggggctgatagacttgcttgaagcagggttggcacaatcccttaatgtgtaaaaagcacaatatctgtgaaacacacgaaagcaaagtgcaatataaggtatgcctgtatataaaataaacatacatagatactatacatataaatgtgcatatatgtatatattaacgtcttcaaatagaaacacacaaagaacaaagctatgtattaattcattaacatggaactcacagccaacagcattataactcactcctataatatgtaaataatgaggattgactgcattttaagtaaaataacacattatcacatagatatagagtataagttccaataattcatctgtaagtctttctctctgttggggaggggattagaaataaagatgaggaagaagatatttcattttaagattgtattttgttgcgagtttaattttaaatgggaacttgtttttgtttggaccacaaaacagaacatttaacatctgtactcaaaaacaatattgataagcataactgaagcttctataataaactttacaagaagaaaatttcttacttttagcagcccacgaaataaattttaaatagcatagaagaagctgcaaattctccctataggtacagattttatatttttagtatgtccaccctcagaggcatccatcattcactgaaaatccaggaaacttgaggtttgtggcaataaaagtgactctatattggatgctaatctgccatgttgacttctaattaaccccagtcctaaagacgcctcctgagtcctattttatttactgtccttagtgtaagaacatgccggccattagatccaagcaaccttgatgttatcacacaaattataggctatgaccacatagcagtcttgcctcttctggaggtttgcctttaactgtctctatacagcatgtacaccctttccttatggtataaaagccctgggtctggggagtattgatgcagaggcctacctgtcttgctgctgcccaagaccatgcttccatctctaagttccccagtaaatcatcctttactgcaaactggttttgtctgccttgttctttggttccttgggtccttctgcatttgggggctgctttgtgcatgtggccctttcacagaagcttataattagaaaaaaattcttcaaattattaattgtgcaacagttggaacatgcagatatacaaaaacacaaatgctatcaaatgaatatagtaaggtatatttcatattccatttttatgttgtcctgcagagctataattttcccaaaagacaaaaatcaaagctaaattaaatacaatactgccttcccaattcccagttaaggcaaaacaaatgtattaagaattgcctcatcagaggtacaaagagagggaagcatgcctgtgaaatctcaaaatggaaaagagaaattggtcattttccaaagtggcctctttctaatgaaattctagcagagatcttcaaggatagaaatttgggccaggtgttggggccagaacaggagttcaaaaccagcctggacaatgtagcaagactccatctctacaaaaaattttagaaattagctgggaatggtggcatgcacctgtagtctcaggtactcaggaggctgagacaggaggattgctttagcccaggaattcaaagttgcagtgagctaaaactgcaccatagcactccagcctgggtgaccaagtgaaaatctgtgttccaaaaaacaaacaaacaaacaaacaaaggatagaaatttatcttttgttgccttagaataattcaataggaatggttgaggttgctttcttgaagcactgatttttatttcaggtctttccattgatgcgtttgttctaaaacacaaaaaaagtccttattttataaaacaaaaccagcagtataggactaggcaattgaaagtaaggctaccttgcaacacttacctaaacaccggtcaataaagaaggtagtcagttgtagaacacaaggaaacatggtccctctgttactcacgctttgggtaaagttttgtctccctcaagttcaagttacagccctccaaaaatttagtgttgtgagaagtaggcaaggcctgttaggaaagtgcttccttagttttaatatagttgattaacaaaacttgaaaattttctagctgttccttgcctgctatttgtttttccttttcttgtgctatcagccagaccttgtggttctttttttttaagacagggtctcactcctgttgtccaggctggaatgcaatgcagttggagttacctggttcactgcaatctctgcctcccaggttcaattgattctcctacatcagcttcctgagtagctggaattacaggcatgtgccaccacacctggcttatttttgtatttttagtagagatggtgtttcaccattttggccaggctggtctcgaactcctgacctcaagtaatccacccacctcagcctcccaaagtgctgggattacaggcagtgagccactgcaccctgccaaccttgtggttcctatggatgtatatcaaccaggatcaaaatgcttttatacgtagtgtttttttttttttttctctgagacattgtctcactcttttgcccaggctggagtgcagtggcatgattttggctcaatgcaacctctgccactcggattcaagcaattctcctacctcagcctcccaagtagctgggattataggcacgtgccaccatgcctggctaatttttgtatttttagtagagacgaggtttcaccatgttggccaggatggtctccatctcttgacctcgtgatccgcccgcctcggcctcccaaagtgctgggattacaggtgtaagccaccgcacccggccttatatatagttcttaattgggattgtggagggacttagttgaaacagatatgaaggctaggctttctgagcatggggatagagaactgtggagaaagaggatcctcttttggtggaactaatccttttccttaggggcaatctctaaagccagattaaaaaattagtttatcaaaattttggctttgggttgatcctaatttccacaatcttaaaagaaaattttcaaaaagatgtaaaatatctccaatagatttcttcaatatctttctcttggtggtaataagcagcgcaaactaatatacctactaaacataattatttactaaaagttttttaaaaatgcattattaacagcaatataattactacataaagttcaaaatttctaataattccttttgcttttggattgtattccactaatggttttcagtggttggttcagctattggttgttcacgagtcacccaatagctccctctctgtggctgttagtccttacctgatgaacagtttagttcagtttcagtttgctttattcgttggcatcctagcagctgtcatttagaagctcttacaacattatggctttcaggtgtggagagaggagggtctactctattttgagatgataaaaagcactcaaataggcccagtgcggtggctaacgcctgtaatcccagcactttggggggggccaacgtgggcagatcacttgaggtcaggagtttgagaccagcctggccaaatggcggaaccccgtctctactaaaaatacaaaaattagctgggcatggtggtgcatgcctgtggtctcagctacacaggaggctgaggcaggagaatcgcttgaacctgggaggcagagggtgcagtgagccaagattgcgccactcaaaaacaaaccaacaaacaaaaaaccaaatggctgtcttcaaaattatgtacaattttattttgaaactatgtgatccatctagaatgttgaatacataattataaacaggattcacacgcatgctctcttgctgattaatttttcacctatgatttaatttctattaagattaaaatatactgtcatatactcagtaattgttcttaaaatttgctaaatcctttagcaaagcttttcaaagagcaagctttttaaatttatcttgctttttctttttttttttttttttttttttttttttgagacggagtctcgttctgtcgcccaggcgggagtgctgtggcgcgatctccgctcactgcaagctccgccttccgggttcaagccattctcctgcctcagcctcccgagtaagctgggactacaggcgcccgccactgcgcccggctaattttttgtatttttagtagagacggggtttcaccgtggtctcgatctcctgacctcgtgatccgcccgcctcggcctcccaaagtgctgggattacttgctttttctaagctatgaacttttaaattttataaggttctcagatcaacttaatcttgtttcgttatactaagtgttttctgttgcttttaacagaatatctgaaactggataatttataaaggaaatgaatttatttcttatagctatggaggctgagaagcccaagatcaagggggtacaactagtgagagccttcttgctagtggggactctgaagagccctgaggcagtgcctggtaccacatggtgagggggatgtgcatgcttaagtgctagctcaggtctctcttcctctccttgtaaagacaccagctctgctcccattataacccattaatccataagccaattgatccatttatgagaagagagccctcatgatccaatcaccatgtaatggccccatgcctctcaatactgccacactggagatcaagttccaacatgagttttgaaaaagacattcaaaccgtaccatcaaggtttacccatctaagggattctcccacttagcattagctgcatcacactagtagtttttaattattattatatttttttagagagtctcattctgtcacccaggctggagtgcagtggcgtgatctcggctcactgcgacctccacctcctgggttcaacgattcgctttttactttcttaagagttatcaaggagatattgaatcttcatattccatatcactagcagaagaatacacgtaaattcagggtcttcagggctttgcttaaactgtacatagatcaaattcttacttatatagttgtatttttatttttatataaatttatattcttattttagttgtatacacagtacagaaccacagcgttccagaaacttttgggtaaataaaattatctgactttaatgctgtggctttaggaaattccaacttcccaaaaccaaatgatttcataaaataccatcacagtgtatgaaaaaaagaaaacagataactagaaaatatccattattacaagtttaaacaacactaataaggttcaaatggaaaatctataaattcatataatttccaattatctgggttctgcttgaaccagctcgtaaggcacagtgtttataatgataatgcattgttttacaccatatttacatgaagatttagctttaatacagaaatctaaattcttgcatggtttcagatgttatgcctgaaattccaaagtctgcattctgtagtagctgcagttaacaccccagaggaaaaaataaactacattctttaattttttttctagggtctgcattcctactgcttctgggacttaaatctgacatataggcaattttaaaggtgactcctaaaaaaaaaaaaaaggtgattcctgggattcttagaagaataaaatatgaaggtataagtgtgatttaagaataggtgcaaaatataagcagattatgcgtccaataaaaaaaaaataggaacaaaacacagaaggtaccaaggtttttttgggcactcattttttcacactaactacaattttcccaatgtcatctaggaggacctctgtacctcctctgagatgtgaactgtgggaaaacattttaaatggtccattttcaaggcatgataaatctaagcactggcagccagccttggtatgtaacaaaccgcactgctcatgcacctagaaggtcacaataaacgaacagaatgtagaggaggagtcagcccataaaagggaagaaagtttcgttattgggaaatcaaaacttaaggggggaagggaatggggtatataaccttacaagggggataatgaaacttacgcgatgtctgggaagactgtaatcccatagtacttaaccaatcagaaactgggggaaggacttgtgtgctaggagataaattacctgctgtaactgccccaggtgtgcctgcccaccagacacccaatcttgcaagactgccattaaaagtcttgcttccactgttcttcaggtctccaagtctgttctttcggtttggacgggtaaatgggtggttcttagatgaagatatggtctttagctcttaagtgctgttaaaggtacctgaaaagtcttctccccaagtttggcttttccctcgaggttcttaatgaggctttgcaccttctcctgggttatctgtcagggtggcaattaagaattttggttttcctttgtaagcctcatcttcccacttaggacatctgactaggatgggatttgttcagttttctcttctaacggtcccagggaaaagtaatttgggatcatttcagatacgccaattctatctattaatatacttttgaactcaggtatcctaatggtataaatactataaattgatccaggagtgagtctcccttcctgactcttgaaatgagaagcattcattaagacagtgaatctggcctagagacaaaaatgagacccacaggaaaaacagatctcctgtaaggacgagaagggtgggtaacacccctgtggggaagggtaacacaaacattacagtcctcatctaaggagacaaaaaccttcctgaactctgcagggcccagcgcagagcctcagcaactgaggggatataggcaagccagacagcaagacatcaaggggtcttaagagcatgcatattccctgttctgtagccctgacttcattcaggttctggaactgctccaggctatgacaaactgttagaaataagaccacagacttgcaattttctgaaatacaatacagattttttgctctttactaaaaaaaatctgcctgaagaaaaaaatcaagagtatttaccatcctgaagtcaggtaagttcaggtaactgattcacttcagttcataatacaccagttttctttatacatgggtttatcccaagatcccagcaacccccacttgtgagaaattattttgagatcttggaggaagggccttgtattctcaaacttcctgtatatatttgaaaagaaatttcaagtttgaaagtttgacaatgggagagcaacaggaaactaagcacaatatacatttgtaaagatacaaatatacattttgaaatcaaggggactcacagtaaacaaggtaaattatgcacatgaaagaagattcatttatttgaaaaggaagtatctggagataggaaaaaccaaagatgttttttcctactttcttttttgtacagacaaggtctcactatgttgcccaggctgatctggaactcctggccacaaggatctgccctatcctgaaactttctaggggcccccagccaccagtcatcacatgagcatacaaaagacacttaactctgcagattccgctggatgtcagggattggggataaagaccaaatacatatttcacaatatcatagcacgttattttttgcgtctcagcaaaagtgacaaacacaatgggaaaaggagactgatttccctcatgccattatgagaaaaatatctgagtgtactcactcagtaacacacacggcaaaggccattatgagaaaaatatctgagtgtacacagtaacacacacggcaaaggcaaagttattccagaggtaatatgtaactggcaaaattttcctcaaattctttcctctttttactatgacctaagctgcacacacatttctgcctctgcatccttgattgtacacgctgcaaatatagtcaatttgcattatttgtggtacttatgttccataaagtccacaaacactgaagtagtgaataccaaatcactgctcctagaaaacatacagggttaggtttctgcaagctttgtttttgtcaacagaacaatgcaacatattgttgattcagtaacactgaactctctgccaacagcattataacttgtgcatgaatgaagcttatctaatatacttattttctcctaagccttcctgagcttaggaacatcagaaagcactccagcagggcatttggaggccattttaaacagtaaaatcaccaacaaaaagaacagaaattaggaagagatgggactaagtagactcaaaaaggatacatgtttacggtatgagagctgaaactagaaggcagagtaccatttgtttcacttctgttgggaggtgactcacatttttgcctacaaatggctcaaaagcacttgtgcaagtactggttctggggttatggatagatttgagcaaggaggcaaatttacaaatataaaatccacaaataatgaggatatttcaattccttcaatgtggttggaaagcacaattgccccaataggacagtcagaaaccaggactaggaacttgtatgaaaaaagaacctagtcttaattgccaccatctatgtctaaaataaattctcagggaagcagaattcttacctctgtatgctgtacattttttctattaaaaaatgtcataacttcattaagcaggtgaactaaaatttaagagacatcaatcaaagaaatgactaatgaatttcactttagtttttattttattgtaaaacattgagatggaatgatagggtttcccagaatcaggtccatattttaactaaatgaaaattatgatttatagccttctcaaatacctgccatacttgatatctcaaccagagctaattttacctctttacaaattaaataagcaagtaactggatccacaatttataatacctgtcaattttttctgtattaaacctctatcatagtttaagcctattagggtacttaatccttacaaataaacaggtttaaaatcacctcaataggcaactgcccttctggttttcttctttgactaaacaatctgaatgcttaagattttccactttgggtgctagcagtacacagtgttacactctgtattccagacttcttaaattatagaaaaaggaatgtacactttttgtattctttctgagcagggccgggaggcaacatcatctaccatgttagggacttgtatgcatggactactttactgcatatatttcaagttgcccccgctttttttttcaaccacgcattaactcaagatcaatgtatgttccattagaataagatttattaactaggaattgccagaaaatcttcctggtaacaaggaagtccccgtattgtgagtcttaagatttttctgaagagaaaaccatacatatatagccttttttcagatgctcaaagaggtctaaaatcctctccacctccaaaataataagaaacatctcagctgggcacagtggctcacgcctgtaatcccagcactttgggaggccaaggtgggcagatcacttgaggccaggagttcaagaccagcctagccaacatggtgaaatcccatctctactaaaaatacaaaacttagctgggcatggtggtgcacccctgtagtcccagctacccagtaggctgaggtaggagaattgcttgaacacgggaggcagaggttgcagtgagccgagatcgtgccactgcactccagcctaggtgacagagagagactctgtctcattaaaaaaattaaaaaaaaaaaatgctgggtgaggtggctcatgcctgtaatcccagcactatgggaggccaaggagggtggattagttgaggtcagcagttccagaccagcctgtccaacatggtgaaaccccatctctactaaaaatacaaaaattagctgggcgtggtggtgtgcacctgcaatcccagatacttggaggctgaggcaggaaaatcactggaatccgggagatggaggttgcagtgagctgagattgcgccactgcactccagcctgggtgacacagtgagactccatctcaaaaaaaaaaaacatgaatcatctcactgatcctcttattttacaaaacagtaatatgcagtattgtttagtttaacttgccatcattcagtagctaaccctattctccaaagttctggtagctctaacaaactgtaactttataaacagagacaggcactttggttctattctaatactttcacaaacatactgcatttataacatttaaaagattttaattactgtcaaatatatctggattacatcttttttttttctttgatagcgtttcactcttgttgtccaggctggagtgcaatggggtgatctcagctcactgaaacctctgtattccaggttcaagcgattctcctgcctcagcctcccaagtagctgggattacaggcacctgccactaagcccagctaatttttttgttattttagtacagacagggtttcaccatgttggccaggctggtctcaaactccagacctcaggtgatccacccacctcgacctcccaaagtgctgggattacaggcatgagccactgtgcctggtctggattacatcttaacctacaatatttcatgaagttaatgattttaaataaaaggaaatcaagtaacatctgaatttctaagtctaaatacatttagatgatagtgactcctgcaactgtttcaaaattattggaaaatatgtcattttcttgaaatgaacttggtattaaaggcagcaaatatgtctttataaggagtttctgaatctgacttggtcgatggtattcggcaaagttggcgaaatccaggagaacgcagcagcaaattctgtgaaaggcccacgaagctggagcataaccagtagagaacaattgactataaagagaagacataaatgttagcatctgtaattctacaaggacatcacagtccagacaataaaaaataaaatgacaatctttgtaaatacaagtatgccaagactaagcaagacttgcagcagctactagattcctgggatagatttaatagacagggaaaaaaggttacagacagaccaaaaagcaaaaataaaggaaaaagagaagtatttagggtagaaagtaaaaagagagaagctcctaggcagaggctcaagagagatcttatctcccttcttcgacaatggaacataactttttccccaccaaaagtcctgtccaactgcttacatactgaaggtagaatgctggaagtgtggcacttatgatggcaaacttagcctccctacacctaattttccccatacagtcatctatcttccaaatgtttcccaacagccagtttctcagtgtagtaaggaatgcattttctttgccttcttctgagacaaacagcctcagcattatctccaaatttcttttgtattaccatcttgagcagtggtccccaacatttttgacactaggggccaatttttccatggacaggaggaagattttgggatgaaactgttccattcctcgtatcatgaggaatgagatcctcataaggagtgtacaccctagatccctcacctgtgcagttcacaatagggttcgtgctatgagaatctaatgctgctaatctgacaggaggtggagctcaggtggtaaggctcacttgcccaccactcacctcctgctgtcagccggctcctaatcggctatggaccagtactggtctgtggccccgggtgaccatttatttaggtcaatacgaagttctacaacctcctgaaatactcctatacttacacctgttccaaacttttctttagcatcagaaggtaatcaggccccagaaacaaaatcatgcagttgttaagtctaggtcctggaggcaaactgcctgaatttgaatcctacttgccatctatttgactttgagtaagttattttccttctgttccagtttcctcatctgtaaagtggggacagtaactgcatctacctcagaggattgctgtgaggaataaatgagataattcatgtagagtggtatgcaagtatgtggtccacattcagcacttacatttgttatttgttccaaagtcagtctttaggggcagaaagcagcacatcctcaaaggtagattagcacagtagttaagaggaggagccaaactgcttagatgtgtgttaagactctatcacttatagctaagtgaccttggatgagttacttaacttctctgtgcctcagtttcctcatcaccaaagtgaagattataatagtacctttatcgtcgcgctgttgggacaattacatggggtaaaatatgtaaaccatttaaaacagtgcttagcacaaagtcagtgttaaataaatattggctatcatcattatctgatttatccaccaaaagaaaaagaacctgcggccaactacagcagtctataagttgccagctaagtatcaatctcccctcttccttagtaacaaaatcttaatttttatttgagtaggctgtcatctaaaaaaaaaaaagactatatttccttgcctcttctgcagtgaggggtggtcataaaactaagatgttaacacaactgtttggtggaacatctggcaagtctccttaaaaggggctgactgcacttgaggcacccttttctattcctgcatgataacaagctctaacagccatgaccgtagtgtagccttgaaatcacaggctgtggataacaaagcagaaagagagcagcagtctgggtctctcatcttcatggacttgtctcatcatccctaagctgcttaatcagatttcctataattgacaggataaattttgggtatttaaggcattgtgttttagatctcttgttactcattttgaactcaatccctcattaaaacttaactgctcgtattttattttatctgaggcgttcttcagtatatagctggtatgattgctctgtggaaatgtagtgaatctgtgccgttctacttttacagggtattttacaacactactactttatgtaaaaagttctctaataggcactcatttcattaattctcacaggcattatgatatctattttagagatgaacaaacttattctgcataggattaatgacagtattatgttcagtaacagcctaaaaaatagattttgatagcaaaaacatactgttttagattcctataaaaaatattgtgggccaggcatggtggctcacacctgtaatcccagcactttgggaggccgaggcgggtggatcacctgggtcaggagttcaagaccagcctggccaacatgacgaaaccccacctctactaaaaatacaaaaattagccaagtgtggtggcgtgtgcctgtaatcccaggtactagggaggctgagggaggagaaccacttgaacccaggaggaggaggttgcagtgagctgagattgcgccactgcactccagcctgggcgacagagcaagactccatctcaaaaaaaaaaaaaaaaaatactgtgaggtagttttatatatgctacaccctaactattaataacaactgaattcgactttatgtgttagctctgagtaaacatggagatatacctaacacagcttttgcctccttagaaacttctaaagtatttgtgggaaacatgcaaaagactgaactaactgcaaacataaccatttctttttctatttctataaagattaattaggtatatacagggacaagtttacctatttcatagagttgttatgagattaaataataccatacacaaacccaaatggtcttagcattttgttttgtttctttttaagtgctaaattctttgctccagtctacataggcagaactaattcaatataccaagtagtcaaatggaagaaataccatattcatggtattatgcaaaacacgttgcaaaatttaaaaaaaggcaagaaatagagacagattagttaccacagaaacactgatttggtaagggatcaagtagtcagaggaagttcagcagaagaagcaggatcccagccaggtgcggtggctcacgcctgtaatcccagcactttcggaggccgaggcgggaggatcacaaggtcaggagatcgagaccatcctggttaatatggtgaaaccccgtctctaccaaaaatacaaaaaattagccaggcgtggtggcaggcgcctgtagtcccagctactcaggacgctgaggccggagaatggcgtgaacccaggaggcggagcttgcagtgagccgagatcgcgccactgcactccagcctgggtgacagagcgagactccgtctcaaaaaaaaaaaaaaaaaaaaaaagaagaggcaggatcccagccagtctaagctaaagtcagagaggatttagcacatgctacacacaatattggtgcttactcactgagggtaccgttgcagcaattggtatcatcaacaccgacattgcacggacaaagtacgtaatatacgtctgaaaacgagacattccaattttttgtagagcacaaatctgaaggggtagaacatatacatgcataatgattattaaaacgcatattaaatcagacaagctttaaaatataaactgatttttcactggcctccatctacactttaataaaagttatatatatacacacaaaacactgattaatttatatggctgatcatctttttattttttgagacctgtcttgctatcaaactgagaccagtttaagggctggtctcaaactcctgggctcaagtgatcctcccgcctcctcctcccaagtagctgggataataggcatgcaccaaccactgcactcagcttgatcatccatcttttaaaaatcttaactggcctaggtggaaggatcactctagtccagaagtttgaggctacagtgagctataatcatgccactgcactccagcctgggcaatacagcaagatcctgtctcttaaaaaaaacgacaacaaaaaaaaaacactaattatgtcaaattcttaaacggaggttttttgacactttgtaccaaaaaacaagggcaatgatttatatggtagctattgtcacaggattcttcaagctccacttaacaatgatttatatggtagctactgtcacaggattcttcaagctccacttaagaattctgcgtaaggctgggggcctgtaatcccagaactgggaggcccaggcaggccgattgtttgagctcaggagtttgagaccagcctaggcaattaggcaacatagcgaaaccatctctacagaaaatacaaaaattagctgggcgtggtggcatgtctgcagtcccagctattcaggagggaggctgaggtgggaggatcgcttaagcctggaaggcacaggttgcagtgagctgagatcacgccactgcactccagcctgggtgacagagtaagaccgtctccaaaaaaaagaaaagaaggaaaaaaaaaaaaagacttctccataattatgactctagagccaaactacgtagttttacatttttatgcctcactttctctgcattaaaaaaggataatatttagctcacagggttattccaagaagtaaatgagttgatttatgtaaattgcttataacaatgcctatggccaggcacagtggctcacacctgtaattccagcactttgggaggctgaggcgggcggatcatttgaggtcaggagttccagaccagcctggccaacatggtaaaacccagtctctactaaaaatacaaaaaattagctgggtgtgttggcgggcgcctgtaatcccagctactcgagaggctgagacaagagaatcacctgaacctgggaggtggaggttgcagtgagtggagatcacaccactgcactccagcctaggaaacagagtgagactctgtctcaagaaaaaaacaaacaaacaaacaaacaaaaaacacaatgccttgcacatagtgtatgttgagtaagaataagcttttaataagcttttatttttcttttagaggtgaggtctttctctctgtcgcccaggctagagtacagtggtgggatcacaactcactgcagcctccatctcttgggctcaaacaatcctcctgactcagcttccaagtagctggaactagaggcgcacgccaccatgccccgctatgaaaacacctttattagtctttagatgacatagaggaaaagactaggggattgacattgattcactgtaaccttgtgcttatcacttccttctttctaccaaatattcactgaacaccaaccacaggggactgtgctagtgctcttagggaaacatatttggactacaggtagagtctttcctcaagaaactttcacttaagaccttatattctatcatctccattttcctcatctgaaagaataaggggtatattagatttcacaaacaggcatcagaggtcatgaggtctgggagatctctactgaggtaaatcatttttaagatttcttccagtccagtctgttctactcagagtctgagaacaatttatgaaattatatgcacgctttccctaaactgctgagtaaagcagcctgtgataagggttaagacatgactgagagggctgggcacagtggctcatgcctgtaatcccagcactttggaaggccaaggcgggtggatcacctgaggtcaggagttcgagaccagcctggcaaacatggtgaaaccctgtctctactaaaaatacaaaaattagccgggtgtggtggtgtgcgcctataatcccagctactcaggaggcagaggttgcagtgagccaagactgcgccattacactccggcctgggcaacaagagcaaaactccatctcaaaaaaaaaagaaaaaaaaagacatgactgagaggtcacattttctatgtgtatgtttttcccatttcatcttataaagacattcaatgacttttctaaggtcataaagcaagaaaatagcagtcagggcctgacttgtgttctccgcctacaaattcacatattaaacacacacacggaacatcactctattttaagaatacaaccagattgactgggcatctttattactgtttttgccaaaagcaagtcacaaaattctatgtatcagaatcatataattttgaagctgaaagagacttggaagtatactagtgcttttactttaatttcgagagttctgaggcccagagaggttaagggacaggcctaagccaatgcctgacgtggaaccaggaaccaagggatctcacttctaactcagagctatcttcaccaactcaaacaaaaacagatttgaagtcaaaacagcagcaacaaaaatccccataaatggcaaacaaatttcatttaaaactactgacctccactattaacaaattgatgacgccaacagagataggcagaatccaagtggagtcgggtgcagtgaggtcaggaaaccacagaattccaccagtagctaactgttcctgaacagaaaaacctgctaaaacagttttataaataaaacaatagaagtcctaaaaatagcagagaaaaatatataagacataaataagtagtctgacaattccaataaggtgtccctcacaggaaagatctgcactggatttattccagtttttcacgcacaatatatatattttttctcaatacaaaatgttcacaacacaaccaatctgtttacacttaagactttaaattctatacccttataaggaagatagtaaacatatcgtaattatgaaaagtatgcttttttttttttttttttttttttagtacaaagacaatgttagagaacttctttgggagaagacatacaataattaccttctgaatgtgctgcccccgtgcttaaattccggagagcaaaagacatgaagatccacattggaagctgaatccaaaccaacacagtggctttgaaagggtggcagttatctcgcacatatagctctgaaattagcctcctcatattctttagataagtgagcctagattgaggttagggggaaaaaaggggaaagagaaaatgtcatctaagaatcgtgctttatttccatagcacaaatagcgcctgctgtagttattagctaaaggatttgtataagggtttcagctgtcacaggcatgttaaggagttgcctaaacaacaggcaaataaagccttttatcaaaacttctacagtatggtacacaagttacataacaatctgaaattgtcagactacaggctttgtctctggtggtctttggctgattaggctttaaaggtaaatttcactactgacatggtataactacaattaatattggaaatatggaagctaaaagcaaactttaatcaaatctctccactcccgccaaacttaaccacttcatccctgaatataccttttggagctatgtggttttatactgtgtatgctcttggcctgtcaaaatagtctccatttttcaatcaactatctcacaaagatatttttaatctgtttctctgttaaccatattagttactactgttttttcctgaaattttactttttagaatacagtcttccttcaggtccaagagaataggagttaaaaaacaaaaactaaagtattcttagtttaggggacagtgttctattttattcatctttaaatctcctgtatcatatattttgtacagaggaggcattcaatagtttttctgaatttagtcaaattatagtgtataataagacagtacacaaagacattctaggtcctccataatttcacatttgcctattcttccaattttatctcgttactcctctagacacctgcatattctggtctgaatgactttagttcatccaacaaatcagacttccgcataggcatgcctttggaagtactgtattatatcatctgtgtggaaagcccactttcctggctgtccatctgacacaccgtcttttacccttcaagactcaatactattgaaaatgcaggaagctggccaacactgtggcttgcacttgtaattccagctacttgggaggccaaagtgggaggattgcttgaggccaggagtttgagatcagcctgcacaacacagggagattctgtcttgttcaaaaaaacaaaaaagaaaagaaaagaaaagaaaatgccagaagccctcagatgtttcctcctagaaagaaacatctgtaaggctgtatctgcacaaccatcctgccagtactgcttaagcaaggtgccacaagtcttatctaggctgcgttgataacccaggcaagcagctattaatctggttcttttggcctatggctgaagctttcgacttctttgataagtaaaatttcaaacctataggtcaacttttaatttttaccaaataaagacattaagctatcaccacgattttttaaaatgtcagatctttttaacactaaatataggacacaatctcgtattaaagatagttgggaaatgtacaactatataaaaatatatggttaataatatacacataacacagattgataccacaaaggcctttttccattgctgtaaaaaggagaataatttttcgcagtctagtaaggattagagtttgggaaactgattgaggagttgattgaagcaagagggcttgtaagttcccagtgaatgaatgcagacatccttgggcgcaatcaagcacccttagattgggactttccaagaacccaggcagacaactgcacagaataaccacaaaggatagacagcatcttagctatcaaagtgtttctactgtggcacttgttttctacctcctctttcctgtaggctattacctgctgtatcttttccaaaaggtcaagattgtaaataacctgtgtcatttgttgaccaatatcacaaaagaatggcaaagtgccttcatcctgtgaaccctgccctgaccttccttgatgatctagctccttgtacatcatctttatataacagttagttcactgacatcattatttgattacaggtctgtctttttcaataggctggaatccctaaagaataggaacatactcttcttatctttatctatttatttctttgctttcagtccagcatatgaaactatcatgccatattaataacttatgaaaatataaaagagtaggctgggcacggtggctcacgcctgtaatcccagcactttgggaggccgaggagggtggatcacctgaggtcaggattccagaccagcctgaccaacatggagaaaccccatctctactaaaaatacaaaattagccaggcatggtggtgcctacctgttaatcccagctacctgggaggctgagggaggagaatcgcttgaacctgggaggcagaggttgtgatgagccgagatcacaccattgcactccagactgggcaccaagagcaaaactccgtctcaaaaaaaaaaaaaaaaaaaaaaaatatatatatatatatatataaaaaaagaaatactttactgccaaaactacagaatactcaaacttataattaacatcacaatttatgtatgtgtgtgtgtgtgtgtgtgtgtgtgtgtgtgtgtatgtgtgcgtatggtcttacgtggatataattagcttacctggcatctcttttggaccaccccaactgatttgcacgaactgcaacttcttggttaagatgcctggcaatagtttttatttctggctgcaaattttccacctagctaaaaaataggttttgttatgagcacataaaggatctttattcataatgactcataatctttcacattattccctcgagtcatttaaaaatgtagtttactgatcatatcaagaaatcttaattctaagcacaagatgttaatttgcttaaaatgtcctcagtcacaaccaaattcacaatgcatacttatccatgtgatcctgtgcaagtaacttaacctctaaaatcatgttccctcacatataaaatatataacagcacctacttcacagggttacaaatattagataagaactgcaccctgggctttactgttccatctctacatttcctagtaacgtaagcggagaaaacagcagtttgttaagaacctttaatacactgtgatagccacaaatcaaaagtaaaaatagcatttattcctgccctgtgctcattcttcctgtaaaatggctcactgccttaatgttgctgctgattccgttcctgttttgtttccggttttttttccccatgctcacaacctgaaaacaagaaagccactatttttgaaatatcccatttgaataatcaagcactttaacccgtattatctgacttgctctgataacgctgtgaagtaggcaaggaaggtactgctagcctgattcctcagaaaaaaggattcagcattaaaaggtcaagtaactgcgaccaaccagacacagtcttagtcgggtctggagaggaaacaagttcgcaaactgttagtctagtagtttcttcctaataagaaagaccagctggaatactttgggacgaaagacactgcagacatactggctattaaaacttttaagacataaattttgtaggtttcgccaacacaatttcttctgcgactgatttctttgtctccgttccccgagagcaagtatagtaaccacttgtgcttggagcacaaatccagtaagacaaaagaaatgacaggtacacgtgtcacaaagtatcttatttaacacacctaatgctagttcaattttttttaacgctaaaatggtcacaatgaaatggtcacgatgattaaacactaagcactgcagaaggcaacatcgtgcgatcgaaaaccctgagtgaatgtcggccttcctccgccgcaggggttgcagcgcagggtacgcgcacggctcggcgcccctcaccttggccaggatgtagtgctggtaggctgccaaaggcagcgtgacagcaccccgtaaggccacggtggagagcagaatgctgccccaccagggcaggcccgtggcggcgtgcacgccgagcagtacttcctccgcaacccgcaccggcgaagacgcggccagggcctcgtaccagccgttcgcatgtactgcagagactggtgccactgcccacactgggagagtggggcgcttggcgccgctcgtaggaaccggcgcaagcggcaggtccctagcccaaagctgcagggcagggagcggccgcagccaccgaccgccgagccggcacagcatttctgcaccacggcggagcccagatcccgggcctcacaatccagcggacatacaccggccagccaaggctgatacgcgcacgcgccagcaacagcgggcataaagcgcatgcgcgcctgcctgcagccgcgattgaccttcccagtcaagccggtgacgtcttgcgtcgcagtggatgtgacgcaagagataggaaagtcccgcctttcccacgcggcactggacaggcctactgcgcacacgcgaaagtttcccgctgctagggtgtagttagtccgaggccggaccaaaactgcagagacatgggtggagcctgctgccctccgccaggctgggtgttctttagggagctctcgccttgtaaagttcatctacaccgtgtaacttaccattctttttcactaaagctaatagtcatttgtagtggaattatccttgctcggttttttgtgaccagaagctgatccccaacctctttacgtgcacctgattgcttccgttagcgattacgatagattatcatactcaagagtcacacgttgctaaagtacctgcttgtagagagacgcatgtttcttgctgactctgagtgttaagcacgagggatagttcagtctcttgtagatttaattggcccatctgttccagttagtatttggaccaccaactgcaaactgaatttcttcggtgttttgtcttccatgataaatagcagcaaaaatcttatagtaaaagtatcatctctttatttaagggaaactatcactggcagtacggtgaattccttgagtttacttgtatcctatataagctttaaagagcctgaacagcagcactggctgtcttctggtttaaaggaatacgttgaatctacatggactatatagttttaacttttgtgttcctggaaacaacaaaatggaatgttgtggaggagtttcctcaccgaagggtcacccctagactacagactaaaatatgttgtgaggagtaaaccttgatttttatttatttatttatttacttacttaggaaaagaagcctccaacaatgttgggtaatgtcaaacgccagctattgtttgcccttcactgtgcacctaaccaagggtaccctacgataactttctcaggattctggaattcatctgctttccaaactgactgataaatctatacatgaatttttaaatgtgtttaaacacacagcacaacacacactatatataaactttttctaaaagaaaaacctaccaatctatttctttatccatttattaagctaacaaaaaagccatcagttgctactgactactgttcagctgttcataatctgaacagaattttaaagttatttttgctagacacagtggatcacgcctgtaatcccagcactttgggaggccaagatgggaggataccttaagggcagaagttagagatcagccttggcaacatggcaagacctcatctctacaacaaatacaaaaatcatccagatgtggtggcttgcatctgtggtctcagctaccaggaggctaaggcgggagaattgcttgagccccccggagtccaaggctgcagcgagcaatgatcgagccagtgcactccagcctgggtagcaacaagattcccatctctttaaaaaaaaaaaaaaaaagcaagaaaagaaaaaaaaaaagctgtaagctgttcttcaattcctaagatttaattttgtggagttctatcggggtcacaaatgagatttcagtgttggaacacattttttgctatacattgtgttcatatattacattcttattttaaaaagtatttccttaagtttgaatattgatctaaataaaatttatgaatatttagtttctgctaatttcatatatgtgtataaacacatttcttaatctatataacagggatgactagaacttgctatctacttggtagaggatgttgggggaagtagttgtcaattttaaagcccaatgcaaaagaaaagtgttactactaatgtataggtactgtttatacaacattgtgattattttgtatcttttgtttcagagtacagtacaaaatgatctacaactattgagtggaccaactgaaatcatttgtcaatcctctttgcaaatgaacttgtgcaatgtattaaaacatttttaaaggttcaacatttataattagcttattccagtctttgatattagtgttatgtcagttaatttctcaactttaaattccttaagaagagactacgtattacattttctttctgcagtctctgtaattcttaaccatcatggtgccaaacacaggaatggagcttgctatggactgaatatttttgtcctccccagattcttttttgaaaccccaaggtgatggtatttggaggtaattcgtcttaagggtagagctcttgaattgggtaagtgccctcataggaagaaacaaggctgggcatggtggtttacacctgtaaatccctgtgctttgggaagctgagtggggaggatcacatgaacctaggagtttgaggttgtagtgagctatgatcatgccactgcactccagcctgggtgacagagatcctgtctcttggaaaagacaaaagcaagatgacctttttctgccctacacaaagaaactgaaaaggaaacagccatctgcaaaccagagaaaaggccctcaacagaaaccataaaggctggcatgttgacgttagacattgtagctctcagaactgtgagaaacacattctgttaatctcctcagtcaacagtatttttgttgtagtagcctgaattaagtgctgaaaatttgaatatggggtgtaattatcatgtaatcatttagtcttctcttttcccaaatatgccttctgaaatgtttgtcaaactaaatgactgtagcttactagggtatatataaaacaacaacaaaacacctttaagaaataaactatttccatgagcaattgttagtgatcccttagaatcagattaagatttcagtttttctttcttacttaaggcactacttctcaaaaccaaagctacctaatttagaattggcttttttctctttattgaaagacatccccttgccatctttcttattattggttttcaagcattgaaaatgcaaagttggcttttgtttttcagaagtgtgaatccatttaaaagcagaagtataatatgcaacctcctacaccacagatattaggtttgtactttgttacgttacaaaggtattctgtcaaagccacagtagcacattttcttttacacttatccaaaattcaagtgatatttttgcaatcaaggtgtgcaacacattaagacttattaaagcactgataatgctcccatcttaaattccagtcacctgagttaatcaaatgctgtgacttaagcaagcatttatcaatagtatatgtatttccaaagacattaaggaacattcggaatttagtgtcaaggacagcaaacattaaaagtgtaagatatctgcatagattcatttacgtaagtaaaatatactgagaatggaatactgaatttctgcttatagtgattaaaagcagtgacttggttgttctttgctattttaatcattttgaaataatcctgattttaaaatctgttattaaaacaatgttttggtacactttaaatgttctgtaatgccagatctgtgggaataagtgttgtgaaaaacatcaacatgaaaatagatttaataaactagaggatctgaagagattttataactttgagttttcctgtttagtctaacactgtactgttttaaaaataagtaatatagggtacaaaatttttacaaaatgtgtatttaggttatttgagtcaaaacacggatggactattatttttgtgaagaacaagacaggattagttaataagctatttaccttttccaaaggagaaaaatgactatacgtagtcatttacaaaaaaattaattttcatgtatcaataaaaatgacttgacttttcagtaatgggaaataggaggggaaatttcttctttataaacagtgaagtcagtgtttgtaaatatgttgattatgttgaaatgtatgttgaaaaggcatgaaatgtggaattttgttgggaatggatggtataaactgattatacaataattgagatattaactacttggggatttaaggtgtgaactaacccaagtgtaatgtccaagagttaaatcatttcttaaaacaatgatgtagtctgcatatacacataccacatattttcaaaattaaaaaataaaagaccttcatggtctcaaaaagttatgggtttttttattgttcaaataaaagtgcactgcattacatctgaaatataaaaaatgtattttaaaaatgttcctagtacagacttctaaaaccatggtattgtactaaacaagcctgatccccaagactaaatacggagcatttcaatctatatcccctggccccacaggtttgaagtcaagaaaatataggagttttccccctcctttttaaataaaatacctcacctaagaaattcagtattgtgaaacaacacaactcatgtgttgtaataaatattggatagcatctgttctccagcaggattaccttaaatagaaaataaccctagttaacacaggaaagaattaagaaaaaaaattttatgtatagaatagtggcaagtcatatataaaatacttcgttaaataacattattacatcccttttttagtaaagtgctataattttatttcatagctatatttatttgtaggctgtcttttagctctccctttaaatttgggcatattaaacataggtggaaaaacaaatttatatattttaagaccacttcttaaactaaaagatatgagtgtactgtttacaaatttctggatatgtttgagaagtcatctttttactctttactcaggctttactctttactcagatggaagaaatcatttgatttacttgacaaccaaggaaccatgttaatatcatcaactctaggtgatttatatgaattttagttagtttttatgttttaccagtgtgaaattttatgtctaattaaaaaaaaagaagacaaattgatatatacattactcgatttttatgcttactttcttttacatttcaaccatataattaatttttccatgagacagggtaggacacataatcttcttggatacattactgtttattgtttcaagtggatggaatatataaatcccactgagtagtttagtgtggccttgtatcttttataaacaggttaaatggagactttacactgtaatctgtgtatttatctgtctaccataaattgtcttcgtgacaaatgcagaatttcttttattacttggctcaaattaactgttgatccttttcactgataatatacaagggtaaaaaagcaggaagcctttaaaattgaaaaaagaaataagatattttccactaaattactgaaaattgaaatttttatgttgactgttgatgactgaaaagccaatgttaagaatcaatatcatccaatataaaatagtacattgaattatttaataaacagaatattaagagcttgtatatgctgactgggaacagtggtggctttttaaattctcagaaagtttaaacattttataattagaagaaaccactggtgatgatgaagatggtccatctctgtagcagccattacagtgaaaatcttgacagaaccttttcactatcagaaagataattttactggtattagtggtaaaggtaaggagagaaaaaggagtgaggagataagtctgtattagttttaaaagtgagaaaaggtaataaaacaacatggaaaagccagaaatttcttcttctatatgtgccttgctacaaataaaccaaaaagaaagcaagatgggtattttaaaagccaatgtggggaaacatccaatgataatgcccattattttactttatacttaaattacaccagtagaaaagttatgcttattaatagtttaatgtatgaaggaaacatccagatttctgaatatgaaggtacatatctcacattaatttaagtctacataaagtagagcctctatactgacatattgaaatttactttctgcttagccttttctgttatgtaaacaattgtacatttatttgccattctaaaacttcaggatcaagtttacataattttgctaaatttccgtgtttgctcagaagcagtttacagtactaaaaccaaccagccaaagaacagcttcaacagaaagttatgtccaaaggggaagagggaaagaaaaaaagaaaaatgataagaaaaatgctaactaaggtaaaacggatgatgatggggaatgggcagtcacaaatgttcacagaaaataggtcagttagtaagatcttctgcaaaaagcctacacacttcagtcaagcacatcagtagaatgatttgggagcataattttttttttcggccacttgtgatttcctccaaatgaaaaggaatctgcaggctaacaagctgatcctcatcagccaagctggttcatatgcacactgttcatgtgaggtgcccagggtccagtccacacctatgaatatagagcatgcattttacaaaatatatatctagcatatattttattaaaataaaacttttaaaaaactaaggaggtactcttcaatttgcaatatactaggaactaatggaaaaaaatgataaaaaccttttttctattattttcctacctcttatccctcaaacagaatctgatttacaacctttaaaaaaaaaatcattacctgagcatttatagattcacggttgtggaagaaaaataaatcaaagatattaaacatacactaaactaaaatatacaaccatttatgtgaattctcagagttatttatagtacctttaataaataacctttagatggtcttttcacaccactagtaaactttaatgtataaaatcatatgacagtcactttgcaacttaaaatctttcatttattatctgctacccagtagaatatacaatacctttcataattttagccccaaacctgcctttggtaccactgcccacagccctctgctatattgcagctatattagatttcctcaactgcccatattcaccaaactctcttgctatcatgagttacctgaatcctatttgtctttgcatttcttaaacacaaaacaactgtttattcactgaatgatcagcctcaccgtttgagggccattattttccgtggagctggaaaccatctttatcagtgagttccaagaagggtctgcagcatgagggccattaaatatgggtcctccagcaccatcagggataggtgctactggaggaatcattgcattcccatacacagaaaaaggcatacccttaaaaaaggaaaacacacacattaacatccaagtcattgttcatttttcccaatataatcaatagccttaaaattgatatttgaaagttcacctcatcctgggaatgtgtaacttatctaagaaatctaaaaattattacccattatataacttattttaacattagattatacatatgcctactatattcaaaacattttctcagaaaatcctcccttaaataactagtacaaaatcaggactttaccccaactttaggaaagtccatgtagcctgcaggaacatgctgatggaatgtaccagaaggagttacaattcctgtactatctcgctccattgcttgatgttgtgaaaatactcctgggtcagacatcggtctgtggatcataggatttcccatcccagggttacaccagtctactttgtctgagggcaaacaaagaggcaaaacaaaaatagataatatttaaaatcaaaatcaaatattttgtttttctaatattttccacattgaaccgtaaattatttcaatataatgacctacttttatatatttacagcaatatttccatggtttgtaagtagtgacataatagcttaatgaaataatctaaaaacttggtgttataaaacaaaagaaaaaaacctaagtacaacctaaagggactgaaaggaaatattattatgtccttaatatgatgaaaggaagaaaagaacatgcttgcattagatattttctgaaagcagtaataaatacatgtaatgagaaaggtcacatggggacagagctcataaagaagtgattaaatattcacataacaaaaaaaataggaatacagatcttttagaaatgactacgaggctgggcgtggtggctcatgcctgtaatgccagcactttgggaggctgaggtgggtgagtcacttgaagtcaggagtttgataccagcctgatcaacatggtgaaaccctgtctctactaaaaatacaggcggggcacagtggctcacgcctgtaatcccagcactttgggagaccgaggcgggcggatcacaaggtcaggagatcgtgaccatcctggctaacacggtgaaaccccgtctctactaaaaatacaaaaattagccgggcgtggtggcgggcgcctgtagtctcagctacttgggaggatgaggcaggagaatggcatgaacccgggaggcggagcttgcagtgagcagagattgtgccgctgcagtccggcctgggttacagagcgagactccgtctcaaaaaaaaaaaattagctgggcatggtggcgcatgcctgtaatcccagctacttgggaggctgtggcaggagaatcgcttgaaccggggaggtggaggttgcagtgaaccaagatcaccccattgcactccagcctgagcaacaagtgaaactccatctcaaaaaaagaaaaaaaaaaaggaaatgactattaaagttaaatactgtttacattatagttaaatgcattaagttaatttctagagagcaggacagaatatcctaccttgattgccaccaatcccttcaaaggaccagatgccactatgtcctactgatgtagacaaattgctcccaataacagatggagctgacgttccagtttgcctgatacgtgcagaacgttcagtcccaatagggactggaactttcctgtcctgagacacattgctgggcttttctgaccctaacggtactgatgatggggcaggagatggtgcacgaactcccgaggatactgactgtgcagaagaatctagagaagagatattttgaaataaaatacaggtcatctatagaacatgtaattttataaaaccaaatcttaaaaccaggagatgttttaaatatatattctcagaaaaacaaagtgtaaaaataatacttaaaaatgatgcatattaaaatttggctaaagttccatgacttcaaggtagaatatgatgtcaatgctgcaaaatgttcaactacaaaggtaataaaccattaaattaaataatattcaaatgaattaacccttgacattaagtaaaatgtagcaagcaataagacatttaaattaaaaaacaaaccaacaacaacagaatggagatgggtaagaatcactgcctgtagtggcaatctccaaactgtattccctgggaatacttgctctttgtgttatgatgaaaaagagattcagctatctaataaatttggaaaacctagcctaggaaaaagaaatacgtttctttgttatttattcattttttatttattttatttatgtatttttggagacagagtcttgctccattgtccaggctagagtgcagaggctcgatcataactcactgcagcctcaaactcttgggctcaagcgatcctcccaccccaacctcctgaacagctgggactactgggatgagccatcatgtccagtttaaaaaaaaaaagtttcttcaaattagaactgaagtttatagaacattatatatactgataaaataccaataagaggatcattgcctaagtctgttttattttatcttgtgagtacttcacagaacatgcttttggtaatgagaatcttttttacttatgcaaacaaggtggatttcttgatttgagactattcattagtgattcaatctctatacattattgagaaaaaacaaaaataaccaaaattatattttatgtgaaaagcttaaatattggccgggcgcggtggcacacacctgtaatcacagcactttgggaggccaaggcgggcggatcatgggatcaggagttcgaggggccaatatggtgataccctgtctctactaaaaatacaaaaattagccgggcgtggtggcacgcgcctgtagtcccagctactcaggaggctgaggcagacgaatcacttgaacccgggaggcggaggatgcagtgagccgagatcgtgtcactgcactccagcctgggtgacagagcaagatgactccatcccccctccccctcccaaaaaagcttaaatattaaagcacatttaaactaaaatggtataaataataaaggagtctgaagcttaaaaatcaaaactgttacctgcagattcaacagaactgcagttgaattccaaataagcctattatataagataaaagagaaagacctatagcattcctgttgacaataaaagcactccagaaaaaaagctataacctaaaattcaaaaatgaacgaaaagaaaatgatatgaaggaacagcataattcagaattagtaaaacggaaacaatatgacaaaactcaggaaagtgttagaagtaaaagaatattttagctaaagaccaaataaaaccaaattctgcaattatacatgcagtagaaaacagacaaaaactacaaggaatacacagacatgtaaatgtaaacacaaagataaataacaaaagcttgttttttaaaaacctacatattgaaaggccacacctaaacctctaggaaaaatcaacccagaacaactaacatcaagacatagtcagggcaggcaggcaggaaggaaagaaggataaacaaatgaatcctgctttcccctaggttcatccctgggagcctaccttaacctctgtgttcactctggtttcccttttatttcctgtatccttctagaaccaaagtagagcaaaataacaacaaccttccacattgttttgttttttatgagacggtctcactatgatgcccacactgaagtacagtgactattcacaggcacaatcacagtgcactgcagcctcaaactcctggcctcaagccatcctcccacctcagcctcctacacattctattttaataaacagaattactaggcttgcccgctgagctgcgccatttaagaagtttactctctgcacagattctgccacccctctagtcatagtttttatcagatgaccctgttttctgctccctctctgcacaactattggattaaggataggcacccatccaagttttattttaggctagtcagtaatctgactgaaatggtctgacttgaacatatgagctgagccaatcacattcctcatcaaagaatggggaattaaagggttaactggtttaattaattatgaagttgaaccactgatgtgcatatacaaggtaagattatgaagaagtttaggtgtaaagagagcagaatgcaagaaactgacaagaaacagaccatgagtgagagaccacaaatcctctaagagagagagagagagagaatagctatccctaagtcctggacggtttggaaaatggttctgcatagccttatataaacatcattttccatgagagtccctggatgggcctatattccttttcatgaaaagaacctaactaaaataattttcacatctctaattattataattacttcaattagaaaaaaagcaaaatttaattcagagccatgttatttaaaaacatcagcttatatattagagaaacaggtttcagaggatggggcagatctaggttttgtggggccttaaacttacaaaattttgggaaccttttttagaagaatgaaaaattacaaataaaaaaatcatgtacagcacttggaagtaccccataaaatgaagtggcctaaggatttaagtttcactgataccacggtaacttcaccacagtttagaaatgataacagagtcctgagttaaaattgaaagagcaatgtgatttacaaattcaaaaagtggggccactgggtgtggtggctcacacctgcaatcccaacactttgggaggcccaggtgggcagatcacttgaggccaggagtttgagatcaggctgggcaacgtggtaaaacctcatctctacaaaaaaaaatttaacaaattagccaagcatggtggtgcacacctgtagtcccagctacttgagaagctgaggcaggaagattgcttgagcccagaaggtggaggttacagtgagccaagattgtgccactacattccagcctgggcaacagagagatacattatctttttatttaaaaaaaaaaaaaaaaaaaggggggccaagcgtggtggctcacatctgtaatctcagcatctctgcattttgggaggctaaagtgggaggatctctggagatcaggagttcaagtccagtctgggcaacatggtaagacctcatcttacaaaaaataaatacataaaaataaaataaaaacattagctgggtgctatggcaagtgcctgtagtcccagctacttgggaggctgaggcaagaggactgcttgagcctaggagtttgattgaggctgcagtaagctatggtcacacactgctgcattccagcctgggtgacagagacagaactcgtgagaagaaaaggagaggagagaggagagaacaaaaagtgcttctacagtaaaattacatgaaaagaaaggagaagaacaaaaagtgctcctacagtaaaattacactgcacatttctcacagtttagttcagtgtttattaaacataccctgaatttaatcaggaagaaatagtaggaaataaaaataaaaggcattctagcaaacaactggcttgtagtcttcataaaatgaatctttctttgaaagttaaagaaagactcagagaacagttctagattatttgagactaaagagatatgggaattaagtgtaacttgcagtcctaattagaatcttggatgagagaaaataataaagttattgagataactgatgaaatgtaaatatgcaccatatattagataataatataaaatgtaaagtttgctgaatttaaacactgcatcatagttgttgaagggaacattcttatatttaggaaactaagttatttaggggcaaaagggcttgacgtctacaactaactgtaaaatagttcaggaataaaataattttacacacacacagaggaatatatgatgaggaaaggaagtaatgcagtttaattggtgaatctgggaaaaatatacaagggatccttgtggtattcttgaaagtttaaaattattaattacaaaatctgagagacataatcaaatgcaatatgtgagccttgagtggtagttcctggttcaagaaagaaacatctataaaaaacgttttggaataattgaagatatctgaatatggactgattaattcttactgaattcatgttaacctattaggtatttgacaatggtatcatggttgcataagaaaatatccttattcttaagtgatgcatgtttttaggtctgaagtgtcatatctgcaccttatttacaaatggttcagcaaaacagtagagagagaaaataaatataacaaaataattgggaaatttaggcgaaggaaatatggatattccttgaactattctttaacttttctatgggtctgaaattttttgtaacaaaatagttactggaatgtggcaacaataaaagcaattgtaatgccctcaatgatactctgtatttacaatatagcactatattcaaaagcatgtattaaaaaacctaacctgggtggtgtggtggtacacgcctgtaattccagcactttgggagctgtgcaaggataattaatattctatatgactgccactatttgacaaacacaagaaaaactatgaatatataaattcattgcaggctacaatttacctcatgctttaactggcaatgtactctgacatgtatctctaaaataattataactctttactctttcattaagttaattaggttaactgttatttattccagtattgctagttagaagaaatttgatagttaaaaaaaaaaacaaaacaaaaaaaaaaaaaccgaagtcttactataacttccttaagggataagcaatttcacatctttacctggaaaacaaacatatccaaccttactacagaattctcttagttgagttgaattctctattgctgactgatcttcattagtttgaaaatctaggcctggtggctcacacctgtaatcccagcagtttgggaagccgaggtgggcagatcatgagatcaggagtttgagaccagcctggccaatgtagtgaaactgtctctactaaaaatacaaaaattagccaggtgtggtagcacatgcctgtagtcccatttattcaggaggctgaggtgggagaatcgcttgagccattgcactacagcctgggtgacagagtgagactccatttcaaataaaaaaaagaaagaaagaaaatctaatcactgcttcaaaagtctgcctgtagttaaaaaacacatgtgataatgtgaaatctgttgtgttgttaatgcagatgagatttttttttttttttgagatgaagtcttgctctgttgcccaggctggagtgcagtggtgtgatctcggctcactgcaacctccgcctcctgggttcaagcaattctcctgcctcagcctcccaagtagctgggatcacaggtgcacaccacaacgcctggctaatttttgtatttttagtagaggcagggttttgccatgttggccgagctggtcttgaactcctgacctcaggtgatccacccgccttggcctaccaaagtgctaggattacaggtgtatgccactgtgcccagcctagatgagatttaaaggtggactaaaaggatgtaattttcactcaagggtagaaatctttctccttggtacctgtattctcaaaactaaaagtaaacataaattaataacaggtacaaggattaatttttttcccccaaaaaatgatccctcaggacaggtgtggtggctcacacctgtaatcccagctctttggaaggcaggaagactgcttcagcccaggagtttgacgaaaccagcgagggcaacacagtgagagcctgtctctaataaaaataaaaaataataaaaatccctcttagaaaaacttcaatattttaggtttgatagaacctaggttgattctaatcatttaaatacctagaaatttttttgaaattccagacttctaagagtacaaattacctttttatggtattaaaattatgatgaggtttgaaacctgctgtttttaagaaaacatatgcagattcttatggaattacggtgtataaaactcaccatttgatgctgatgaacacggagtcaacaaactaagcggggaaaaatgttgtctgttaaagttagcagctgcgggtgctcctccaaggggtgccccaggtccgtacatctgacctcctgaaatgtttgaagcaaagtttcccaaatgtgttgaagaaggtgttacagaaccatatggcgagtccatattgacaatacctataatgtagaaggtcatcataatttataatagttactcctgcaagaaatagagataccttaaaattctaaaaggccctaaatatattcaaaactattttagataattaaaaaaatcccggctgggagtggtggcccacatctgtaatcccagcactttgggaggccaaggtgggaggactgcttatggccaggcattcaagactggtctgggcaacacatcgagaccccacctcaaaaaaaaaaaaaaaaagttcctggctgggtgtggtggttcatgcctataatcccaggcatgaatctcactttggggggccaaagtgagaggactgcttgaacccagagttcaaggccaggatagactgcctctacaaaaaattaaaaaaaaaaaaaaattagccaagtttggtggtgcgtgtttgtagttccagttacttgggaggctgaggtgggaggattgcttgagcccaggaggttaaggctgcaatgagctgtgatggcaccactgcatgccagcctgagtgacagagtgagaccctgtctcacacacacaaaaaactaaactatgtagataattataaaagaaacaattatcacattatactcttaaattcaaattataatttactgggaacaaatttaattcttgattttagtactttcagcactagtgggcattaatgttttagttaaaaaggatcattagttttcctttacatgggctttctgtcaaagtggacttttgttgcctttattgatcataaaattaatgcaaacttatttaaaaaatccaaaaccaaaaaccatatataaaacagaaagtgaaacttccagatgttcctatttcaaaaacgaatgtatgtgtatttgtgagagagaaaaagaagaggaagaataaacgtttacctttagggatttttagataacatttttttttaaatgtttatttttagggataaagataaaacatttactcttcctcttctttttctctcttacaggtacacatttgtttttgaaatatgttcattaaaaaagtattacaaatgtttacacactaaactattacacaagtaacctatctgattttagtctaacgggttaaaaatacagaaaaaaaagaaagaaaataattgtcaacgatttttttttttaatttaggagacagctttctctgttgctcagggtggaatgcagtggcatgtgatcatagctcacggtagccacaaactcttgggctcaagcaaccctcttgcctcagcctcctgagtatctggggctacaggtgttcaccattacacctagctatatttttgttttaccttttattagcttttatagaacacatgtcaatattggattttatgcttgaacctgggaggcggaggttgcagtgagcctagattgtgccactgcactccagcctgggcgtccgagtgagactccatctcaaaaaaaaaaaaaaaaaaaaaaatatatatatatatatatatatatatatatatatctgtaggattttaaataggtttaaggaccaaagagttgtataaaactacagggcaaaaaagggctgtagatacaattctacaatgaagagatctgataattacatactaaccacacggccatgctttccacagccaatactggaacaatttatcattttttctttttttttaaggagacaggagattgctctgttgctcatagctcaccccagcctccatctactgggctcaagtgatcctcctgcctcagcctcccaagtaggtgggattacaggtacatgccaccacacccagcttttttatttatttttgtagaggcaaggtctcacaatgttgcccaggcaggtcttaaatttctggcctcaaatgagcctcttgtctcagtctcccaaagtgttgggattacaagtgtgagccaccacatccagccaatctgtcattgataaaatgcagtgtgaggttcaaaacatcacctatatgatgctccttcctgaaatatttgatctgaatctaatcatggattgacataatcactgaattaaacttgcccacagagtcaatgtcaagaattacagaggaaggcagtagaatactttagacagagggagaccaaagacacataacaaccaaaagtaatgtgtgaatcttgattgagtcttggatcaaatggcaaggaaaagagacacacatagtcagaaagaatatatttgggaaaatggcattttatgttgggtgttattatcaaattcatcctcattttattgggtgcagtaatagtggcatagctgtgaaggcaaacattgtgaagatccatatcaaagtatttaggggtaaagtatcatgtttgaaagttatcttctcatgatttgacaaaagatggggaagaaaagaaaatagagataggatagaaagggggaaaaggaggaaagaaggatgaagaaggggagagacaggtaagacaagacaagagagggggaagaaaaggaagcagcaaaagagaggaaaaaaaaggagggaagaaggaaaaggggagagaggaagggaggggagtgagggagagagtttgaaaagatgttaacaagcagagaatatattaataaatgtggaaataccaagtatttactatgctgcttattctgtccttagatctttatgtgacttaaataacttttcaaaatacaaactataaaaacagatctgagtctaaaatacaaataatcaaattatttacataagaaaagttaaacaaaggaagaaaaatatggaacacaaaatgaattaggaagaagtagagagaagtgaaaattaggatctgagagaggtttaggagaaaataaaaggacatacttcctatgtaataaaaggagtatctttaactcaaaatgacctgaattaggtaattgacttgtaagttaaacttcaatgctaattttggctctcatcaactatacactccctaaaaacctcacctttcttacagaggtctttcttctataccttttcaaaaaataggaatttatttttttgttctctaaagcttaattttagcctttctgaatcccacacctagattatcacatttttggaaaggtaaagtattaaattccaactactataaaaatcaaacttaaagcatttcctacgcactggcacataatgatctaaaatctaattatattgattctattgttttaatataaaataaattatttttcatagtacacataaatatttcagttgacttttagcaaagaatatttactgaccaccttcattaaattttatttacatgttacagaaataggtaaaaataacattgagttcccattaaacttggaaatttttgtcccggaatgtcatatttccaataacacagataacgagttggcaaccaagagccaaataccaaatattttaggctttgcaggtcacatggtctctgtcccagctactcaattctgtcattgtagcataaaagtagccttatacaatatgcaaatgaatgggcattgctgtgtttcagtaaagctttctctacaaacactgaaattaaaatttcatattttgtgttgcatgtttattctttttaaatttttttttttttttttgagacagggtctccacccaggctggaatgcagaggtgtgatctcagctcactgtaacatctgcctctagggctcaagtcatccttccacctcagccccccaagtagctgggactacaggtatgcaccaccatgcccagctaatttttatatttttgtagagatggggtctccccttaagcccaggctggtctggaactcctgggcttaagcaatcgacccacctcagcctcccaaagtgctgggattacgggcacaagccaccgtgccaagcctattcttaaaaaaaaaaatttttttttaaacatttaagaaatgtaaaaacaggcagcaggccaaatttggcccatagaccatagtgtgtccatctcttacgtggactatctttaattacttgaaatgcttatattaaaacccaacagctttaaatggaaactggcatcctggattagatcctacaatagaaaaaggatattacttgaaaaacttgtgaaatctgcctaaaatctgtagtctagttagtagtactacaccaatattaatttttttagtttcgaaatgtatcatggttatgtaagatggtcacatgaagggaagctgaggaattatagaattcttctataaatctaaaaatattttaaagtaaaaagttttttttaaaaaagcaatagcttacaatcaggagatctttgtatcttctacatatatcagtgttgcccagtagaattttggataatagaaatgttctagatctttgctgtccaatatggtagctaccagccacaagtgttttttaagcacttaaatatgggtagcctaagaagctaatttttttatttttaaaattttcattaatttaaatttaaaaagtacacatggttattggctaccatatcagactgtgtagctctatttttaaaattattttagaaataaaaaagataatgcgaaatgaaacccaattttttaaatctgttattttgtatttgtaataaatgtaaacttttggtgacagtaccttattaaattaaaacatgaaagacttctgagagagaaaaacacgcctaggccaggaactgtggctcacgcctgtaatcctagcactttgggaggccaaggtgggtgaatcacctgaggttgagagttcgagaccagcttggtcaacatggtgaaaccccatctctactaaaaatacaaaaatcagccaggcatggtggtgcacgtctgtaatcccagctactcgggaggctgaggcaggagaatcacttgaatctgggaggcagaggttgcggtgagctgagatcatgccactgcactccagcctgggtgacagagcgagactctgtctcaaaaagcaaacaaacaaaaaaaccccgcctgatcagaagacttatttatggaaaattaaataaaaatctatggtagcttttaaaaagatttttaaaaataacaccatactaaacacaaacaacagcatctgagttaactaaatccaacaatctttgtctatatcgtccagagaataaaaatattagaaaatgaccaagaattttcacatcacttgtgcaaatgaacagctgcagaatctcagaaaatataaactcacctgagggacttggagcaggtctctgtaatggtggtctaaaacctggagctttggaagtatcagactgatgtaaaggatctgaatttggcaaatatgaggattttcctgatagcatagattctggtgttgactgagatgaaacaacagatcctccccagaaggcatgagcagaagtagggctgttttcaaacaatgtgctaaagggcccaaatggtaagggggcactgaaattgggagcaataggcttatttgctggatgtactgaattctgacaagcactttgtgtacttaaggtcgaaggtagctggacagaagagggaacactgtgaggtcttttaatgtgattgacactgaggactgcaacagatgaattttgcactgaagctgaattcttgtgaggggcagttgtgccatgagggggtggtctaatagcaggggtttccattttaggagtaggctgggggcatcccattggtgtctgaggcatagggtaagtcactggggcagtagaaggcaccgccactggagcagaacttgttgctaaaggaggaacagtcattctaacttccgggggaggaacctgagactgctgaagaggtggtcttggttcctgagaaacagatcccggaggttgttgctgattagaatgagctgatgaactcccagaagaactgctgctgtttggaggtctagtgtttgttgtttctactactggtggactacctgcttcctgttcggaggaagatgccactttatttggagatgctgatccacaatccaaagggctgtttctagaaacccctcctggctgggctggtggtgatggggaagatggggatgatactggatagtgttctttggcagtaggcataggatatgtggcatttgtgggtgcagtgttgttgttgcttgccgtggttgtgactgttgttgtggtggcattggatgtcttcacaactgtgacaaaaagctgccttcggacagaaggtgaacttggactgccatttgtagatgtaccaggcaccgttgaagctgatgaactggttgtagttgttgggcttgaagttaaagaacctgctgaattcacctgagaaccactgctattctgattgctatggcgaggcaccatgtgaggcttaggcgagttagtagctctggcagggctcaaaggcctgacaggaaacggaccccaagtggattgagctggtggaaaagtacctccaaagtgggtcatgggcaaccttggtggacggatctgctggaaagtctgagcagcaagcaaagcatgtgcaaactgtggaggaggatatgctaatggaagagaaactggaaaaccaggcctcacattattcactgggttcttaatggttttgtgagtggatgcagaagaaattgcaggcacagtgagtgctgtggcagtttgagatgttgatgacagagctacagttgtcattttaattcccattaaggaagtgttagcagcagtggtggtaggtgctgatgaccctattttggaatttgctgaggagcttttcaaacgattctttggaataagttcatcaatttctttgtctggatccttgatcaaagcattaatcaattgagttgcttgtcttgttgattcagtgccacccctataaattgagaaaaaaaaattaggtagaattttccctacttttgagtatgtaaagtgtttttaatatgtatttatgtacacaaacacacacacagttttgtgtgtatatacatacacacatacaaacaaaggacagataacaaaagctgggcagcaattttcttaccattcctgaggtattctacaaacaaagcaataaactgtcctgaattactacttttatttttcagaagaatagtaaatgacttatttttcaaaaatacatttcactattgtttccttagactaagaaaccattttcctactgtaaaatacactacagttagaaaaaccactgcacataaaagcctatgtaatccacaatgttattgaaacatttaatcctaaaaatattgaaacagttaatcaacactaaaaataatagaagtaaacaaggaaaataatacaactgagtaagaaaacagtattttattttaaatcttggtatctgggatgactccgtctactaaaaattcattagtagtttgtctattaataggataattattgtaactcctctgggaagatgtcttaaaatgatgcaggaatcctgatagtgccaaaaatagccatataaaaccttagtgctggatcttcaggaaaatatttgatatttatggaaactcaagggagcaattaccaataaagggtatctggttccctcttttctagataagataggctgtgactacccaaatacccaggggaaaaccagtcagaaggagaggacgatgaataaaatagagatggctacttgctttcttatttttgaggtatgatgtaactattagctctcctatataatgcaaaggggcatctgcctcatacaaacttatatctgccatgtaaaaaatataaaactctttttcaaaggaacatgaatttactttaaagtaattaaatatagcttcctacattcttatgatttcttagaacatcacttttattttaagaatattcaggcatagacatattcgacgagttattcaagataagttatatcttcacttcagattcaaatctgaactcaaattcttttttttttttttttttttgagggagtttcactcttgttgcccaggctggagtccaatggctcgatctcggctcaccgcaacctctgcctcccaggttcaagcaattctcctgcctcagcctcccgagtagctgagattacaagcatgcaccactatgcccggctaattttgtatttttagtagagacggggtttccccatgttgaggctggtctcgaactcctgacctcaggtgatccgcccgcctcagcctcccaaagtgctgggattacaggcgtgagccaccgtgcccagcccaagaactcaaattctaaagacacaatctcagaataacaaatctcaaaggttatttgagaaagacaaaaacccactgcttaaaatgttagaaatgcgctccctaaaagtctcagaacaaatttttaagaatgtcatataaacagtttatgtacagaaattatttatttaaacctttgctacacatgcatacaaattcctataaaagtctctgaaacacttcacaaaagtgtattacctaggaaaaaagaaaactataaaatttatcttctcaaacactaataaaattcccattttaaaaagtatactatgtaacacaaagttccactgaaaactcatatggctgtatttcattaagctatagtgcaataaaataaaggaagaaaatgtaagagacaaagttttgccttatagtgattatccggtctccagtcttgtctttctgtttatcaatatctatgtgtgcaccagtaaactcccgaatagcattgatattacagcctcctcttccaatcactctggatatcacagttgatggaacagatactttctttgacctgtttaaaagttgtatatataaattaagattagtcattaacaatagttattgtaatttttaaaagaggaaagagtattactaaaatgtctttctataaatacagaatattgttgaataagcctcttctatttactcttactctagatgaacagagaaaaggcaatcaggagcaacagacagataagctttattatagcttctcatctcactatcaaagattgtttgctttgttgattatcattcttcacttgtatcggtaaagcacatactatgtagacacgtgctgtgctaatgcaaatactaacggtaaataagacagacatgggtttctgcccacatatattgactatctacacgctaattatgaaaacaccaccatgtcatgagtgttgcaatagtatgtgtgtacacacacacaaatgtattatatatacatatatgtatatatagacatatatatgtatatacgtataatatatacatgtatatatgtgtatatatatatattatatgtgtgtgtgtatatatactggttgggcatctaatctagcctcaagagtcaagaaagacttcttgtgggccccttttggtgctttactcatatgcttctttttattctctaatatacataactcaaagagtgatgttaaaaattcatgactgggagtggtggctcatgcctgtaatcccagcactttgggaggccaaggcaggcagatcactttatgtcaggagttcgagaccagcctggccaacatagtgaaatcctgtctctactgaaaaaaatacaaaaattagccaggcatggtggtgtgcacctgtaatcccagctactcaggaggctgaggcaggagaatcacttgaatccgggagatggaggttgctgtggactgagattgcaccactgcactccagcctgggtgacagagtgaaactccttctcaggaaaaaagaaaaaatattcattacttccctgtattcttatagtagcattaaaatgaccatccacaaatatgaaaactttctaaaaatctttaataatgtccggaaaaagaaaatcctactagaatttaaaaagcaaaatctgaggccgggcacggtggctcacgcctgtaatcccagcactttgggaagccaaggtgggtggtccacctgaggtcaggagttcaagaccagcctggccaacatggtgaaatctcatctctactaaaaatacaaaaaattacccgggcatggtggcatgcacctgtaatcccagctactcgggaggcagaggcaggagaatcacttcaacctgggaggcagaggttgcagcaagccgagatcacgccattgcattctagcctgggcaacaagagtaaaactccatctcaaaaaaaaaaaaaaaaaagcaatatccatctaatacttgcaaaattacattttaattttaaacattcagatatagattatagatttcctttattattattttttttttgacagagtctcgttctgtacccaggctggaatgcagtggtgtgatcatagctcactgcagcctcaaactcctgggcataagcaatcctcccacctttcccaagtagctgagattacaagcacaaaccacatgcccagctaattttttaattttgtttttagcagagatggggtcttgctatgttgcccaggctggtcttgaactcatagtctcaagtgatcctcttgtcttggcctcccaaaatgctgggattatagacatgagccacaggtgtcaggcccgaattcctgataagctgattaaacaatatttctaaaagaaatacagtataaagttctcaataaagagaagcagtcaagtatagttcaataaacaagcaaattatttattgagaatggttaagtattaaaaattgtcatattttctaaaaggaagggcatgatccctgttctctatatatacaactaagttacctaacaactctttttaacctaaagagcatgataatcagccagtgatcatcatttccaaactgtataacacagtattaaatgcatatacaaaaaccaaattatcttattagtgtatagagaatattctgatgatgtgatttcaattaatccaatagagtgtgtatgtgaaggagtgaaagaaagaatgtgtgtatagtgtgtgaaaatagagacagaaataaacataggtatgacggggacaagatttggtctaaaatacggaggaaataagccaaaaacctgtatactgcacttagggattaacagtagttactaagtttggttcactatagcttttgtttcagataaccaaaagtttaaatttttacgaaatttccggaaagttctttaaaataagttatcaaagagtgacaatggatcacattctttctggatttcaggtgtcttacctccttttacgtttctgagatattgtatttttactcttggatacatattatttttaaaatcccatgcaaaacaaaatatttttatcctgaaacccttaaaataaagttatcttatgatttaaagacaacagttactatgattagatcaacagtttaacatcaatacctactaattcatcaaatgtttacaagtagcttttataatacttctttgtattatataaggctttgagataacgaagctgagaaagacacaatctaaaatagttctcaaagcaaactccaatacttttgaggggccaaattaacacgtaatttttttcatctaaaatatggcacaggctctctctgttggtcaaatttagccttgaaccatcagtttgtttgcaacctttagaagagtaggaggaatttaattataaggtagataacacttgactgtgatatatagcacataaaaagaatgacaaaaacaattactcaccttcttacaacttctttccatccttcttccctcttttgcccacgcttaggacttgctactgttaacttcccatttggagaagaaaggggagatggaccagattttgtacaagtagatagagaattactggtcccttcactgatagtttctgacaatctttaacaaagagagggaaagtacattaaatatggaacagatgtagaatttttaaatgataaaggtagtctactacccaatttttaaaaatttatttttaaataacaaatgacgaccttatttttcacttctcctcatatttagcatataatatagagagcctttttttttttttctttttgagacaggtcttgctctgttacccaggctggagcgcaacagtgcaatcacagctcactgcagccttgagctctcgggttcaggtgatccttctgcctcagcctcctgagtagctgggaccacaggtgcatgccatcacattggctaattaaaaaaaaaaattatttgtagagacagggtctccctatgttgtccaggctggtgttgaactcctgggcccaaacaatcctcccactttggcctcccaaagagctattattataagcatgagccattgcacccagcctgaagagccaactttaagaagatactatctagggtacacatttagcagagtttaatcacagtaataatcccttggaaaccacaatccatatttttcatgtgctaagtttaacaaccaaaaaaaaaagaaattacatagtaaaaataatttgatgtctcattatataaaatctaaacaaaagcttattcttcaattcaattgaaacagtaccttctttagcacaaagaaaaatcctattttgcaagttgcaaatttactttctttaccaacaaattcagtaataaggtatttcatgatgacactataaatattgaaaataaaaattggaactaactttattgaagccttgccagaaacagattttctctcttcctttggaaatgtaacaagaactgatggctgctttttgctgctcacagtggtagtgaccacagctggtgaatgattgtcactcttacgactgctgttgctgttactactttcatcgctgcagctggaaatcctcatgttatcactgtccccactctcgctggtactgctgctcttggactctccattcaccttctctggctgactgtatgaaattggtagtggatcatcaaatataatttgaacgttttctggagtaattttatttttcctgtttttcctctttgaactggttgtagttatggtattatttcttttaccatgagaacctgccaaagttgtccaggttgcagatatacctatggtagtagtggttgtggcacttggaggttctgtcaagacttcaggctcatctgtaaaagtagcaatactgaattagcaagttctaagtgttcccagaatgtatttagctataagcacttgaagaaaagaaaaacccaggagagatactctactactattagccatgtaagttattctcacattcatcggtaatgagctggataggactgatatactctgtgtacccacgttctgttcaaagaatagcaggtagttataaaaaatattttggggggcatttctggtgctggcgtggctccaggaaggccattccagccatcaatcttccacctgctccttagagaagggaagatgagtgagtcgagcttgaagtccagccagcccttggcctccaagcaggaaatggacagcactgagaagcggggccggggcaggccccgcaagcagcctctggtgagttccgggacagcactggtagggagtcagaaggagcccagtgaagtgccaacacctaagagaccttggggccaaccaaagggaagcaaaaacaagggagctgccaagacccggaaaaccaccacaactccaggaaggaaaccaaggggcagacccaaaaaactggagaaggaggaagaggagggcatctggcaggagtcctcagaggaggagcagtgaccgtgtgtgctgcctgtgcctcactgaaggagcagcttccttctgggactggacagcttttgctccgctcccaccgcccccgcccctttcccaggctcaccatcaccactgcctccggctgccacccccatccttccacctgcaccctcaccaccacactacacagcacaccagccactgcaggggccccatgggctgagtgggaagcagttttcccctggcctcagttcccagctccccgcaaccacccacacatacacacgtaccctcctggacaatgctaacatcccacttagccacaccctgcacatgctgcatccccactcccttagtagtagcaacactgctctctggtgatgggggcaccctctctgctcctccactgttccctctggcttcccatagtgtggtctgggaggattcccctggccttaaaaggggcccaagccccatctcatcctggcatgccctactccactgccctagcagcaggtgtggccaatggagggggtgctggcgccaggattcccccagccaaactgtgtttgtcactatgtggggttcacacttttcatcctttcccacctcccctagtccctgcactaggttggacagtcccctttggctacaggaaggcaggaggggtgtgagcctcttacttcctcttcactgtggccccagccccgttgccctccacctgggatctgagtacacattgcggtgatggagatgcagtcatttattgtccaggtgaggcccacaagccctgtggctacctgagatgggctggggccgctcccccatacttactttgcttctgccactcagccatttccccctcctcagaaggggcaccaataacaaggagctcaccctgcctgctcccaaccctcctgctcctccctgccccccaaggttctggttccatttttcctctgttcacaaactacctctggacagtggtggtgttttttgttcagtgttccattcttcgacatccgttattgctgccgctaccagcaccaaatgttcatcctcattgcctcctgttctggccacgatcccctcccctaagatactctttgtggggaagaggggctggcacatggcaggctgggtgaccgaccaccccagtcccaaggaaggtggggccctgcccctaggatgctgcagcagagtgagcaagggggcctgaatcgaccataaagggtgtagggaccaccccctccccctgttctgttggggaggggtagccatgatttgttccagcctggggctctccctctggtttcctatttgcagttacttgaataaaaaaaaaaaacatatatatatatatccttttctcggagaaaaaaaaattggggggacagtttggaaaatataagtatgtactgtatattacgtattattatgtaattattaaatttcttaatgtcgttgcagttatgtaaaataatgtcctctttctgggagatacataatcaagtatctgggggtgatttcacatgatatgtatagcttacctcaaacaactcaaaaaaagagaagacacaacccatgtgtgccaaaatgttttaaaaatgtaggtgacatagaggtatttaccatattaatccttaaaattttctgtagtttgaaaattttcaaaataaaatgctggagaagggaaattaaaaacaaaacaaaacaaaacacacacacacatacacacattgcatgcacatatttttggtggtttcatggcaatggttccttcccacaatacagtcagtcctctttatccatagatttaaccaacactagattgaaagtattcaaaaaacaaaacaaaaaacaaatacgaatttaaaaaatacagtataacaactatttacatagcatttgcgttaggtattagaggtaatgtagagatgatttaaagtatatgggagaatgtgcataatttttatgcaaatattacaccatgttatataaagacttgagtatctgaattttggtatccgtgagggtcctggaaaccatcccctgtggatataaagggacaggattactatacttccatcccaaataaccttttgattataacctagttaaaaatgattccttcatttgaagaaatcgatgatctggattgtagatgatattatgaaattaccatttataatacctaaaatggtattatgatgatgtaagcaaatgtcattcttgggatgtgggcttaattatttataggtggctggcgcagtggctcatgcctgtaatcccagtactttgggtggctgaggcaggggggatcacttgagatcaggagttagaggctagcctggccaacatggcaaaaccccatctctactaaaaatacaaaaattagggggacatggtggcacgtccctgtagtcccagctacttgggaggctaaggtgggagaatagcttgaacccgggaaacggaggttgcagtgaaccgagagcataatactgcactccagtctgggcaacagaccaagactcggtctcaaaaaaaaaaaaaaaaaggatttataggcgcaatgtcaggatgtctgcaattctgcaatttacttttagatggctcagaaaaaaatatgtacaagtacttaaagagaaaaataaagcaaatatggtaaaattttaacaattttgtcaatctaggtggaatgtattcaggtattcattttatcatctgtcaacttgtctgtagttttgaaacttttcataataaagttagggaggaattcagtcaacaaaaaaaaagcatatatcttttcttttctcttttttttgatagaaggtcttgctctgtcacccaggctggagtgcagtggtgccagatcatggctcatgacagtctcaacctcccaggctgaagtgatcctcccaccttacctccccatccccccaatccccagtagctagctgggactacaggagtatgctactgtgtccagataattaaaaaaaatttttttcctttttttgtatagacagtctcactttgttgcccaggctggtcttgaactcttagactcaagtgactcgctcaccttgacctgccataaaatgctgggattacgggcgtgagccactgtgcctggcctatgttaaggggttaataacttgaaagcatattttcaagagtgactgataatcaagtaaatataattttaactagaatataaaacaaatgggatggttgttaagagaaaataccttcaactttaagcttttctttttcttgagcagcttggagttcaaagttctctttatttttggcttcaatttcttctagtttccttctttgttcttcctttttcttccttctcttctcttttcttttttctcttttcgcagccaaagccagcctccgactttcttcccttaactgttaaagatcaataaagcagaaatataacgttgaaatttaccctggagaagaagttgtcacataatcatttaatcataaggaaaccatgatatcataaaattcaaagtcatctagttcaattcattgttttatcaagatcatattcaaaccactctaaagagacaatatttttacaatatcaagatcaaattaacaatataagactaattttaaaatgggtaaataataaacagatacatagcttttaatcattaaggacatgtaagttgaaccgacaaaataccattttttgatcattaatttggcgaaatttaaaaaggtatcagatatcagcacaagtttgagaaactgaattctctcctgtactgctgcgggcatgaatatttacattttagaaaaagtaatttgaaagcttcctaacaaaaattacaaactgcttatcccaacaacttattatataaaatgtctatctctagtgaaaaaacaagggttcagcaattttctttgcaaattgattataatggcaatacatggaaacaaggtaagtctgtcaatgggaaggaataaattaacagtatatattcacagaatactagataggcaccgtaagtattataaatatgtacttgggaaaatgctcccagtttacatttgttaggagaaaaaaaggcacactgaagactaataatcacttttatgagagaagagaaccctctttgtgcatcgatttgtataaatacagaaaaaaaaaccataaaagttataaataaaagggtaacagagactacctctggagggtggaacaggaggagggatagcagaatgatggtgactttcaattttactttatataactatacagtgtttctatttgttaaaatgagtacattattactttcatagtcaaaaaactaactgtaggtttaaaagtccaaaaatatatcttaataaactattttaactgttaaattttctttcttggctcataaaggtatgaaaatcatcttcaaactctgtctgcatgtcatctaaaagatgttttttaaaaactattctccacccataatctagcattctgaattattttatgtgtattttaaatatgtgtcaaaacaatgtcagttaaggcatggagcctacaacatgtaaaaccagtcctcataaattcataagccaaacaatatttagttttcattcaaaaaagtctgacttcatcttttaagtgctgtgcttttgctagatactctctgtcctgcctttcaaattaaccctctccggttttttttttttttaagccaaatttagcagctgggggttgtataccaactttagtgacactaacgttaataagttctgataacccatgacactcaaaccagctctctgctaggttcttgaaaagtttggcccaccaccaggtttttacaccctgcggtaatgcaacatacttaccttaggctaggtgagagataagtcttgttcctgaaaagggcaacagtgaaggaaaacctgtaggtagaatacccatactttctccagcaaatcgattttaggaaagaatgcatctaaaagctaaagatacagaaactgcctgcatcgtaaccctggaaatttctgctggactcccagaaagctccagtctgaagatcagtagaggagcttttacccctgctgaagtattaggaacaaaacagtaactggtgacctttactccctggatcaccacaagggaggagtaatatctgattggtgagtttgaaagaagaaactgagcatgtgtgactcagctcatttgagccttgcttatgtgttttctccacgtggaccccagtgaaggagggagaagtgtgcttgttctgtctagctttgattttgtggaacaggtaagtaagtataagagggagaggaggagtgaaagcaaaggtgaaacgtgcaccagaaaaacgtattatcaaagcagctatggctacaagtgtgtattaagtctctctacttcaggattaggaataacaaaatcaatattttatctgtatcgtatctgtatagacagaaaaatcctgggaaaggaatgctttgggggagaatcaaaacagcaaatgaagttttagaattttggctcatccatgatgggttgttcattttgctggaattttgtacttacctggtagcaggagctaattatgactgctatttaagcgggaggtgggggggatttgggggtggagaattttttttaaaagaataagagttttaattcagaaagcaggatttcatttaagcccatatgtcctagatgttgatgggggtggtaggtttgggtaggtcatagggtgtggctgggtcttagatatgtaaatttctcagggctggcagagtcagtcaggggtagccctttggcaagagtaatatgagtttggattatcgaacttcagagtttaaccctaagaggtaagtatttgctcgtttctaaattttgaagttttaaagccggcgttttgataatctgatatattttactaaccctctgaattcactgagagtaggtagggcactaattcagaggtcctagggaaaccttctggggggagataccaagttatggctacaaaatgacccaactttacatggcacggagctctaaaagtaagcagaattagcaagtgtggatcaacagatacaggatttaagaggcatcataagtttgcaggcggtagctgaaactaacaaatgaggtaaccagaggaaaaaggtgtaactgtgtgtgtgtgtatacatacacacatacacctactattttactatatataataaaatatatagatattatacatatataaagagagtttatgtatatgtgtgtgtgacagaatatctaaggggtaaaggaagaacaaatgaggcttctgaaaggcataatcagaggaagacaaacaggagaaagcaactccaatgggaaaaggaaggccagatcaacactggtaaacctcacaaaagtggtgggcatcaataagaactgaaaagaggtaaatggatttggcgtgctttgtgaactgaaaagaaacaaaaaataaaatttaaaaaaaagaaggatttgtcagttaagatgccattggttacctccaccacagttagtttattggagaaggaggtcacatggttcagacctaagatttaatttaaaatagttaataagacatagagattattataagcattaaaagaaaggcaaaatactaaatttgagaaaaagttccattaggatagagctaccctgattgtacctctgccttgactgaagctgtaggtagtgggtaggagttagtaaaacagtagaaattgaagataaaggcatagggagaggtgctaataactgatagaaaatcccagacagcatatggaaagagtaactaaaccatgaagattcaaatacgtccagaggcataagaaaataaaactaaaaattcagtctcactttctatattttctctcactttctctcataagcctaaatctcattttacttcttggagaactgctgtcatgtttgttagtgtgtgtgggggaggttagaggctctgagaaaaagggtcaagttagacaggagaatggcgtgaacctgggagacggagcttgcagtgagccgagatcgcgccactgcactccagcctgggcaacagagcaagactccgtctcaaaaaaaataaataaataaaaataacttcactgtggaatgggaaagggcactaacccaactgatgatttctaattgagggctcaggaaacaaagtgacacttgggagttaggctttataagataagaatttaaggacttggggaaagccagtccagactaaacaaatactgcagatttagatatatgaaagtgaatgggatatgtgagaagtagcaaaccatagtgaaagatgagcctggagaaataagagagaagacctgaatgtttagaatttcccatgcaatcaacgaagaggcactgagggtttctgaggagaaagtaaggcatcccacctgtgtattaaaaaaatacgcgggctgggcacggtggctcacgcctgtaatcccagcactttgggaggccaaggtgggcagatcacgatgtcaagagatcaagaccattctggccaatatggtgaaaccccatctctactaaaaatacaaaaattagctgggtgtggtggtgcgcacctgtagtcccagctactcggcaggctgaggcaggagaatcgcttgaacccaggaggcggaggttgcagtgagccgagattgcgccatggccctccagcctggcaatggagtgagactccgtctttaaaaaaaaaaaaaaaaaaaaaaaagcgaaactgtaaaagttacaccggagcagaaaaggaatactgaagacaaaagataagagagagacacagatatgtatacaggtagacttttaagaagccaaatgcaaaattttgggtgagaagtgatcactcagagaggaagtggatggaacagaaggcagacacagagactgccaaagctaaataaaaggtgatggtagtgatgatgataataatcatgatgacagtgctgatacagctaatatatagagggtctaatatgtgccagatactggtctaagttaactcaccaagttaattcatttactggatgtaaagaatgggaggcaaaaataattgagaacctaaaagtagcatcaagatttcatttctcaataaagagtagtaatatcaacagcagaaagagatcaagaagtttcaaaggaaggtaggggaaagatccaacaaaaattttctggtaacttgctatgtgctatgcacggttctagtttcatcagtaaaccggataaaacatccctgtcttcaagtttacatttagttggttaggggagggtggatacagataaatagaatgcatacattatagtttgttaaaaggtgataagtgcaatgtaaaaaaggggaaaagagcagcgagatgaaaaatgtgtgtatggagacaaatggagggttttgatttttaaatagggtaatcagtgtacccctcatgagatgaagttaagtgaacacctgaaggacataaaatatttcagccaaagagaaaagccagtacaaaagctctaagttagaactggacccagtatattcaagtaagctagcgtggctaagaacagtagcaaatgagtttcggggaacagtatcaggaggcttgatcacctaaggccttgcagagcattttaaagactgtcttttactgagagggaaagtcattgtcgggctctgaacagaagtgtgatatgatttgatttagataattgaagaggatcagggtgctacataaactacaagcaatgatggaatcagggagaccagttaaatgactaatgcaggtatgagattaaattaattgtttgaaccatggtgagaagtgattaagattatatatctatattttgagagaaggtctcacactgttgcctaagctggagtacagtagcacaatcacagctcaccgcagtgacctccccaggctcaggtgatcctcccacctccacctcctgagtagctaattttcaggcaaaggtaacgggatttttcaacgcgatggagtatagagagaaattaaggatgatttcaaggtttctggcctgagcaataagagttgtgggtttggggtgggcaaggatcaggagttcatatttggacacatcaagtgtgagatgcctaataaggtattcaaatggacatgttgaatagctagctgaatacacgagactgaagtttagcaaagaagtctgggctagagatacaaatttggaatcaactggtgtacatttaaagttagggggcaggataagaccaccagtggataaagaagaccatgtaacaagtcaaaaggcttttcgctaaaaggtaggggagaagaggaggaaccagcaagaggacacaggaacatccagacaggtaggaggaaaaaaagagcctgtagtggcatgaaagccaagtgaagagagtatatcaaatgttattagttcagtaagataaaagatggagaggagaagtaaccattggatttagctatatgaaagttactggaaaccacaaaagcataattttagtgagttgtgggagttgagagccagcctgtcaggaacagattcaggataatggaagaaaaaatggaggtgactgaaagcggcggttcagggatctttaccgcaaagggaggcagagaaatgggtctgtagctaaaaggttgaggcaagagggttgaagtcaaaaggttttctgtgtttaagattggagaaataagtgtgtatgctgatgagaatgattcaagagagggaaaaaaataggagaaagaaaaggaattgctacggacagtgctgttgagaaggagaaaccatataggatctggtacacaatgaagggactggttaccaaaaatttatctaggctgggcatgatggctcacgcctgttattcccagcactttgggaggccaaggcgggcagattgcctgaggtcaggagttcgagaccagcctggctaacatggtgaaacccagtctctaccaaaaatacaaaaattagtagggcatggtggcccatacctgtaatcccagctacttgggagggtgaagcagaaggatcacttcaacctgtgaggtggaggtcacagtgagctgagatcgcaccactgctctgcagcatgggtgacagagtgaggcgctgtctcaaaaaaaaaaaaaaactttatctagtcactggtaggaagtatatgggtgtagatattggtgggtggatagatagggtaggcaaagtctttggaagttttcttttgatgcttccattttctcattaaaggtaaagaagaggaggtgcaggtattggtgggcagatagatggtgtaggtaaagtctttgcaagttttcttctgatagttcaattttctcaggatgcaaggtcacctactgaaggtgaaagagaggtggtgctggagttcctaggataagggagaaagtaagaaacagtggtctaaatgaatggaagactaaattaaactaaggaaatgcagcattttaactactggtcagcattaaagggctagggaaatctagtaaagctactgtcagcataaaagggttcgttgtcacacatttcaagtaaaattagtcataaagattgttttttctcgacacgtttagttactgaggttcatgtgagaataagaagaaaggagtaagaaacaatgaaagggtagtatgacataaatggttcttaccatttattggtcggtggtgttggcaggattattaaaagtagaattctagagggagtaaagttgaaaagatagaaagcaataatcagagaatgaaatgtgtgaaaccgagaatgggataggttgtgtttgaaaaatatactattacctagctccctaaaagtttaccaaaaaaaaaaaaaaaaaaaaaaaaggtagaggaaaaaaactaaaatgaagtgaagggggtaaaaaaaggtagaggaaaaaaactaaaatgaagtgaagggggtgaaataattatatcaaaaatgtaagtttaaaatatctgctagggattctaacagccaagaacgtaacttagttgttaatgttctgagagcaagcaattaactgttaagaagattccataacttgaccagatggaactacttcagagcagggactcttccacttagtaaatgctcaataaataaatgtttacttaataagtattaaaaaatctgctggccttaacataatggccactgatctctttttcttttgtagagactgggtctcactacattggccaggccggatttgaattcctgggctcagcctcccgagtagctgggactacaagcatgtaccaccatgcccagttttctgcagcagtttttataaaccaaattttccaaattagaaagactgaccaaagaagcacttttatacgaggaataacttacgtatggagaatctcaacttggaccagtcaagaccaactccagcgatgaagccagaatgtaatatatctcaaaaggctaaagaagtccattttcccagatgtaaattataattaaaaaatagtgagccaaactctaatatcccaatgtgataatctttcaaataaaaatatgggctgtagttcaggaaaaaagtggcttctctataattaaaaattttacatatgttccacgttcactcaaaactatacataaaagtatataatgcatgtgcaggaatcaatttagatagaattgattaatgattaagaattcttcattagcttttggttttaatattatggaaaaatatacaacgatatttaaaagaagcttctcttgacttctcttaaaactaaggctcttgaaagtataaacattaaggttaaataacgctggcaagaatacaaggaaatgacattggtgtattgctaatggtactaggaaagtattctgcaagtatctactaaattaaaaatacagtagtgcccccttatccatgatgagtaagtacattccaagatccctggtagatgcctgaaaccttggatagtactggaccctgtatatatatgttttttcaaagaaacccatgataaaatttaatttataaattaggcacaatgaaagataagcaacaatagcaataaaatagaacaattataacaatatgccagtaacactactcttgcactttggggccattattaagtaaaattagggtttcttgaacacaagcactgtgatacctcaacagtcaatctgataactgagggctactaagtggatacaccagacaaaaggaggattcatgtcccaggtgggacagaaaaggacggcgcaaaatttcatcacactactcagaacggcatgcaacatgaaacttatgaattgtttatttctggaattttccatttaatattttcagaccatagggaaagcaaaaccacaaataaagggactactatatgttgacccacatgaaggaacttatttcataaaaataaaaggagcaaaatatttaaaaaatatgtataagggtgtttattacaatattatttgtcgtgacaaaaaactggaaacaaacttattatggactattctgcagttatttaaaatcactatcaaatgacaatatccatcagttactaagagaggggaaagcaagtattagagtaatatgtttgcatgattctgttttttaaaaaaagtacaccatcacaatcagtgtgaacatttattcattcaacaaatatttattgagtgcctactatatgccagacactattttatgttctagtaatagagacaaacaagataattaagtattttgaatgaatacaatatttagaatgttgaaaagtgaaaaataaagcagagaagagcagaaaagtgcttgtgaagaggaaactaaaacatgaggacatctaagggacattcatggaagatgctgctgacagcacaaacaaaaagaggatggtcagtatggatagagcaaggtgactaagagaaagagtaataaaaaacaaggccagagaggtttaagaagtggtgtgggtaggcagatcattacaggatcttaaaaggccttataggtaattgcagaggtaaagattttaaaacaaccattatcacatttctaacttcagttatcttaaaatgatggcagctgttcttgtctttgtttcacagtttaaactgagcacactgttataataaaaaaacaaaaatttaaagaatcaaatatatattctatcacacaaactggctcaattatactgccttgtatttagcaggcattaaataaatgttaggtagtgaatataaaaacaggtcaagtaatagttatagtggtcattatatctcttaatgcactcatattcttttaacatttttaaatggccaaaacagctacttttaatttgctcagaatataaaccacaaatttttaaaaatgaagagcttccaaaataaaatacattttttcagaaaatagtattttcaaatttaaattagaataaagtacttcaaatgattcatattaatgtaggacaaaatgtagaacttaataaagaaagcaagtatagtaaaaaagaatgtagctaacaagtcaaaaaacgcatatgcataattatcactgcatctcctttataaatttaaatagtagatgttaaattttatagcattttgacctttttaaaaaaattttatttattttttgagacggagtctcactctgttgcccaggctggagtgcagtggcgtgatcttggctcactgcaacctccgcctcccaggttcaagtgattctcctgcctcagcctccagagtaaatgggattacaggcatgcaccaccacgtccggctaattttcgtatttttggtagagacggtgttttgccatgttggccaggctggtctcaagctcctgacctcaggtgatgtgcccgcctcggcctcccaaagtgctgggaatacaggcgtgagctactgcgcccagccactgacctttttataaaagatgagatatggcagttccataatattcaatgccaaaccaattattttcctatgattactattcagttaagttctagagtacagaattataggggaaaatgtggcagaaaagggaagtgaagaagctataagactgtccaaactatatgctgttttggtgtattttactccccatgggaatagatgggaatgatgttgtagtctgcctgaaagagaaaagtacaagagaagtcacccatttaaaaagtgtactcatttgacattccaagatttgtatttcactagttggttatgccttggtagtgcatttggtacttgtgataaacctgttggcaataaattacaaggtctaaaacaataaattataagatcaaaaaacaacagatgtggttgaggattaagagatcattagctgagataagactaaaatccagaactagaagctaagttttctgacttccagatcaatgtaattcctataacaaaattttgttagttacaaagaagctttcaatgatgttcaatgtactcataattctctccacgatttgagccaaatgtagaaagaaatcatgtacgtaatttaaagcaaacaaaacaaaacaaaaagacggattacaaatcaaaagaagagaaaacaagatggaaaaaagtgggtagttttcatgtgtaaagattattgttaccttttccaagtctaactcctctaacaaaatgctggcgtttttgtttgcttcagcagcctgtctatctttggcttgtactattgactccatacaaagatgacacttcttcagcatctcctataatgaaaaattaagatttttccaggctcacagaacaattctcacttagagaaattcctaaaaacacgaagatctttagtaaggtactcaaacctaagcaataaagatccatgaaagggggaaaaaaggtgtgcaaataaaaacgtaattgacatggtatatttaggaatatatacaaatgaagaatcaaagagtagcttttgctattcttcaaaataatatccatttagcaggcacttcagaaactaaagtcatttatcctctaatttaaatataagaaattgtacagcaaacagaactacaataatttatgttggctggttaacaggctaaaggaaataatgtcaacaaagaaaacagatgtgaaaatttttcaagaaatgtcctcaaatatttaagctttgttgctccaattttgtgtacaataatcatttacaaaggaatcagatacatgtacttacataattttctcagtgatttcattctcaagtcacactttaggacagtaaaacactacttccttatttttataaaatttttatttatttaattttagagataggggcttgccatgttgcccaggcttaaatgcagtggctattaacaggcataatcatagtatactgtatcctttaactcctaggctcaagcaatcctctcacctcagcctcccaagtacatgagactaatgcgtacctgagactacagctgtgtgccactgaaccagtcttattcttagtattattaaaaataatttatttttaatctccccctctgcccctaaaaacctgtgatatataggaatgttaattgtcatggacaagtctagagctaggaaagacagtgacctagctagtttaaattaaaacttatagggaaaagctgttcactatcatgtaatagcaactgtgtaaacgtcataagaagacatttttaagatttgttgtcctctttggttttcagaggcatgtgttaggatcttattcaagtgttagtgtaaactccaaatcaaaatgtatgtctccaggagaaggtctcaattaggatctctaataggattcagttttatcttccataaaatttcctgcaaaatttgcatttcctgcaaaattcctagccaattcattctaaaacttagttaaaactaaaagttagttaccctaacttttacatcacgctcaagacttcttgctcatgattaaaagtagtatgttcattttactaggaaataaaaatctattggactcattactttctcaatataggtatcagtctggataaacacacatatacagaggacagccctaatgaataataacatgttgctttgaattacttagtgttcacataaaaattaaattagctcaagaatttttttgttgttattttattttttgagacaagagtcttgctttgatgcccaggctggagtacaatggcacactcttggctcactgcaacctccaccttccgggttcaagcgattttcgtgcctcagccttccaagtagctgggattataggcacatgccaacatgccaggctaatttttgtatttttgtagagatggggtctccccatgttgcccaagctggtcttgaactcctgggctcatgcaatccacctgcctcggcctcccaaactgctgggattacaagggtgagccactgcacctggcctcaagtattatttttaaagataaggtaatcctatagcagaggatgttttattgattcattaggtaagtaaataatctgcaagaatctcttaaatcgcatacttcattcccaaatactagataaatgaaaatggctacatattacactttactactcaaactaggaattcttagaatggaagatatattaaccgaatagagtcccttgctcatatagtgaacaacatattaccttatcagtgatggttgctatgtatctcatacattcagaatctgatggaaactgattgacttctttgactaagtagcgcaccaccttcacatgaccctaaaaaatagatatcaatgtcagattgaaaacagactctaacagttcagtaaatctatgcctgaactaactttaacagttaagattagggccacaaagtaaagactaaattgcatatttacactataaatgaaaaagagacaggctttggttccagtgagttaaatccacattgatcattctcatcctaccctccaaaaaaagtacataataatatgagctaaaattctaaacaactctgaataaaaaaaacaataatcccaaaatcaatacaaagagtaggggatatgtctgaagggtggtggggggtggggattcttatttttttctttgctaactccctaaatatgagagtctagtttcaattctaaggattaaaagggcaaaaataataattttgttttttcattccttcagataaaaaacaaatgtataatactgtcttaggtagtgtgaaagaatatatactttcatgaagaataagctatgattattcactgcaacacaagttagtatctaagttcaaaatctttagacttgccctttcctacttcttaaacgccattcccactttgtctagcccatactgttgctttctgacacaacatctgaagttagccagtcgggataaacagctgttaatctttagtatattttttctattgcctctatctcttccttttagactgcatgtttctaaacttttctctaaatgaatagctcaaatgccacttgcatcattccctaaggatctctctaatacttctacagtgtttaaactatttacatgggacaactcaaacagttacctaactttgggtatggatcttacctttccatattgtaccctatataacatagtatatgttatatatacatatatagacaatatgtatatacatatatagacaatgtatatagacatatatacacaacatatactatgttgcaccctatataatatagtactctagcccacagttgcacatgttaggtactcaagaaataatggaacaaatacataagagtataaaagataagcactgctcaactgaagtcaataagtctatctggaaagatatatgcatgttagatactagagtaataactaataaaaataacaactctaatagttagagtaataacatataaaaatatgtatttctccaaatgaatgataaacactgtcaaacttgtacgacctctagagattagagatctcgatgtgaactcaaataggatgaagagtttggtaggagagacttcaactataactaaagaatgagtaactttggaaaaatgaagaaagacatgggcattctatgagatgagaacaaaggtgatgtgagagataggaacaaggaaaagaccaagcaagaagataattctccacattaaggattctaatgggagataagatctacaagcactaaattgtggtggctgtgaataccaaactaagattggatttcaaatgatttcagaaactggggagacacagaaaggttcttgaagaggttctctaatatagtagagtggttagaaagattaacttgataatgatatgctagcttgcttggagaagaggcagctagccagtgagaaggaataagttggattgctgagaaacaaaaatatagagagtcaaaaatacagagtcactggtagtccagattatctagggaagaggtagaataaagaacagcggtcagagataataagagaaaaaggaagaaatagcttattgtgatttatttattaaaaattttcaacattttggcatctacagggaattttatctacatatctccaaatgacaaaactcaaaattataatccctgtaacagtaatctgatattcccaataacaaactaaagctggatttaagagatcaatggattatcaaacaaaccattaaatcaaattacttacacacagctctgtgctatgtacagaaagagaaagtttgttttactttcacggaatttgtatttttacctttaaatgtaatatacttgaaacttagtagtttaaaatgctggtagtggcattttcattatttaattcattttttttcctagtaaagtcaataattgaaatgaaaacaaattttttttgagacggggtcgtactcttgtcacccgggctggagtgcggtggtgcaatctcagctcactgcaacctttgcctctcaggctcaagccatcctcctatctcagcctcctgagtagctgggactattagcacatgtcaccacgctcggctaatttttataatttttgtagaggcagggcttcgctacatctgcctgccttggcctcccaaagtgctgagattacaggcatgagccaccatgcgtggcacaacccccgcccccagcaaaataaccagtttaagtgatatttttctctgtagtggtaatacaagaaaacactcactaagagtaactaactggaggtacttacttaagtatcttaactggatttacactttgtgaagattaagactgcaactagattttgaacacattacttagaacagctttttaaaagtttacttagctctgatgtccaataaggttaaaattaatggcttttctgaaaaacctgtatatatctacatttaatgttgccataagagtaattatttgcatattattgctttcatcacagctgcaaaagcacaaaatgagtctttagtgatcactaagccatgtacttcctagtgtaagtaaaaaaacatccaggtaaatgaggatgaaagacttatacctttctaaatgctgccataagaggagttatcttgcggttatctgctgcatccacatctgcacctgcttgcaccagtaactgaaccacatcgaggtgtccaccatttgctgctagccacaatggagtgttccccttcttgttacgtacatcaatatgagctcccctaaaaaccaatgacacagatagcattgtcttttttttttttttttttttttttgatacagggtcttgctctgtcacacaggctggagtgcagtggtgagatcatggctcactgcagcctccacctccaggggtcatatgattctcctacctcagcctccagagtagctgggactacagtcccatgccaccacgctcagctaatttttaaatttcttgtggagatggagtcttcctatgttacccaggctggtctcgaactcctgggctcaagtaatcctcctgcctcaacctctcaaagtgctggaattataggcattgtcaccacacctagcctagcattgtcttaaatagaatgaaatgacacagtaacaaaaatcaactatcaacatgtgaaaatattctgtaaagataaaaattgttttcaatattcaaagatgtaaatatgtcttgctctcagaattatactacacaaacaatatcctatgaggcaactgtaaccgtttcagattatttgtattcatatacaatttgaccatccctaatctgaaatccagtatctgaagtctgaaatgctccaaagagcatttcctttgagtgtcataacagggctcaaaaagttccatactttggagcttttccaattagggatactcaatctgtttttgtagttatgttaaagataacatgcaggtttagcattcattcagtgggcatgatgtagatgggaagaaccatggttagtaagagttaacagcagttactgccaaatactactgcttagaataccatgcaaaggtctttgagagtgcacgaaaacaagttaaacagacaagcatctttggaaaactagcaggcaacttctacgtgactgaaagtagaaagtaccttggatcctgtctgtttatcttaaatagtcccataaccacacctaaaagccttaattactgtgaagaacaagaaaatggacaatgaagccttagatcactgccagacttttaagacttgtgtgtgggggatgtaagtatgtctgataacagatggatgttcaaatagcttgttattgtagacgttaaaagtaatatagacaagaatgaaagaaaaacatttttaggttacacagaaacaaatcagacaatgtagcatagctctggagggttggaaaacaatgggtaggtttgggggaaaaagcacttgtttataaaagaagaaataatcacatttgattttttaaatagtttaattgcctagagagaatgataaccactagtaacacttgtgttcatatatgaagggtatggtaacaacatacctgccaataagaagctcacagaatttgtaatgccctttatctgctgctatggttaaagctgtatctcttgaggagggaactggaggggcattaacatcagcacctttatccaaaagaactcggcccacctccgcatatccaccagaggcagcttccattagtggtgtgagaccagtctaagtttagtgtaaaattaaaagtaatgacacgtaagagactggaaagatctaaaattgtaaagaataacaacttgaagaaggaatatgatacagctgttaccaagattcacaactaaatttaatcactgacccttattagctcctttgagttagtctgatctattaaaagaaaataattctacctaatctcaacggtattgcaaaaaaaaaaaaaagaaagaaagaaaaaaaaatctgtttaagatgcaagcacttggcatataactggtactcaataaatgttccattcccttccttttcaaaatagtctctctttttcagctgataatcctactgtcattgttgcctataaaaatttatcactcaggtattttcaagagttaatgtttgactgagttatacagaatgatttctaattaaatatatacataggagataaatgttactagaaagaactaaaattataatcaacatgttgctactatatatcttaaatatcaaagcaataaattcatgtgtaaatctcagactttttcttaccttagctctgtgttcaacatttgcttttctatcaagcagaagactaaccacttcagttcttccttggaagcaggctaaagtaagggcagtgttccgattggtttctatctgagcatttatgtcagagcccatgtctaacaggagcttaacagcagctgtatgcccattcatagctgctaacatcagaggagagatgcccaatttgctaccagttctaggggtgcaggtatggggaaaacaaatggaaaaatatatattttaaatgacagaaaaattggagatgatatataattctaatctaagattattttgaaggattgtttaaaatatccatttttctcaaccttagtaagtctctgagatactaccaagactccattagaaatgttttattagaatattttttgtatttcactcaacataatgacttaggctggaaggtgattaataagttattaggataaactttcaatcttaaagcatgtattagcttgcttaataaaagcttctaagatgtttacatttagtatcataagaaacagtactcaatatttttcaaactctatatcaagttttaattacttaaataaagttcatctcaaaaatctctaacactttgaatgccaaatttgtaataaagggatttactaaatttggcactaaaaaataggtgttctacaaatatctataacagtcttactaaataaggggcttacagaaagggaatacaacttgcctagagttaatctcagctcctgcatttagtaatattttgatgatgttcacatagccaccagaagcagccagacttagaggtgtgtaatcagaaacattcctgtgctctttatttgcccctcgagctaacaatagctccaccacctgaaaataaaatagaaaaaaatatgttttcttatggagagacaaattaccaaagtgtgtatttttaaatttctttttctggtatactgtacaataaaagaaggggaaagttcttccttcatgctctgcataaaatcagcctctaatgatagcaggaggtcttagaagccaacaaagagataccttctcaagtaaaacccatgtagaaatccactaaaatgctacaatgtgttcatgaaaggtctggactgaaaattttgtgacatgctttggaaattaatatttgttatttcaccacaaagcggtaaaatagagtaatatgggacaagattttttcgtattatacatgtgaatgtatttaacatatttttaaaccttttaatcagtaagtattttaaaagcatggtataaaaggtcctatattttcacaagattatgaaaattttctaagataacattaaaaaaccttatatacattcactacctagattttaggtcccacctactggcagaatttctgggtgtatggttttgtaagaaattgccaggctattcttaaagtggttgtactatgtacactcccttcaataatgcatgagttctagtagcatgagtcttggcaacatctgttattgccagtcgtcaattttagccattctagtggatgtgtagttgtatcccactggatcttaattgcatttcctgaaacctaaaaatatttagcatttatttaagtactgatgggccattcacagatcattgtccactatgccatttaatgcctaaacaatcctttgacacaatattcattctcattttataaataagatatagagaagtcaagactggctcaagatcatagctcttacccctgctcttactattaataatatatcctaaaatactaactggcaaataataaatgttaatgaatagtggtttatcttgcatctcagcaaagctatgtccaattttagatatcacattctttccatcactttttgctttcagagcgagtgacaaggttataaaaacaagaaaaaatatagcgttaggctattttataaacagtatagtagaaaactctaatcaaatttctcaagttttctcaatgccattatatttctcaattctttcagagaactcttctgctcccaaaacatccaatatacaacaaaaatgtatgatttttatagtaaaatgactttccaacattttattaatcacttcaaaatacttacctcttctattgacaccaaattaaagtaacaaagtgtttataggcaaaattgttaccctaacatacttcaacaattgttataacctaatctgttatattttaacaaaaatacataattcataaaaattacagtgccctattggctttaatactacttttaaataaagaaaatcaactaatatcttcttgactcaatattgaaaaaatctgttcttatataaagcaagtattttttcaagctaaataatgattgaaaggcaatatgattgaaaggcaaaattttgctttccgggatttatggggatttttactttttctggaatagtagaaataatttatcaaattaagtggttcatttttcactatcttaatatttggcttataatacttttaacctatctattgcccctactatgaattatagaagaaaaaagtgacacaagtagaagaaacaaaacagtagggacaggccaggctccttgtctcttgtgtggagtattctagtaataagtgtatctaactatccattcatataatatctattccaaatataagggaacaaaaattatggaaaaaaatgcctatattatcactgttaatagatttcagttctttttaatttacaaaatgaaggatgaccaagccctacccttactgcacttacataattttattagatttcccattcttttgtataggaattattatatctattaaaattgtttatttattagtttattttaaaaatctagtgggtttaactaactagagctcaatataaccttatgtgctatgactggggggaagtggggggaaaagctagtttaagatgctcaaatgggaggtaacagttccccagttcactcgtcagaatacctttacatataatattttaagaaggatactgacataaagggtgaaacagtcacgatgatgaagggattggaaaaggtattcttaggctaacaaccgaaacaagacttgtttcacacaaagaataggtgacttcaggaaaaaaaaaatctgaagatagaaaaggttaaacctctttctatttgtttaaagaacaaaactaagaactgtggggaaacaaaaaaggcatacttcaggcctgataaataggaaaaccttataaaagaataagagaaaaaagattttaaagctaagacactgatctgaatgacctaaggtgctttccaaatctaagattcaataattccttgatagagaagggaatctatggagacaacacatctggtttatatcccctgtacaaaggactgaatttgaaaaaaaaaaaaaggttatctagctgattataaaatgccacaagatacataagtgagtgtaaagctacattttcttgagcctagctaatctctatcagttgttctagtttccttaaaaaaacaaaaggtcatataatcttaccatcttatctgagaacctttcctccagagttgagaaagggtggggaaaaatcaaagcaagacaagagttctcaaaacacataaaaattgaatattcttaattccctactaatcttacagacagcaacagagactgtgattaagtaccttctatgccatgtactatagggcaggcaaagatgagtgaatataggccctgtacattaggaacttactgatttgacttggaatagtctttctcctaccgtaaatgcatggcattcctacttttagatgagcaggattctaaacaatgtgtgatttttctggcaagatagcttatgctaacaatgatactcatctttttgttaatagataatagtttcagttattgtgagaaatctaaacgtcaaagcattgttctgatagaaaaaataatataagtgaaagtacacatttgctaaacagagaaaggaaaacaattacactaaggggaaacattacctcctgtcttcccccagaacaagccaaggagagtggtgtgtccttggttctttcagactgggcttcaatgtctgcaccattgtccagcaatatttccacaacaccaacatgaccagctgtggcagccaagatgagtggagtaaaacctggagaaaaataatgatcttctcactacatgctaaggcaaaagaacaaaatatctgaccttcaaaataggactaaaaaataatgttcctaaataaattttttgaccagtattccaaaaaataaaacaaaagtaggccctacctttcttgtctcggtgctctatactagctcctctctctagcagtgtttgtaccagttcctcgtggccaccagcacaggcaagtgttagtgccgtgtcatgattactctcagtctataagaaattattttttggttagtttattaaataacttaagatgttaatatcaaatacataatatgcaaacatatcaaatacacacaaatacatatgtaccactctacaatatcaagcatttgaaaagcaaggtttatggacgggcgtggtggctcacgcctgtaatcccagcactttgagaggccgaggtgggcagatcacgaggtcaagagattgagaccatcctggccaacatggtgaaaccccatcttgactgaaaatataaaaattagccgggtgtggtggtgcgtgcctgtagtcccagcttcttcggaggctgaggcagaagaatcgcttgaacctgggaggcagaggttacagtgaaccaagatcacgccactgcactccagcctgggtgacaaagcgagactccgtctcaaaaaaaaaaaaaaaaagaaaagaaaagaaaagcaaggtttacttgtttccatattagcagccaacttgcgagttttttaaaaaggctacaaacatcaagaaaaataaagtatgactttcaatcacgtgattgaaagaaatactgtggattaacttttgctttcagccattaatggagaaacatagatcagatttattttcctatttcaaataactaaaaaagaaaaaaaacctctttgaaacgatggtgtttagacaggcagtgcagaagagtgatctctgaagacagaaatgattagcccaacttactgcctggagagtttccaggctatagtgcaaggagcaagtatccaaacaacctggcagtctccccaacttgagaagacagaatttggagagatcaaggtggctagaattcatggagcagattattgaagaggagagtactgcagaaagggtactctggagatgtgcagaggattcccctcaaatcttcagctgagttttgatcagtccatgtgcatgaggaaattatcccaggccaggaaaggaccaccagagagagtcaggctgaataatacccagggctcacacggagccaggaatagtttggttcccaccagccagagtagaaagacctcaaaacacacaggatgtcaagtagaatcctcagtagtagggccaaattagcagttgtggacccacctaacaaactgagaagtaggccttgaaatttaaaaaaaaaaaattgtttccaagtaacttagctgtatttgagaacaaagccccaaaatacttaaaggaaccaaatatccaaaatatactgtgtattttgaaaaacaaagactattataatgagacatgacactatctacatatggtttgcttctgccttctgctaatgataatgaccaacatattagatttaccagtgttcatactctgttatagtttcaatgctaacctagcaaactatctaatttctcatacttttattatttattttattttttatttttgagatggagtctcgctgtcacccaggctggagtgcagtggcgcgatcttggctgtctgcaatctctgcctcctgggttcacgcaacgctccctgcctcagcttcctgagtagctgggtttacaggcgtctgccaccacgcccagctagataccttttagtactctacaagcaacatgtgactattagcatttgaaatatggttagtgtaacagaggaactgaattttaaattgtatttaactttaatttaaatgtaataactgatattcaatttggttactggaaaatttaggatgtctcaaacaatttgagtaaatgaatctacttttcgactgcacatttaattaaatctagatacaaattgagtatttccaatgaaatccaaattcagatatactttaagtagggtgacaaatctgggactgagggggtttctgggatgagggacttctggtgctaaaacaggaaagtcccaggaaaaccaaaatgatttgatcactccagctgtaagtctaacatgcccaagttttgaagacttttagtatgaaataaaaatgtaaattatctcagcaattgtggtgtattgattgcatgacatgttaaaacaatatttggatatattaaattaaattaaatatattttaaaattcatcccatttgtttcttttcacattttttaatgcgactactagagaatttaaaattacaatctcatcatatttttcaactgaacagtgttgctctaagcatttccctcactttcacatatgtatctctattatagtacttatcaccaatctgccttatatgtttatcacccacagagactataaattcctgggaggtaaggaacatgtcttatccatgtttgtattttctacctgtagtgataaattacttaggaaataataaatgatagttaagtaaaatgaatggcaatagctgcaaaaggtcatagattcaaaaactgttactaataaacataataagcaagggactatatatgtagcattgattacatttacacattgtatttgtagaatgtacataataattataaaaaggaaaagcatattctcccagaatgtaaataactctacagaccaaattccattataagaaatgaaaaacaaaagacaaaaggcaaaatcagtaagagttaagaaaaaagaaaaagcctactagtcagtgatgaagagggagacggcaaaagctgctctgcagaagaggctggcagagagcagagctactgactgcagagatcagggatggccacaagggagagatgcaccaactacaacaatggagaaggacatgaaacttaaatgagtgacagctctgactgtgttatactatttgatcttcatttcaggtttataggaagaaattatatctgatttcagagaaaaggagataaaggctctgataaataactttccgatggccacataagctaacaactggtagatatgtgctttaaaaaacccaagaagatcttgataacaaaatcctgctctccccactatatcacagaggggccctaaggcaaagcagattgtgctgaatataatgttaagtgtatgtgtcttatgtccactctacgttggtgcatatgcaatcagcagaagaatcaattttatgatgaagtttataaggtttctaaaattcttccagggtttaaagagtaatttaggaaagcttaaatagaaaatgaagagatgtacataaaatttgcaaaagataagcacggaaaattttagtggatcagtaaaatgttttttccaatattataaaacataaattcaactgacatttattaagcaccttttatattcaaagcactctactaagtgctcgagggttgacaaagataatacaggactcaaagaagcttactgattactacacagggcaaattcaggttcaaactaggagacaagcataataatatattatgagatttcaagaaacaaacatttaaagctaagaaaacagctttaaattccttgtggaaatgaagttaaaagtgggcaactccattgtatttctgcattaagagaaactaaaccaactaacatgacagaaatatcactctatttctgaatacatcaataaacaaatgaactgaaatagaaatttgggttaatattaataatgacaaagtaaagaaaaaaacaggtgtttcaaatactgctaatcatggaaataattataatacagctgactattttgtagaaggcaaagtaccaattaaaggaagaatccttagattcaaattatattgcacaaagttacattagtcaagaagttatattccttgtcacagatctaagagaaagtcccgaacctgaaaaaggagatagatgtccagagctttaagagctcattcaggtttctattctaaagaaaatttcagttagcccatgatgccataatatatacaccattctataccattaatagaggttgttatgatgaattctggcttataaaaaatgataaaaaatatatttaatgcaaaaatattctgtaagttatcaacatgactattcaattttataatggtggtacagaatgaaaaacaagaaatagtaacacagatggcaatactgaaggaaagacaacttttaatgagctgaaattcaggtgaaaaagcactgaactgtgtgaagtgtctttaaaaaaggaaatacgctgggtacaatggctcatgcctgtaatcccaacactttgggaggctgaggcaggaggatcacttgaggccagaagtttgagaacagctgggcaacatggcaagaccccatctctgcaaaaaattagccagaagtggtgtgcaatgcctgtactcatagctactcatgagtttggggcaggaggatcatttgagcccaggagttcatggctgcagcaagctgtgatggtgccactgcactccaacctggctgacaagagtgagaccctgtctcaacaacaacaacaacaacaacaaaaaagtacatctattaattactttttttttttttttttttgagagagagagtcttgctctgtcgccaaggctagagtgcagtggctcactcagctcactgcaagctccgtctcccaggtttgcgccattctcctgcctcagcctcccgagtagctgggactacaggtgcctgccaccacgcctggctaatttttttttgtatttttagtagagacaaggtttcacggtgttagccaggatggtctcgaactcctgacctcatgatcctcccaccttggcctcccaaagtgctgggattacaggtgtgagccactgcactctgcctattaattactcttaacataattaaattaccttgaaaactactaggacttaaagagctgaactttttttacacttccacaaccttcaaaatccttaatatctcattctctaacccactcaggttacatgtaagcttaaaaagtgggatagcacttcaaggtattcaataaatgagaataatcagtaaaataaataacctattaaaagcagttcatatgaacaagtagaatgcatgtattttaaagcagaatgctttaatggtagcatattatatatgtatcactgttaactaatttttgctggcctctctaatttctcatgttaaatcactgtgattaaactgttctttatattgcaaaaccaataagaatagagaaaaatattcatataatacttataccattaaaggtaaaatataattttacatacttaacaatttcagtcttgatacgtcacaagtgaaatttgatgtctacccttctttaaaataatgaatatatgttaattattaaaaagtgaaagaaagcaaaattctataaagatctattttttttttttcagttttgagatgtactagaataaggtactccaagttcaagaaaagacttcagcggcctcagaataaaaacaacaagcagtttaggaatatagggaggacatgtgacaaaaaagaggctggaacaagtttttatagcccaagaacaaaacaactggttctttctcattggtagtggctcctagaatcgatcatattttacacaataaaatacaaaaaatatttaattaacttgtggtattcagttctaaccttcaagtcagaattattgttccacataaagcctgtggttttaaaaaatctctacataattcctcatttctgtatgtacagaacccacaaataagtttggttataccaaacttaagcaaaataaactcaacttaaactcaagcaaaataaacacaaaggtcagagcaatgctatcaaaaggtgtaataaaaatagtcccaaataattccttcaaactattatttattggtttcctaaaacagattttgatagcagcaaagtatgtggtattcatcttaaaagttttgaaaatacctagacaaatttgattcagtaaaactggagagttggaaagtctgtggcacacccttggcaagtgagttctagttgtgtagcagagagttgaagccccttatgaagaatgcaaactcttcagcatttgtcaaggatcagaaataaaacatatgattcctgctaatccttgttaaaaatattagctcctgtctaaaatgttcaactaaagcagttaaaggtctgaccattttccagaatcattagcattttaaaaggagttatactttgaggctttaaaagattaacatttcctttgttcttccttatattttgatgttaagtatgcaaagatgaaagacaaatgatctcttaccatctaggcagtggacacgtttctgtgatcccacttaccaggctaatacaacataattcaaattcaaggttaacacacttaagttaaaaataaaaaaacaatgtaacatagtgcagtggttaataaaagaaaagagtctagagccagagtgtctgagttcaaaagtaggctccaccactaattagctgttgggcaaggtagttaatatctttatgtcttatattcctcaaatggaaaatgtaataataatagtacctacttcatgggactgttacaaagattaagttaaagaagttaatatctgcaaggcattaagcctgtatgttagggtttgttacataaacagatgaaagatctaagtattaaagaatgtttaatctttcagaatagcaatcttggtattaatttcttcattatattatttgtcacagcacagtattatcacacataatcaaagtacccactatgtaagagcccacaaaatttttattttcttatcaaaacaaaaactttgagcttttgtttgattgagtataaaaggatcttcatttttaatcacttaaattacctgcttgatataaaaactagttgttttttttttttttgagacagagtttcactctgtcgcccaggctggagtgcagtggtatgatcttggctcactggccaacactctgccttctgggttcaagtgcttctcctgcctcagcctcccaaataggtgggattacaggtgtgtgtcaccatgcccggctaatttttgtatttttagtagagacagggtttcatcatgttggccaggctggtctcgaactcctaacctcaggtgatccatccacctcggcctcccagagcgctggcattacaggcgtgagccaccacacctggtcaaaactagtaaattttaaaaacaaacatcaaaaattaaaggagaaaaatggtgaacaattatttttgaacagtatttttttccaaggtaggaactttttaatctctaactaaacacatatggtaaaactccacagagagtagtttaactcaggtctggctaacccaacaaatgacaaatcttgatgtgagatcagataaaaaaagtagatttttaaggagtcatagtcaaatttttctataaaagcatgtctactatgtttaaaatgtaagtttaaaaataattttaattaaaaaattacatgtaacttctcagaactaagttataacatggtgatagttggtgagtggtacagcccagaaaaatcatttcaccatcactacagtaatttcatattcagtaaaatcaatgactggacaaacttttctgtgcctgtttaaaaacatttttataaagaagtctttttacattttggtgaagtacttatttttgctaatggatcaattcttgggcccacaaaaatcagaaaactacctcttgctaaacataatagtctcagctgtgtgcggtggcacacgcctgtaatcccagcactttgggtggctaatgcaggcagatcacctgaggtcaacgagtttgaaaccagcctggccaacatggtgaaaccccatctctactaaaaatacaaaaaaattggccaggcgtgatggtgggcgcctgtaatcccagctactcaggaggctgaggcaggagaatcgcttgaacctgggaggcggaggctacagttagccaagattgccactgcactccagcctgggtgacagagcgagactccgtctcaaaataaaaaaaaaataaaaagcctcaaagcaaaaaagactggggaaaaataatgcaaattcaatgccaagttcaaaccaattctacaatgctatcaatattaaatgtaaacaactatggctcatcaaatgaatgtctcgtgttttttttttttttttttgagacagagtttcgctcttgttgcccaggctggagtgcagtggcatgatctcggctcactgcaacctccatctcccggattaaagtgattctcctgcctcagcctcccgagtagctgggattacaggcatgcgccacaatgcccagctaattttttttgtatttttagtagagatggggtttcaccatgttggccaggctggtctcaaactcctgacctcaggtgatccgcccgcctcagcctcccaaagtgctgggattacaggcgtgagccaccacgcccggccatctcgtatttttttttaaaaggctatgtagatggtagttaagagtgtctttgggggatggtggcacacctgtaattccagctactcaggaggctgagacaggagtttgagaccagcttgggcagcatggcaagaacccattacaaaagaaaaaaagaatggtgtctttgaagtcatgctgaatgattcccagccctgccgcttcttagcctaaatgaagtgactaaacaaaatgcttaacctctctcttagctacaatgtcttcttcagggagatggatattaagagtagctacatcatgtatgtggtctgaggattagatgagacaattccttaaaatagtccctggcaattttaagtactcaacaacaacaaaagtcagtacataaaaaacaacagacatttggccaacaagtaagagcagaaataaaattcctttttcatagtgttactgaggatcattttaataaaaaggaaactttatttttaataggttaagagtacatgcccttaatggtccatccaacacaaacacacatacactcactcctctctctttctccccacgttacccctgctaaaattcaggctttattataaagaaataatcatatataaaattaaaagttttataatgtacacaccccaggtaccatcaaaatacaaaaactaagtaaactgcaaacatttcttagtcctgatggccatgtactcttgaccttattcagcagtcttctaaactagacctcttaacttttcttcaggataaaacacgcactattctctccaatctcaccttgccctgagatttcatggtcaactactttttaataaaaaattatacttaatagctctcaaactttctaaagcttaacttaaacagtgtcctccccccactccatgttatttcttcaaaaagtgcctggaatcccgtacagctaaattttacaaatacagacacagactcaccacatatttcaatcagtaagatgagaattttcaaagatgatatatgatatcaatcatgtgtatgacatacaaaaatataattttatgttagaaccttttttcttttacatgcaatccattatatatttcaaaccatatcttctattaatttattattagaagaagttatgcactaatcttaaataaattatttttcttttatatcctcttgtgaactaaagttaaaaaaaaggttacctgatgaccttggaaaccagaccatcacataattatcactaataatctatatttagcattttattttttaaatgtgaactttaattaatttaaaactggctcaagactttgcctagagacaaagcagtctttcatggtttaaatctctgaaagttaatgtttttaattatggcataattccaatgaaaaaaccatctctcttaagtttgggacttacctgtgcatcaatatcaatggcagggtagataggaagcatggctgaaggagagatgataggacttggagttggagtctgaggttgggaaatggatgcagcaatactgtgggtaggagtgtttgacattgcagatgctcttccactgactgctgttgaacaaaataactgcacttaataaggatgaaacattgttaagtaatactaagacatattcactcaaaaatatttaaagacttcttaaaacaatatgtctacaggaagactactatagcactaataactaattttcctggttattattcactgatgacagtgtaaaattgtaatgtatactgagtaactcattttctaaataataatccaactgaaaaacaaattcccctgttataagcagtcgtaaaaccttaattcaaaataaccctgaaaacaaaaatgtttatgtattaaatataaatgcaaatggaaacttgtccattatatcctaattagaaaggggatcaaaggtaaaatagtcaagatcagaagggggaatatgtggtttttacttgccaatttcacaccttatattctagaactagtaaaattaatatcactgtcggggagggagaaatctcactatgcaatcatttaaaacaccgccatactgttttactaactgcagactgggatatagtaatattctgcattgtagccctctggaatgacaggatattcaaatataaaaatttatcctcacacagaagtgtagttgctcatgtgaagaattattctgagggagctaaaatgctcaccaatgaatccagcaatcacactgacttaaggacaaaattaaaagattagggtagaaataaatgtatgcacacaaacattcttcaaatatggattactattattctaagtatgatgttgctgtgatattattttcaccaaaatatgcaacttaagaaaaggctattctgatcagtacttgaggtgggaggactccaaatatgctggcataggatatactgtagattcagctgagggtactttattctctcattgccttatttctggagttgataggtgaacatcatctcccccaaccccattaaaaatgctatagtattaaagtatgggcatttatctttgactggtcaacagtactgtggatgtgtattaccaaagtagttatcaactacatcagacagaaaacaatcatgattcacaactggatctgaaaccaggcaaaagagattatgatcctgtcaagaataaaactgaaattgatcttattataacaattataaacataattatgaattaagaaatctattttacatgaaatccttagttcaggcacaaacatacactatacattatagcaacacacattctataattatacatttttaagtccacttaaaagccaaaggaaaaacgaaggagaaaacaaaacaaaacaaaacaaaacactgtttgaatccttagggatccagaccaatagaaaagggcatatactaatatattaaattgataatctagcgatctggatattgttactccatattgatagttttgtatgttacgaaaagatcaagataatttaaatgtacatattgttgatatacatttcaaaatcatataaaatctagagctctttaaattgattccatatctcctttgattggattttcacaataaaactgctaaatacaaaaagtagcttaaacaggatgaacaccagtctgtccgaatcactaaattttatttcataatactaaacaggttaaaaaaaatctaagttttattgttaaatgactaaattataatttacatttcaactggaatattttcttttaaagaacctaccaaaattacagagttttttttttttttttttttaagtcaaattggttgttcttatcacctcatctaaaaggagacaggaaaaatcaattatctcatcatttccttcggggtacctataaaattggtttactaaaattaggtgactgtcaatcacacatccattctctacaactaaaagaaacaaatgtaaaatatgtaggtacctgaaggaactctggtaaaaatctttacatgtggggcttcattttagtgttagatttagagagggagaaccacacatcagaaaagttttaatgtcagcatagaaaaaagggaacttgaaatgatagcaaaggcaaggtgttgagacaggttaaacagggagctgattctggtttggcaagtgtgaagaacaggaaagacagacgattttggtcagcaaattttatggtagaagtctaataaatgaagcctaagaaataaagagcagggactgtgctagagggaggaaaagaagacgatgagactaatgaggctgtaatatactttaaacccctaagaaagaagtggaaatcatcattaagcaactgaaaggatacatcctaccacagaaatttaagattgaggctgcaaaagtcagtgcatgagtatatgtgcatgtgtgtgaatgtgcacatgcctgttgtcagggatgagttgcaggtaagtagccaaatgttttcaatcctactcttcctccttctggctatgtttctctccccatagaaatgagcataataaaaaagtaaaatatttttgtattatgacaagcatctgtcatatttcctaaaaagttatatgcacttaaaatttttttatacagaacactgagaatacacagaattgtttttgtttcatgtatgaatcaaaagaaaagatactttacaaacttctgataattctgatcagcatacaaaactgtacaactagcaaatcattgttgacaactatgcatgcccaagcacatcaggtaaactctgatattatataaaaaaaatttttttaaacaaccattactgtgtaatacctattcttcattaaagtggatacgtaatatttaactctatacatcctttagtagtttcacatgatagagcactattatgatctgaattcatatggacatagtatcaaatttagggttaatggttactgtgctccaactttcacaggatatttaataattttaaaagtttactctcaattattataatcagctagtcatgattagtagtgactttcaaatctatagaaaaattttgcactcatcaataagagtcgtacaattcttactagtaattattactagcatttttccaatgtggttatttaacccttaagactagcagaaattttcattccacatgttataactactgaggtgctattaaaggcggactagcaaactttacagatatttttaagtataaaatctatctcagctggattcttagtgtctgaacgttacctaaatatctaaacactatacagtttagtttcctattatccatttaaaagatgaaacttaaaaaaaaataagctcatcatatttaatgctactgaaacagtttttaaattagaaaaagtcaatcatcctctaagtacagatgaatgaataaaaaaggggaagagatcagatggaagtcaccaaaattccactgtttattcctttcatttttctgttttccttccttttcaaattttctttttttaatgaagcaaattatccttctcagtacagcattcttatggttcacaaccctataaaacctcatcccattactttgttacaaaacacaaaaaataagtaccaaaaactagaagcataaaaacagtcttctaaagtgtatcttcttgtcaatgaaactagttataatcgaataaaatttatctggctacacatctaaaaatatatcatttatgatactttcaggggggccacaccttctcatgatacagttagaaagagactacacattaacattcacaggggacaaaatcacttacatacagtataattaaaccctatttggttttgaactttattaattttgtaaaagtgtttttttttttaaatatccatcaggtttgaagtctgatccattaggatataaagtatttctgttcataaataagcttcctgatgtgtcctactagttttgcacttcaacttctatcaatttcccagtttattggtgtgaatacagaagcaaaatgccaaaattcaatctcagtattctgaacttaaaggaaaaaaatgaaaacaaaaacaaaaatcaaacatcaaccccactactgaaaaacctagattctcaagctaccaagctaagccagaaagcttcagtcatttgtactgaatgagctaatctttaatttgacctgtatccatctgagaacttctgagattgaactaatacttctaaagctagacatgagtcagtccaaaaatagttctcaagttgggtaacggcaaaaaatttgggtacattcttactcgccttaagcaaatcatatttgatacctgctcataacaatataaacccacctgccatgatgtcatccagcgtgtcattgagggtctgagcagggctggctaccattaacccttgttgtgtttctgtcagaattccttgccccagccctgccaactgtgcttggcccagtactggctgtccaactatcactccttgcagttctgtaagatttgcgatggaccctggaggcaagggacctgccgccagaggcaaagcttgaggcatcgccagaggctggattggcgcaaaacccatctgagcagcagtctgctggggttcatctttaagtaaaacaggatccacttgctgtaaccgtgcatagtctccctcagaaagctgctctccaactccaacaggagttagtaatcccaggtgttggcaagactgttgctgctgttgctgaagttgaattctttgagctttaacctctagatactgcttttttagctgctgctgagttttcagttgtaactctcgttctactttctgtagttcctccaaaatcttttgtttcttctgaatttgttcctcccttgttttgttgagctcctcgatcttctccttggtaagttggtcagcatgagccagttccaaggactgcagctgtgcattcttttctatggcttcttttatcctctgttccagttctgttaactttccctgagcctcttctacaatgctctctggagactgattggtgatgtaaccctgtacatcctggctgtttgctggcaaatggctgctggacttttgtttagaagcagctgtgtgaaaaagaaaccccctcagaagtgcacatgaatggcatcctcattacagagttactgttgggaggtttagtgccaacagttatgcactaagtaatcatatccataacaggtgaaaatgcactgttaaaaaattaaaaacaaatccaccttctttttcacaaatataaaatgtatgtattttatgtgcaaaatctttgtaaattaatttcagaatcttaaaaatagcacatggcttaaattagacaatagaggaatgcaggtttgtgatatctaagtgtgcaattaaagtaacatctaaggctatgtgtagatattttatatggtcataaagatgttaaaactcatcataagaacagaacaataatgctaaattattagggtgaagaggaaacagacctctaagtcaggttttttcacatttcatagtctgtgccttttaaacacacacacatacacacaaaaagtacccaaaccactaagaagtaacaagaaattaaaatctgagtaaaatatatgtctttgttggggcctaccatcttcaagactaatagaggcaagatataaattcacatattcacacagctatctggccagtagagaattgggattcagtttccctggaagaaaagatgctggactatgccatccactgtatcttctgacagccaggtgaacagacagatctggctataggtatagcaatcaattgtttgctataccaactgaaaaaggtgccaaggctctaggttgatagtagtgactgaaaagagctggtgaaaatacttagcattcttgttcataaaagagtatacgtagccaaaaaccaaaaaataaaaactgcactgtttcttcaggtaaaacttttaaaaagaaaaactgattcaaaccggtaggtataaaatgtttggggacattacttaagaacacacatggtgtaacatacacaagtcaaatatggacctcagaattctagagaaataaacaagcatatctcaagtaactgaattattggttgagaaaaggtatcccagatcagatataaaatctatattaagccagtcattctaaaataaatttctaatatttgatacatcttgttaatttatgcctttataactgcagagatttaggtaagtaatttataaaaatattgctcaactatacccagcttaacattttacatgaataaaaattactattaaaggaaatcatggataatcagaactgcatcaaagatgagcatctgaatttctcatgctaaaacttctaattgtagcacaaattagtgctattaactatttttttctcccaataacatgcttttatcatgggttaaaaatttagtaatgccaacttagtaaacttctttgtttgtagaaatgtctattttttggtaatcttatttttacctggacaccaagtaagaaacagtctttagaagtataactgacctttattcctgatgggaagagtggtggcaacattggcaggtggtttgtcaggctcctgaggtggaacaaccatgggcagtgcttgaactggtacacgaggagcctaagacaaaggacactaagtgactattagtgtcctacacaatccattaagtaatatgctctaaataaagaataaattagagattttttgacaatatttttaatatgtcatcttagacaatgacatatttacttaaaatatgttggcaccaaattgtttaccacgacattttttagtaggctttgaattcaagttgtgacctttaaaagctaaagcataatcatatcatctaggatctgaatattgtaccagatgttcattaactgtatcaagtacatatttacaaacagaactacatattagaacaaaaaaaaaccctaatttaaacagaaactgtaagtgaaagaattaggataaagaagacataccataaaatgctttaatttttaaaatcttaccctatttaaatcgtgggatgggggagttaactgagtgacatctggtggaggggctgaaagcaagttattaggataatccaagagatagcaaacaacacttgtatggccaccttttgctgcttctatcaacatagttgagccatcctaaaagagtgaatatggaaggggaaaaaaagtgaagaaaaataagttagtttacagaatcacttaggaagataaagccaacaggtcccagacgcattaaaatcataggtttggtaaagaacgcttcaagtgaaaaaggagaaaatttacacttagaatgccattatgaatggaacttgtacatgatatgttgtaacaatgaccaagagagaaatactaattcacaattctgcacaaacatttgagttacatactttcaaacggtgagtaggatctgccccatgagccaaaagtagttccaccactgccagatgaccccctgcacaagccagggacagtacagtatggtcattattagctgtggttctattcacattcgctcctaaaacagaaaaggcatggaaaatcatattagtagaatggtttttcttaaaattatggtaaatttaaaaatcatgaagagtagagaaaatagtattatgaggctccacatacccattaccgagctttaatgattataaacacaaggccaatctcatttcacaaatatcctacattaattctcctctcccatcttggattattctaaagtaaataaatcccagacaaacacgatataatttgaaaaggtttgagtatgcaccagtaaaagataccaaagtacccattactcctaatgtaataactgtattaaaagtaaaatatgaagttttatttgtattttaagttcttcagtagaaaagatgactgaataaaaataaactatactgccctctatgggctttatgtagagaataaacactaaatagaaagaatagtaccattttttttcccattagtaaattcctgacaaggaaaatagataattcacccctattcccaaataggaatgtatccctaatttattcgtttgttgttttcgtagaaatggggtcttgccatgcatgttacctaggctagtctcaaactcctaggctcaagtgatcctcccaccttggcctgccaaaatgctgaaattacaggcatgagccattgcacctgacctctatccctaatttggattactgtgctaggtaatgtgagaaatggaaataaaacagcagaaagaaactgaaatcaaactcattaaaattaaccaatgagaggggacagcgattatgtacataatgctatatattcataacagtattctaaagcatatcaccagtgcatgggaaaatgttgaaagtaatttcgccagtaagttatttcaaattttctttacctataaacaattataaacttgagatttcgttactattattataatgtgaagaaaatggtatattattgccttttaaaattgtatatggcctacatcttttttttgttttgagacaggttctcactctgtcaccctggctggagtgcagtggcacaatcatagctcactataatcttgaactcctgagcccaagtgcttctcctacctcagcctcccaactagctggcactacaggtgcaagccaccatgcccagctaattttttaattttttgtagagacagaatctcactgtgttgtccaggctagtcttgaactacaagactgaaaggaccctcctgactcgaggtcccaaagagctgagattacaagggtgagccaccacacctggcttcctctttcttttatcaatgcagaatcaaaaataaaatctgtaatctcttatacttaagaatatgatgaactctgaattgaaaactgtctcaactagaactttcctagtaagcacgttaagaaacaatttaaagaaagtaataatatactcccttttattttatttggtcattaaggtctttggtattcaaactaaaatttctgatcatgaatgaaaatcctcatgcaatttgctatatttgtcacatttctattgtgaacattttttgtactatatttataaccagctccctgtattttataaaaaaggaaacatagaagcagggaaatagtagaaatgttacttgccacaaacttttttagtggcagaaacatcataaaattccaggtttcaagaaagtgctatagtacatgaacacagcagagtttgttacctaaatcctcagtttttacacagagaaatttccctttcctttatacgtttcacaacaagtgtgctacttggtatgacaattatttctagtttgaagctggtctgtgcatggcaggatgtttatcaactatccactcaatcattaaatgtcagtagcatccctcctcatatgataccctcttgccttcaaaagacctttacccttaaatctctaaatgaaggcaggggtagatacctttcaaaaaaagacaactgttttatacaaacctacctttactaattaagaactgaacagtacaaacatgaccagctcttgcagctttcattaaaggagttcttccaccttcagattcatgttcctgtttaaaaaaaaaaaaaaagacttgacatttaattgccagtgaacaagtattctttttcatggaaatcaaaaggaaaataattggactgatttctgaatctaaatatttaaatataatgctttgaagcaaattaagaaatatacttttaaatttaaaaaaaatctcaaatcataaacatgttctatggaaataattttagtatatgtgctgccaaagtgagcactggaaataattttaaatttgaagttatagtcacgtgatcatgatgccctcatctaaacgcatctgagtaatttgtccttctctctacacaatgaattgcggtacttgaatatgcatgtatggtactctagcatggccttctccgaacaatcaatataatgagcattatcctcatccactccaagttattttcctcttatgagtgtatcccatctctatgaattttagtaagtacatcattaccatctctttacagacttcctattatctctagtttcccttatacaaaaatgataacaaacttttctaaaaccatcaactctaagatgttacaagagctttctgggtcccaaaaggatggagactctactgcatacttatgattactaagtaatcaagaacactactggtgaaattttcaatcttaaaaaaataaagatttgagaaaaagtatcttttgtatggcattttttatttctttttttaaaaagccttcacatctgatgaacaatttctgatttttctcttaagccatatcctaggtttttctaattgccatcaactaaccaagtactaaagatttcactgctgtatgtttcagagccattgtggcaaacactaggaatacagttcttacactgaagaagctctaagtctaacaagctcgaagcacttattatatacgttctattctagttagttgtgtgcttatgtctcccttgttagacttagtgctaacactaagtggccccagcaataatctaattcaacattctcttctcataaatgacaaaagaaagattaaattataaattattaagtttataaaattaattactgaaggggggcttgttgctgcctgcacatgaatttgtcataaactgtgaaggaaagagcacagttgcttattaatcttagaatctcggggccataaatatatgggtgcttacattttaactaaaatgggcctttggatgtcttattccttttaccccgcaggctagactggaagaccacctattctacccacacacagttgcttcatgctttcttacccctcaggcttcactcataacattttttccaattgaaatatctctttagccacaacactgccatatctatctttctaaactttagccatccccaaaataatacatcagatgactgctttaccttctgatcttctttactctgcattttcactacaacatctcttataataacctcagtatttgtcacctattattttttctgaaattataaagtacttgagggaaaagtttattatttatgttttaaactcttttattatttaataatgttctgaatattgtaggcataatttatttcctaagcaatactgaaattcctctaagccacatttgcctttttatatcaaatcagaaaagcttctaaaaatagttaatatctaagggaaaaccagtctgcattaatatctgtaacacaaaaatttcctttttctatggaaaatgagggataatgcagtgaataaccctattaaggatggacactaaacagtgtggaaaaaaatgtgactaagtgagagaaagaatggcaaaaaaataaaaataaaaaaaacaataaaactgaaggtaaagaaataccttttgtctagactctccataatttaaaattaatttcttattgttaaatattaagatttaaaaagtaacatagcttaccagatctgcgcctgcctgaagtaagacatctgctacatcagtatgaccattttcacaggcatatgttagtgctgtatcccctgttgctgttgttgcatgaacgttagctcctgtagtagtcaacaaataatacatagacttaataaaggagccataagacatatatgacgaaaataaaaacttcttctagataagtcatacctcctcaagttaaacaaattcaaacttcactcatttccagaaacagagaatattgtaggcattaaaaaaattacaaacaaaactggttgaaattaaagctgcagatacttcaaacagcagtaaggtaaactgttcagaatacatacaaaggtatatcacacgtttttttaaactcacacattcagtgtatcatagcatcataaaaatatttgcattatgacatttttacttaaacaaatcatgtaaaaaacttctcccaaatgcaaaaatgcctacctgcagctaataagtatttaactaactccaaatgaccctcttgagcagcttccattaaaggggtagaacaccctagttctatatcggctcctgccttaattagaaagtctgccacttccagaaagcctccacagcaagccagagtcaaggcagtttcttgagtttcttctgtctgtgcattgatatttgctcctaaaataaagattctaattatttaaagaaagtcattaacttattccagagatatgaaaaacatgattgtttcttaataaactgaatctttaaaatgaacatttatattactataataaataagaaagtgcctctctcctaactcctaaggcagttaaaactaaaaataaataaaactattaaaatcacacccagatttgatgtaccacagctggagtaatatttactcagccagaaggtacaagtcgggtgataaaagaactcaaaaaaataagctacatcctctcattatagtgattcaaaaatgataaagatactggtgataatgatgatgatgatgataataaaaatcttaacattcaataagctctatttcccaggcaatatcaaagcattttacaacttatttaggtattattattattattattagttccattttacagctaaggaaactgaggttatttaacttatacaaggtcacaacattattgtcatcaatactaccaccatcactatagctagcacttaacaggcactacatgacaagcactgttctattagctttatacacacgtattaactatcacaacaaccctacacgagaaaactgaggcacagaaggttagaaacttgcctaaagttacaaaattggcaagcagtggagttatgattcaacctaagaagtctgctccaaaacctacgctttaaaaatcatagtcaacattacttctaaataaaaacaaaagttttttttaaaagtgtcattcctcttaaatttgtccagacaaaaactttactactgaaagaaaaataaaatcacactacaaatacagagatgggagattacttctaaactgaagatatcttaacatattgaagtaattgtttcacttttcccaaaaaagaagtttatgtactgagccccttggcagcttctaatatgtgcgcattcttgcactctcagcaagttagtctttactgcgtggtttcccatactgttttttaaaacattagatctattaaatacttattagtaggtattccgcccccaaaggaatacattctcttgatctattacctttagaaatgttggctcttatattcccctatttaactcacaagccttgccaacaccagttctgtttttcgttcacatatagcacatgatgtctctgaaagctctatatgaaagaagtttctttgattttgttttaacacagtatgggagccattttcacagtaaatactttatcactggtttgtgtaatagctcattgcaactctactagaaaggtgaaatactaaaatccaattttataaaattatactcttaggttttacacatttatactttagtgtcttgatagatacggttaccttgaccaagaagtaatgccaccatttcttcatgtccttctcgagctgcttccatcaatggtgtataaccttcatcattgacctcttccaggctagctcctctttcaataagtaaagccgcaagttccacatgcccaccacatgcagccaaagttaatggtgactcaaatgaatcagcaggcatgttcacttgggcaccgctgtcaagaagtaacctagctacttcaacatggccatcctaatgataatacaatttaaaaaattaaatcagcaccattaaaaaaatcttgaaaaatttgaagacttctcaattactatacaatgaagtttatctatctccactcaaaaaggaatagagctacatttaacagttgagtaaatcagtatttattatgcactgcctatattctgttaacatagaagagggaaatagagattgaaaatataaaataagtagaaacatgataccttcaatcaagaagcttattaaccattagaaaaaaaaacagtaagtatgtgaaataagagactatagtgagacatcaacactatatggtacaaacttaaatgttaaaaggataaagtttagagaggaaaagaagaattttcataagaatctttaaggataagcaaacttttgattagttagaaaaaaatggaaccctttttggagaagtgggggaaggatacatgctgtgttaggggaacacaaatgcgtacatggtactttctatattgttcatcgtccaagtaccagtgaaattaagaaaagggccaggtgtggtggctcacgcctgtaatctcaggactttgggtggctgaggagagaggattgcttgagcccaggagtttgagccaggcctgggcaaaatggtgagatcccatttctacaaaaaatacaaaaattagccaggcgtggtggtgtgcacttcgtcccagctactcaagaggctgaggagggaggatcatttgagctcaggaagttgaggctatagtgagctatgatcatgcgactgcactccagcctgggaacagagtgagaccctgtctcaaaaatgaattaaaaaagaaaagaaaattctatattctgtcttctggtcactttttcccactgctttcctaattactggcaacttcaaggccctcttttcccttctttttgtccttcagtaatttttttccatctatatgttatctcccagacatattctttcaaacatgccatgcctatttttgcctctatgcttgtcacattacacaattttaatggcttactacttttttttctatttcaatttgtagagaagactctaatgtcttattagtttgattactttgctatttcttcagtgctgaatcttcttcctcgatagcgaactcccacatttcctttaaatcctagtttaaaaactcagtattatagcaagtctttcaaatgtctggcccctactaatatctttcacttataatatttacttccagtgcatgttggctagacctacagattattccattttaatttcttaatctacacacaggccatttcctcagtagggggtggcaagaatgtttaaatttccttatcatggggaacttttaaaactgttactgttaatactattaatgtgttttatgcccattatctcatttaatcctcacaactccagagaaagatattttcctcattttacagatgaagaactcaaaagcttagaaaaacttttatttgttaaaaaaaaataatttgctaaagcaaacactaagatggcaataaggaaaacaacagataactcaagtcttaaatggctacctcatattttaaaaaatagtaaataaaatttaacatcctttcaataattactctctgaagggaagatgagacaagaaacttcagattctttgggggccctttctaccgctggcctgttctcctcataaatttttctatgatattttggcccatttctgtgtcataaataaacaaagatacaaaggtttaagagtactgttatgagccattcccgaatacaaactctaaaatgcagctcttcaaaagacaatctagggctcagaaaagacctcgagagaggggaaattatgtaacataaattaggccctacttttaaatttttgtttagtcaatttattggtttgaggtatgttatgcttattaataatgtacatactctgaattatatttccttttttctttttttaacatttttttaaatagagagggggtcttggtatgttggccaggctggtcttgaactgctggcatccattttaatttgttaatccaatcctcccaccttggtctcccaaaatgccgagattacagtcataagccaccatgcctggccatattttcctatttcatatcctcaaccaatctttacaagagtgactttggtatagttatatgagactaagaaaatgcaggtagcattgtaaagcttcagaaagtaactttaatagaagttaatgttgtacaactgattcaataaggttctgacaaacagaatcatagcacccattggaaaggcattcattgtatactactctgtctctccctggttaatatataaacatatttgacatatttcaccaatcttaccatgcaagcctccatcagagcagtgtgcatttcatctgttttatgctcttgatccgcgcctgcttccaaaagaaatcgcaccatctctaagtgtcctaaaccaaaagtgtacaagattacttgaaaatattttattattccaaaatattttttaaaattataatattttgaaaagttatatttaacttacagcattaaatttataagcataataaagtcaactagaagccaccctcaattgtagaacacaaattatacaagtgatcttgctgttctaccccttaccctactgccctataaactgctgcttctagagtccctgctagaggtgaacaaagatgccattaaaatccaacacccaaaatgttccctctacaaccttttaagagcccaggcatgttatatagttatgttatatatgctacggaataaatcagttttcatgaactagtagcctgagataatgatcagtcaagttatttctgtgagaaaatgtatttaaagttccaatacctaactcagaaacactttaggaaaaacctgcttataaactgggaactgtatgtataaaaatattcttcaaaccacaccatttaatttatatttatatatttaattataatataaacatgtacacacattaatgcagtttcaaataaaccatatgcttcagttcatttaaagatacaagtggttaaaaagcagacgacaaattataatttaaaaaagacttcagatcctatgcaaaaaacaatagaaaaattatttaattttttccagctttatttggaatgagctacaatcaattcttattcaactgggaggcgggagaaggacagatagtggagtcacaggtaaacaattaaacaaaatttacttccataagtaagtgtagtatctgccgcgtcttatatttgtcaactacctaccatcccttttcctctctgtcattctcccctccccaaaatccacattagtgctcagtctcagcctgacttgtctctcttccctaactcctccttgtcagtctatatcctacaaaacctcaccagaaggagaggaagggaagggggtccatggatacctggaagtagcagagatgttctccaccagctcagtttgctatccagcttctaattaaagcctgcaagccccaacctcagatcccccttttggatagcagggtggggctacaagcaaaggcgagagggcagagtagttacaagcagccccatctcaaagctctctagccagcagggactcagtagtgaaatgcagccagtactgggttcaaaagtatttgtgagaaggggagagagccacccaatcaacccactccaaggcttacctcctctcctcccagtgaagatcagcctctgcctaattataaacaggattggggaagggaactaagggacctcagctgtgctccctatctgaaaatctattaacatcagataatcaaaagcactttataaataaaccatatttttcaaatttaagttaaattttagtcaattaatccaaatatataaggattattttcatgtttataaatgaaattattccaaaaggcatcatacaaccttggctactcttatatagaacaaaacaacaccagggccagaactagggtgaggaaatcaaagtgctgggtgcaaaatttaaggagccactcacatgtaagcttgtgcaagtgaaaggttagtcactgagaatgagtgcctccttaaattttttactaggttttgcaaaagctttttcttgatgcctaggggtcaagaatttatgacgtaaataatatgggacaactatatagacagatgacataaaacacagaaatgagtggctaaacacaaaattgtatgactttttttaataaaaaacttccttaataaaaaattttcttaatttactttcttaaaaagtaaaacaccttactttacagccatttatctgtcatacatgtggagtctaaaaaatgttcagctctgtggctgtgttttaacaatctagaatatagaacattaattatctacagacaaaatatctttctaggcaattgtccggtctgccaaaggagggcattttctgtactatcaatattttcaggttcattgacatcatttaaaataccatgtaccccttcataccaagcaaaatcttcccaacatgcaaagctattatacagttcatattaaaagaactgtttctgataaaacaattagatcaattaatactcatttttcagtgacaatatttatagttaaatctatattttaaaaatttaaatagtaaacaaactgcaacactgcaaacacttatttaacctttaattacatactatatactatcattgttttattttttaacttagaaacaagattacataaaataattataatttcacatatttaaaaactttgttttaagaaaggtttatactgtacctttgtaacaagctaaggtaagggcactctctttaaattcattagaatgcgtattaatgccagccccattttctagcagcaatctggctacttccacatgtccagcacttccagcttccataagaggggtatgaccattttcattatggtcctcaatactagcaccggattccaagagcacctttacaacatctacatagcctccagcacaagcatatgtaagtgctgtattgcctattttaattaggaaaaataaaaagacattaacataaaataccaaaataaattaaagtgctaatttacattaagaaaatggaaacagaagactacaaccataataaatattaaattacatatacatatatgtaaatatatatctatatataaaattcctttcctactgcattttatctttctgaaatcaactccctattctccttttccatttaaaaccaaagtcaaatacatgtggaaaatcatatacacttatccagactggggagttgtaaaagaactgggcaactctgccccagagctaagttttaccttaagatgagaaaaaagttgttttaatgtttatcagagaaatgcttcacaagcttttttttaattttaatgtttctaacctaaaattactcatcatatacatactttatactataccttttaatcatatatgttttcattacaacttcaaataccagttaactgatcaaattcaaatttctaaatttgaatttgaattcaataatttctaaaacattcttttctgctgataaaaatttcccatgttacaagaaaaatcaaccttctgggtaaaataagaatttctaaaaatcccttcaaatcagaacatgaccttaaaaaacatttaataacgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcatagtggcaggcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaatttaataaatttgaaaaatctgaatgaaggaaatgcacaaaatatttccatgaaattttagaatttttacacaaatctatctaggcccaaatttgaaaaaaatatatattttagactaaagttatgctcttcttcaggacacaatgttttcacaatatttttttctgtgggccacaatttagtaacagtaggaaacaatgaactatccttttgttccacaattgtttggtctccctatcttcccattcctctcctaaaaaactggaaacatggatttgagcactacggcccacacctctcaatttccaagagagtggtccatctaactgggtcagtgttttacttttatcttaaagaatcttaaaaggccaattgccctcataaacaaaacaggaagaatatcatttgaaatatattctatatacttcaaaactcatacacagatgtgtgagaatatgtagcacttctaataagagaactgaaaaattagcactaaacatcactttcatgcaaaatcattattaccaaatgatgttactatgtagtaaaactgaaaaagaaataggcatgacctgttgaagactgtgcattaacatctgctttatgagctagcagcaacttcacaattttgacatgtcctccattagcagcagccattaaaggtgtaatgtcacctttgattcccctatcttccacatttgcatgcattgccaacaaaaccttatgagagaaaaatagtttaaaaagatattaggaaataatcgtcaaaaaattttgaacacgtatttatataacgtctacctagtcatagtaaaagagctataagcacacaaaatttatctaacaaaactatttgttgaaataatcctaatggttggaaggatttattttattatttccttagtaagcaagccagtttttaaaaaaacaacaaataagctttattttgataatacgaacctgtgcaagctcatagtatccagcagaacaagctaaacaaaggaggctctccccttcctctgtgtgttcatttacacttcgcccttcaatgagtaactttcgcacagcatttacatctccttctgaacaggcttctgccaaactgcggctattacggaaagaatatcacaataccagaatataagaatattaaaaaattgcacagcataaatattgtttttgattgttttgttttttgttgtttagaaacggagtcttgctctgtcacccaggagggggtacagtgatgcaatcagctcactgcagccttaaactcctggcctcaagcaatcctcctgcttcagactctcaaagcactaggattacagatgtgaacaaccacacccagccagagtattggatttttatgtcaaatcttgacagttaatatggtttggctctgtgtccccacccaaatctcatgttaaattgtaatcaccggtgttggggaagggacctggtgggagatgattagatcatgggggtggatttctcccttgctgttctcatgataatgagtgagttctcatgatatctgtttgtttaaaagtgtgtagcactacccactttgctctctctctctctcctactgcgccatggtaagacatgcttgcttcccctctctctctcctgctgtgccatggtaagacatgcttgcttcccctttgccttccaccatgattgtaagttttctgagacctcctcgctatgcttcctgtacagcctgtggaactgtgagtcaattaaacctcttttcttcataaattatccagtctcaggtagttctttatagcagagtgagaacagactaatgctaacattagtgctcaacaaggatgattatttcaatatgattcataacaaaaaggcaaaaatgattgaattcattgagttttttacaatctacatattaatggcactgaattaaaattatcaatattccaaaatgttttcagttatgcaactgaaggataaagtctaatttactggtaagtggagaaagaacataaaattttaaaacataaaagtttatagaaatcacatacaaataacaggtcataattatacttcttttgttcggtcagtagaaaattttttataaaatttaattaaaaagtataaaatgtgcaaaacttccactaattataaagatctatgtgagtccttccatcaagtaaagggaaatcagacggaaaagatgggagaatgtaatattaataaatgaataactgatgagccttttttggttttggttttgaaagtatttacttatacaatcaaatttggggggaagtttcaaatccaggcaaagaaaaagctaaactcaagcaaaatgagagtggaaaaagtggagtaacaaaaaattaaactgagagaaaagtgtatgccccataaacttcccaaaacaattccaattgtagacatttctaaagattctcactttcgtataaaataatcctaaaactaaatccagggctattaatattctttttatttcaaatataactcaattattttattatcctcttaaaatatggccctttcatttcagatactaaaggcacctacagataatcacttttctatagccctgttattaccatcagccagatttaagaccaacatctttgtctcagatatggcaaagcctcctaaccagtctccttgccttcacactacttgctctccttcaggctcttttcaacaaggcaaccagagagatctttttaaaagaaaagtagaacacgtccgccgggcacagtggctcacgcctgtaatcccagcactttgggaggccgaggcgggcggatcatgaggtcaggagatcgagaccatcctggctaacacggtgaaaccctgtctctactaaaaatacaaaaaaaaattagccgggcatggcagcgtggcctatagtcccagctacttgggaggctgaggcaggagaatcacttgaacccaggaggtggaggttgcagtgagccaggatcacaccactgcactccagtctgtgtgacagagtgagactccatcttgaaggaaagaaaggaaggaaagaaggagagaaagaaagaaggagaaagaaagaaaggaagaaaaagaaagaaagaaagaaagaaagaaagaaagaaagagagagaaagaaagaaagaaaagtagaacatgtcattcctctactcagaaccctccactggcctataatctcactcacagtaaaagctgaaatccttacaagatctgcctagtggcaggataccatattcctcttcccttttacttctctggctttatctcctaccctctcacccttattccttccactttggccacattggtcttcttgctgttcatcaaatatgctaaataagctccaacctccaaatatttgcatttgctgttcctgtgccaagacagctcctctctcagacatggctcactcccttccctatttcaggtctttcctagaaagccaccattttaagtgaggacttctctgaccacgctattaaaaaatgtaatatgacctctgctatggtttgcatatttgtcctctccaaaactcatgtgaaatttaaccccaaatgtggcaatactgataggtaaggcctttaagaggtgactgagtcatgggggctttgtcttcatgaatcggttaatccattcatgaattaatggattaatgggtaaatgaactattacttatcatggagtgagactgggtaggctttataaaaggaagagaaacctgaactagcacacttagcctacttgccatgtgatggcctgtgctgcctcagggctctgcacagagtccctgccagcaagaaggctctcaccagatgcagccccttgaccatggacttctcagcctccataattgtaagaaataaattccttttcttgcccagtttcaggaatcctgttacacgcaacagaaaatgaaccaagatgacctccaacccaaacactgtcttagcacttccctttcaatttttcccatagttatattattatgtgcaatactatatattttatttacatgttaattgtattgtccccttaccaaagtgaaagtctcgaccagtactaaataaatttgtcttttaaacatctcttctgatttcccatttcacaggacactgacagtccctagactcaatgctatcatttttaagcatgtttagaacaaatccttcccataagacatttcctgtataagagcataccttttctctctttcaaagtagtctctctctgtctctttcacttctttatgcatataccctaatttacattatcatttgaatttttcattcaatttccatgtgtgtataccagcttgaaaacaaccttacaggatctactctagcaacagctgaacttaagaacttgtgggcgaagggcatattaagcctggcacatggcactgtccttaactaatataaaaatgtggcacatagtactcactgcacttaagtccaccatctttctcaaactttgttgaataaatataattctcacaaatatgttctattttttttgctgttaaattccagtattttcaatgcaaaatcatttgtgactttatttttctattctatttcctgcttgaactggttttagtatacccttcaaggtgttttaattctttctcttgccaatcttagtaggcaccacattaaaaaatatttggagattaccaatgatattgtaggctagtaaaactgaacatttactatggaatagaaaccgaggttaactaaagaagggagtcagtcaacctatgagaagaatggtaaagcaagttaatacaaacacaaaaatctagatgaatgaacactaataaagagccaagagaaacagcaaattcatgaccttgttaatactatctaacctctcttttatgctcttaaaaatgttgtatgaaaacaccattagacaacaaagaattcttaaatgctataatttactctctaaacccaaatagaatattcagatgttctcaattgttttaaggcaattgctaaaataaataaaatggcttcattttattagaggaggcaaaaagaagccaccaacggttgaaaatggtaacatgtattaatgattcttttctagttgcttccttgaagtatctatccatttttcttatcactttttttttttttttttttttttttgagatggagtttcgctcttgttgcccaggctaaagtgcaatggcgcaatctcggctcactgcaacctctgcctcccaggttcaagcgattctcccgcctcagcctcccgagtagcggggattgcaggcgtgcgccaccacacccggctaatttttgtgttcttagtagagacagggtttctccatgttgctcaggctggtcttgaactcctgacctcaggtgatccgcccgcctcggcctccaaagtgctgagattacaggcgtgagctaccatgcctggcttccatttttcaatatacatccataattgtgtttatatatgagatggtgtgatttttattggataacatcatcagaacagcttaaaatgccatgtcacaaaacatttactgagtccttactaactgtaaagtgctatctatatacaaggaattataggatataaaaaaataaagtccctggactcacattcaagttataggaactagatctataacttcttttaagacttcagaaagcaaataaataaataaaaagccttactctttaaaatggtcagaactacgcaaatgaactgtaaaatggcctaattgtaaaacatttacttctttgtcaccaatacatttttaaaaaaaatctaaataagcaaaaagtcttttataacatattgactaggccatcagccttgcagtcggaaagacactggtgctctgccacttattatctatttgatcttgattaagttactcatctctctttaacttttcatctgtaaaatgggagtaaaaacaaaatctataccttataaagtttttgtgaatctaaataagacatcacatgttaagtggttagcacagtgccagccaggcacaaaataaatgctcagtaaatgttagctatttgttattatttttaagaaaatgatttcatactgatggcagcaaaaatgtacttacttgtccgactgccctgcatttgctgtgctttcagctctcatacgggtaagtgcagcagcagcttcatccaacgcacaactaacagacgatgtcaacctccgaagtacttcaggatctgcaaaggctttaccatcagccgtggacaattttcctattcctattatattattttcacaccaatatggacacacccaaaaggagaaacaaagcaaaattcaagttacttaaagctatactgtgtatgttaacaaataacctccaaatggtagagtagacatatatattggctgcccagcatcttttgagaaatcactcttctccagttttctaataatcttattcattccatgtggttcataggtacttgatcctgtgaccctctggtgccagaaacgggtctttggcctatgatgggacaattagactctgtcatatctctgaaagaacgtatattcaaaggttgctaaattggtaagatgtgagtcataagctatttagccacttttgtcaccacatacagaaaaagactgcccaaaataaagtcaacatagaggagaacagagacacagaaagagaaggggacagagtcctgataaaattatttttaactcattgacgccagtagtgccagaagctagcaccatctctatgatttgggaaatgtctacattttattttttttaatttatatatatttcttttcgagacagggtcttattctgtcacccaagctggagtacggtggcatgatcatagctcactgcagtcatgaactcttgggctcaagtgatccgcccaactcagcctcccagtagctggaattataggctcacaccaccacactaggctgatttttctctctctctttttttttttttttagacagggtcttgctctgttacccaggctgggtgcatgccacgattacagtttactgcagcctcagcgtcctgggttcaaaatcttcctgcctcaggctcccaagtagctgggactacaggtgtgcactaccatgcttggctaattattttactttttggaggaatcagggtcccactacattgcccaggctggtctcgaactcctgggcataaggaatcctccggcctcagcatgccaaagtactgggattataggtgtgagccaccgcagcaggacacccagctaatttttaaactttcttgtagaggtagagtctcatttatgttgtgtagggtagtttagatctcctagtctcaagtgatcctcccacttcagcctcccaaagtgctcccaattacaggtgtaaactacttcatcgggccaatgtctatttttgcttaagaatgtttactgggctatcatctgtgaacaaaatatggcctaaaaaggcattctagactatatataaaagataagctataaatgagttatgtctacaacttatcacatatacttaaaatcatctgaaagtactaatctgaaaaccattcagaactgcaaaattaaaaaaaaaattcaaaagcagagatggttagtaaccatctatatgaaacctaactgttgctctttcagatatccctataaagcatgcagcattcttacccctaacctttattattttaattcagtggtgcttaatccaagctgcccatcagcatcacttgtggtgcttttttgttttgtttttgtttttgtttttgttttaagataggatctcacctggttgcccaagctgaagtacagtggcatgatcatggttcactgcagcctcgacctcccgggctcaagtgatcccccactttggcctcttaagcacctgcgaccacaggcgcatgtcaccatgcctggctaattgcttttttttttttttttgttagagacagggtctcactatgttgcccaagctggtcttgaactcctagtttaagtgatccacatgccttggcctcccaaagggctaggtttacacgtgtgatccagccccctgtagtggttttcaaatatatagatgctgaggttttctacatctggggatccaattcagtaagtagaaagcagggcctggcacctacatattttaaaggctctaaggcaattctgataaacagctaggattaaaaacctttacctctaatgttatgatggatattacagaaccctgctatccaacatgtggtccactgaatagaagcactgctatcgcttgggagcttgtcagaaatgcagaatctcaggccctacgatgtactgatccaaaacctgcattttaaaaaagatccccatatgattccaatgcacattaaagaaaggctattataggttttacaacaaactagttaactaagaaacaaaaaggaccactcacttggtaataaatatatctgcacagataagtatgtaacagtgaaaggtgttcaataatatcacataagtttcatgtttaaagttttgaaagtgtatacttttacagtgcactttataataaaataggcagcctagattaagcaccgagttagaataaaaaggttaggggtaagcatgctttatagcgatatctgcaaaagcaacaattaggtttcatacaggtggttattaaccatctctgcctttaaaatattttttttctgttgccgtcctgaatgatttttagattagtacttttagatatatttttatgcttttctttaataaaaaaactaacatagcaaatgttatatctcacaaaaccaaaaataaatctgccaagaagcctttatgattatagccataaaaaaatgttcagagtagtcaaatttcatatctgctacagttaagatgtataaagaataaaaactgtcttggtctgataagactgatacctactgtataatttatgtcactaatattaaaagtcatactatattctgaatctactacaatatttaatagatcatctttcggttaaatatatgaaggcactattgagatcaacatcacagaagaatttccacatgaaaaaaattagctccaatttttcagccatctgagatcactatataacaaatatttgtcagtgatagcaacagcaactaggcaagaggacagatctggctcagtaaaaactaaccactgttttaaaaaaatctcactttaaatctttatgaacttcttgtatcttcataagtaaagataactattttaataaatgtaactaggaagaaaccaaagacatagatggtaacctttcaaattaattagcagtaatcaaaaattaatttattctagctaccctgaattatggtgattcttttttttctggtcttatccagctattgaatattaaagtgaagatcgaaaaacagaaaagagctgggtgtggtggcttacgcctgtaatcctactacttggcgggtggatttcctgagctcaggagttggagatcagcctgggcaacatggtgaaaccccgtctctactaaaaatacacaaaattagctggacatggtggcatgcgcctatagtcccagctacttgggaggctgaggcaggagaatcacttgaacccgggaggtgaaggttgcagtgagccaagattgtgccactgcactccaggctgggcgacaaaatgagactctctccaaaggaaaaaaaaaaaaagaacaaaatgaccagattattatttccaaatgctctcatttaatcaattgaacaacaaaaccatagaaattcagatagagggcacattaaaatattatttatattattattttataataaaattattaatattactaacactattaaacttattaaatattatctgattttaagataattgaatgcgtaattatgttcctctcagaacttactcagagggctaaaatgcaagagaaattccatctatggtaaaactaggaaaaatctgtatataagctgaatatataagctaaaatgtataaagacaaagtaaaccagagaactaactaacttatagaacagaataaactgaaacaccactatcaaaagagaaacagaccattagcccaacaggagtcaggtatgagatgtaccagatacaggggtgaggctttggttagaaaaaagggagaccagctgaacacttgtgaggagtaatcagacacaagttttcattgccaaactaaacagccaggtgattattctctaaagaaaccaaactagaaaggccctggactaggagacatcaggtatacaggaggatgacatgaagtactacataaaagcattaagtgaaagtttacatgataagtagtgaaatcctcagccccattcccactgtcagctcccactgtcagaattatggtagctgggttaattattcagaagacaaacactggcaggtgtgtgtctaataaaatgatcctaaggttacccgtccctgatgtacacatcctacaaccttgggactgtgaatttgacagattttactcccaaaattaagttacgttatatagcattgttgacctaaagacagcgaggttatcctggtgggcctgacccaatcaaatgagcttgtgaaaggcagagatttctttggctggttggagataaggaagtcagagattaaaagcacaagaaggattctacttgccactgctgacttaaagatggagggtgccacatgtcaaagaatgtgggcaaccttatggagatgacagcccataaaaaaaatcaggatcttggttctacaattgcaaggaactaaattctgctaccaataacaataaatttggaagtaaatgttcacccacagcctacagataaggaacataggatagctgatatcagccttgagaccataagcaagagaatccagccacactgtccccagatgtctggctcacagaaatttaagagataataagtgggcgttgtttcacaccactatatttatagtaaattgttatgctgcaatagaaaactaatccatgctgtacagtgaaatgaaccaacaaaacatgcatccagactttccaatttagctttttatggcattgctatagactaaaaacagaacccaaggatcaccagacatctgaagaaaatcttaaatatgaaaagccaaccaaagtattgaaaatgagactgaaattttataatgccaaaattataaagctttggggaaggagaatagggacaagtggtacagagacagggtaagtcataaataagtttggcaacaccagaagtttagtaactttaaaggtctgagagtggttttttaaactggaactctatacctagctaaactatcaagtatgaggatagtaagaaaggcattttcagacagtctaaaaaattttacctctcaagcatcctttctcaagaaatatattggatacctaaaccttgttcaatctcaacatcacaaaaagagaagcaaccagacagtgcctatgtgatacataaggaaacacacagcattatgaatgactattcttgtcaaaatcagaataaatctgaatctgatcaagtatctggatctaaaataggaaatacaacacacagaagcacaactggcaaaatccataaagtgagagaaatgactatttcttcaacaaataaatagaaaaaaaaaaaagaggaactgttatgattaaacttaaaacaattttttttaatttttaatttcatgggtacatagtatgtgtatatatttaagaaaaataattaacattaaaactatgtaaacctggtttggatcctgatttaaaccaactgtaaaaagacagaaaataattgaagaaatctcaacattgacaggatactggcaatattaaggaattacttttttttcctttaaatctgaaatagtattatggctatatttctttttaaacactcttaatttacagatacatactaaaatatttatatatatgaaatggtatggtgcttagatttgctttaaattaacataggtggcaatgtcagcaaggtggtaataggcagatatgaaaaaagactgcctgtacactgaaggctgctgaagctggatgatggataaacatacacaggtttcattacgctattctcttagatttgtatgtgagaatttccatttaaaaagggaaggaaataaaggagtgagggagaggaaaagtgaaagagaggtggagaaagaaagaaagggaagtagggggaaggctagcttgttagctaccataaagaaaatataaaaaatagaaataattacacaacttagaaaaatgaagcaactatttgcatcgtatgaaaaggtatcttatctccaaaaatcagcttttatgtaaaatctacttccgtgtaacatctttgaatcttcttgtgcctcttggggccacagaaaacaaatctatatgacagtctcttaagcatttgaagaacactttattcaacctgagtcttcttgtcttcaggagaaacattccctgctcctctgaggtatatttttaaataatttcataatctgcatttctctctcataaacttctagagcaatgtcaaattgccggaaaatgctaaattaggtctctactcttctgtacaaatagttttctttactccaagacaggaccgtgcacatgccctgattatgtttccaagtctatttggttaagatccttttaataatccattctagaattttaccttggatggaaatcaagtttaaccatgaatccttcaaatatttaaataccggttgggcacagtggctcaagtctgtaatcccagcactttgggaggctgaggtgggtggatcacgaggtcaggagatcgacaccatcctggctaacgcagcgaaaccccgtctgtactaaaaatacaaaaaattagccaggcatggtggcagacgcctgtagtcccagctacagcaggaggctgaagcaggagaatgccatgaacccgggaggcggagcttgcagtgagccaagatcccaccactgtactccagcctgggggagagtgagactccgtctcaaaaaaaaattaaaaaaaaaaaatttactgtattacaagatgtttactgaaagcattattgaacagtattaggtcagttttatgctataataaagtagcagtttacatgcattgcatgtataataggtagtgcactggggttcttaaaccatgaacaattagtgttcatagtgtatttatgtctactttacaaaacctaagaaaacatcatgtctttaaaatgattatagagatttcattatcactgccttatatttaagatatgatatatagtgctaaatatttgattgtgtgtgtgtatatatatatacactcctcaattaaaacattgttcctatggggataatataatgatccacttcacaaaaataccacgatgattcacatgaggtttcagcctacagtctctaacaaacaagtggggaaaattatatattgtcaattctcattattcagttattcacagtagttatgttaagtcgctagaaacacggaattagcaaatactacactcaaccactgctcctgggagaaatatagcgttagccagcccctggccacagcattgtcattaatgcacataaccctgttttacgtgtgtttctgtttaaatgtacgttttttgtgtgtgtccttccaacttttattttaggtacagcgggtatacatgcaagttggttatgtgggtaaactgcatgttgtgggggttcagggtacagattatttcatcaccgaggtaatgagcatagtatctgataagtaacttttcaatcctcaccttcctcccattctcaagtaggccctggtgcctattgttcccttcttagtgtccatgtgtactcaatgttcagctcccacttataagtaataacgtggcatttgtttttttgttcctgcgttaattcacttaggataatgggctccagctgcatccatgttgctgcaaaggacatgattttattcttttttatggctgcatggtattccatgatgtaaaatataacttatttaatatatgttgttgattcattaacattgaactcacagccaacagcagtaaaactcatgcctgaacctaaaacatgtttttcccaaaaggcacatcacagcattctcacacttaggaacactagacagcactatgcttgggcgccattttaaacagtgagtgggagggactgtacatcatggtttgagtgccagctaagacacagtacaatagaatatcagacagatttctaaggtttttgacctcagtccctggctcccagatggcatctctagaccaactcagggcctaggggaactagccaccctgaagggaaaaaaaaaagtctggctggcttcaccactgagatagatggagtaagatggctgaaaagggggctctagtgatctccccacccctccccaagtttggcaactatctacacaaagtgagcatcttcataagaacccaaaatcaggtgagcacacacagtgcctggttttgacttcgcattgctgaaataggcattaaagagggtagaaaagacagttttgaattgccaatgacacccctccctaatcccctagcagctccccacatggtgcaaagaactgtgcaactgtaagacggagagcatagcaactgtgagcctttgcattgaactcagtgctgcccggtcacagcggagagcagaaacaggctgaactcagctgatgcctgctcgtggagggagcttttggaccaggcatagccgcaaggaaattgtccatcccagcagtccaaatttgacttccagcaagccctgtcaacacgggctgcagtgttctggggccctaagtgaagctgaggggcagtctaagtcacaggactgcaattcctaggcaagtcctagtgccaagatggacttggagtcactggactggggatggggagcaggcaacttcctgagccaccacttgggtggctaagggagtgcttgagtcacccctctcccaacttcaggcagcacagcttaaggctccaaaagagaccccttccttctgcttgagagaaaagagcagagacaacttggtcttgcatcttggatacaagcttagccacagtaggatagggcaccagtcagattcgtgaggccccccattccagaccctagctcctggacaatctttctacacacaccctgtgccagaagggaacctgctcccttgaagaaaagaacccacccctggaaggatccatcacctactgactaaagagcccttgggccctgaagaaccagcagcgacacccaagtagtatgccacctgccttggttgagattctgagatgtgctggcttcatgtgagaaccagcacattcccagctatggtggcaacagtgacagcacagttggggtcggggggcggggggctgttaagtagaaagtggactctcggggtctcctattccaaggcttggcacttagatgacatttctggagctgtcctgggagagagggggcccactgttctgaagggtgagtctcaggcctggcagctttcatcacaagctgactgaagagcccttgggctttaactgcacattggcggtagcctggcagtactccctgtgggcctctggtggtgacggccatgggctgagactccttacctgtggaaagaggaagagtgggaaggactgtatatcgtggtttgagtgccagcaaagatacagtacaatagaccctcattagatagatttctaaggtttttgacctcagttcctggctcccagatggcatctatgaatcagctcagggcctaggggaacctgccatcctgaaggggaaaaaaacaagtctggctggctttgccacctgctgactatagagccctagggccttcagcaaacataggtggtagccaggtagcagtcacaacgggcattgagtgagacccagtgctctgctggcttcaagtctcacctagtacagtcccagtggtggtgaccacaggggtacttgtgtcaccccaaccccagctccacatggctcagaggggggagagagagagagagagagagagagagagagagagagagagagactgagactccatttgtttgggagaaagaaaagagaagaagagtctctacttggtaatccagataattcttctagatcttaaataaaaccaccaaggtggtacctctatgaatccataaaaaatcatagcgatactgggattggggtgcaccccaatgcagacatggcttagatcacaatacccaagtcccttcgactacttagaaagccttccaaagaaggacaggtacaaacaagtgcagactgtgaagactataataaatacctaattcttcaatgcccagacaccaacaaacatctgcaaggatcacgaccatcagaaaacatgacctcaccaaatgaactatataaggcaccagggaccaattctggagaaacacagatatgtgacctttcagaaagaaaaatcaaaacagtattgaggacactcaaagaaattaaagataacacagagaaggaattcagaattctatcagataaatttaacgaagagactgaaataactgaaaagaatcaagcagcaatattggagctgaaaaatgcaacagacacagtgaagaatgcatcagagtctcttaatagcagaattgatcaagcggaagaaagaattagtgagcttgcagacaggctatttgaaaatacacagttgaaggagacaaagaaaagaataaaaaagaatgaagcatgcctacaagatccagaaaacagcctcaaaatggcaaatctaaaagttattggccttaaagaggaggtaaagaaagtgataggggtagaaagtttataaggtaaaggtatagtaacagagaacttcccaaacctagagaaagataccaatatttaagtacaagaaggttacagaacaccaagcagatttaacccaaagaagactaccccaaggcacttaataatcaaacttccaaaggtcaaggaggtaaggatcctaaaagcagcaagacaaaaagacacaaataaaatacaatggggctccaatacatctagcagcagacttttcagtggaaaccttacagcccaggagagagtggcatgacataaagtactgaaggcaaaaaaattttatcctataatagtacatctggcaaatatatcccttaaacatgaaggagaaagagggactttcccagacaaaagctgagagatttcatcatcgccacttctgtcctacaagaaacactaaagagatttctttaatcagaaagaaaagaatgttaatgagcaaaaagaaatcatctgaaggtaccaaactgactgataatattaactacagagaatattataacactgtacctgtggtgtgttaacgcttaccttaagtagaagcactgaaagattaacaaatcaaaaataataactacaacaacttttcaagacatatgcagcacagtaagatataaacagaaatgacaaaaagttaaaaagtagcagacaaacttaaggtgtcgagtcattggttttcttttaccttgttaaatttgtttatggaagtggtgttaagctgttatcagcttaaaataatgggttataagatagtatttgcaagcctcatggtaacctcaaatcaaaaaacatacaatagatacaaaaaataaaaagcaagaaattaaaacatatcaccagagaaaatcactttcactgaaaggcaggaaggaaagaaggaagttaacaatacaaaacaacttgaaaacaaataaccaaatgacaggagtaagtcttcacttatcagtaacaacactgaatgtaaatggacttaaaggactacaaccaaaacacatgcagaggctgaatggataaaaaacaagacccaatgacctgctgcctacaagaaacacactttacctataaagatgcacacagagtgaaaataaagggattgaaaaagatattccaggccactggaaaccaaaaaagcgcaagagtagctatacttacattgcacaaaatagatttcaacacaaaaatatgagacaagatcattatataattataaaggggtcaattaagcaacaggatataacaattttaaatacatatgcacctaacactggagcacaaagctatataaatactagagctaaaggtaaagatagaaccccaatataaaaatagctgtagactttaacattccactttcagcattggacagatcttccacagagaaaatcaacaaagaaacattggacttagaaagaaagatggcagagaggagaggagacagggctaatgtgcagctcccacttggatgggcagaatagcatgtggagactcacaccacaaactccggctctaagaaccactgcaggaacattaccaggaaaaccaaaataattcacagattctctgaaagaagtgacacatcgctgcaaattctgcaagacagtcaaataactgtgagttcccaaagtacaagagcaggaaaacctgtctccaaacacacatgtccactggggaatctgaaaatccagatcacaggagaaggatttaacctcacctataacaaaaatgaatacagggagccacatgaaatataaaggtagaagcagcagtgggaagagccttgtaagcacacccagtctccagctcgagcccagggaagccatccctgactgcatctgatagggccctcagggaaggcagctagcagaattagggaggggtcacagggtgaaaaaagcttccaactgaatttcataataatttcaactgggcataaactttcttcagcagaacccacagggtaaatgggaatcctccctaaatcattctatgaagccagtatcaccctaataccaaaaccaagaaaggagaggaggggaggggaggggaagggagaaggaaggcgagggaagggaggggagaaggaaggaaggaaggaaggaaggaaggaaggaaggaaggaaggaagaaaactacagatccctgatgaacatagatgcaaaaatcctcaacaaaatactagctaacagaatccaacagcatagcaaaaagataatataccttgatcaaatgggtttcacaccaggaatgcagagatggtttaacacatgcaagtcaataaatgtgatacatcacataaaaggaattaaaaacaaaaattgcatgatcatctcaatgatgcagaaaaaacatttgatgaaatccagccatccctttatcattaaaacctttagcaaaactggcagagaagggacatatctcaaggtaataaaagccatctatgacaaaccaacagccaacattacactaaatgggaaaatgttgaaagcatccccccaagaactggaacaagatctggatgcccactttcactatttctattcaacacagtactgcaagtcctagccagagcaatcagacaagagaaacagacaaccaaactgataaggaagaagtcaaattatccttgcttgcagataatataatcttatatttggaaaaacctaaagacttcagcaaaaaaactattaaaactgataaattcagcaaagttgcaggaaacaaatcaacatacaaaactcagtaccatgtctatatgccaagaactaacaatctgaaaaacaaatcaagaaactaatgccatttacaatagctacaaataaaataaaatacctaggaaggaacttaatcaaagaagtgaaagatctctacaagggaaactataaaacactgttgcaaaaaattgaagacgacacaagaaaaatgggaaaatattccatgttcatgggttggaagaatcaatactgttaaaatgtacatactaccccaagcaacttacagagtcaatgcaattcctatcaaaatactaatgacattatttacagaagtagaaaaagcaatctatattggtctgttttcacattgctataaataaccgagacagggtaatttatcaagaaaagaggtttaattgacctacagttccacatggctgcgaggcctaaggaaacttacaatcatggcagaaggtgaagaggaatcaaggaccttcttcacatggcagcaggagagagaagtgtgaggagcggaaggggaagagccccttataaaaccatcagatcttgtgagaacccattcactattacaagaacagcatgggggaaactgtccccatgatccaatcacctcccactgggctcctcccttgacacatggggataatggggattacaattcaaggtaagattttggtggggacacagagccaaaccatatcacaatcctaaaatttacaaggaacctcaaaagatccagaatagccaaagatatcctgagcaaaaagaacaagactagaaagaatcacattacctgatttcaaattatactacagagttatagtaaccaaaatggcatgattgtcacataaaagtacacatatagaccactagaatacaatagaaaacccaggaataaatccatacatctacagccaactcatttttgacaaagttgccaagaacatccagtggggaaagaacagtctcttcaataaatggtgctgggaaagctggatatccatatgcagaagaatgaaactagaccccgatctctcaccatatacaaaaatagaatcaaaatggattcaagacttaaacataagacctctactatgaaactactaaaaggaaacattggggaaactctccaggacattagaatgggcaaagatttcttgagtaataccataaaagcatgggctcctaaagcaaataaggacaaatgggatcacatcaagttaaaaagcttctgcacaggaaaaaaaaaaaaatcaacaaactgaagtgacaaccacagaatgggagaaaatatttgcaaactacccagctgacaatgaattgataaccagaatatataaggagctcaaacaataggaaaaaaaatctaataatctgatccaaaaatgggtcaaagatttgaacagcatttctcaaaagaagacatataaatggcaaatacacatatgaaaaggtatcaacatcactgatcatcagaaaaacgcaaatcaaaactataatgagacatcatttcacaccagttaaaatgacttatccaaaagacaggcaatgacaaatgctggagaggatgtggagataagggaatcctcatatactattggtgagaatgtaaattaatacaaccatatggagaacagtttggaagtccctcccaaaagtaaaaatagagctaccacatgacccagcaatcccactcctaggtgtacacccaaaagaaaggaaatcagtatattgaagaggtatctgcattcccatgttaattagagcactattcacaatagccaagatagagtagaaggatgaataccagaggctggggagggtagttggggcagtggggatggttaatgagtatcaaaaaaaaaaagttagaaaaaatgaataagacctagtatgtgctagcacaacagagtggctatggtcaaaaataatttaattgtacacttaaaaataactaaaaaagtataactgggttgtttgtaacacaagggataaatgctttaggtgatggatagcccatttaccctgatgtgattattatgcattgcatgcctgtatcaaaatatctcatgtatcccataaatacttacacctactatgtacccacaaaaattaaaaattaaaaaattaacaccaacaaaaatcacaaaaatgtgtaaaacctggcattaaataggccacaaaaggacacttatttatagcaggagagctgaaacaagaatgtagagcatcactttgttcgacttctactgggagcatgcatgtagggtgattcaaatgttccaccactttatacatgcctatgaaagaccgctagtactgattttgaagttaaaatgcatttttgcaggtaggcaaattcacaaatacataattcacgaataatcaaactcaactgaaaaatctctctttgtaaggtcaactgtagcacatggactttactctggtaatgaaaattacaatatgctttagtaaaacgctccatgtaattcagcagaaagtaatcaattaacctttattaatagtatcattctaaatacccaatatcattcatttttaacaagagcttttattagattgatgtgcaactttacataacaaggtagacttattactatgtagagtacatacctgcagcttctagtaaagcttccagtctagcctgtgtttctggatctactgtcctgaggtctgcaccatcagcagtacctgataagagcaacttggaagctgtttccagcattggattttccaaatcatcctgatccaaaatgaaagactccacctataaaacaaatgcaaaaagagggaggaagggagaaatgaacagcgaaaggaaaagaggggagagaaataaaaagaaagcaggggagggaaaaaatatgttaacataattaacaatggtaaacacagtgcaaccctaaaaagttcaacatgacatctaagcctgttgattaacaaaagaagaaatttttttgtggaagaattcaaaactttatttctcatatgcagcctaattttctttactaatattcttttctactttaatttggttattaggtatatgtagggttgagtgtgatgcttaggttgtgaaaactttaactgtgaatagaagacctaactaaatcagcagtttttaaatgttttgctttcaggactcaatgaagtactgaactcccaaggactttatataaaccctgtatttcttgatatttaccatactggaaattaagtaacaaatatcactatcaaaaaatcacattcattaatatcaccactgatttcatccaaaaagtctttaagtactggaaagctgtcaagcctaggcaaacaagttccaaaattctaatttttgcttcaaagcttaactttatcattggcaacaagtattgttgttttccttaaagtgacagactcacttcaaacatttttagaggagcatttgccaaatatccaagtttgataactatagtttttcgtttgtactttaccataaaaatgacatttcatgggggaaaaaaggctaattcacctcacatctaaaaaaattgcagttatttttcctccagacaaacactatactttttatatgcagcaaaagtgctttatgtgtacttcccattttgttacacacactaatattgaaagaacatgcattcaaaaggggagttttcataaaatgaataattttatcgcttcatcaagaatattcttaaactagcatttaattttttttttttaacttcaagcacgtggtagtgaagaatacaatcatatcagtacagtttgtttccatggccttcgggtccataagttttacccaccactgtttttgcaccatcatcgtaaatgtcaacatagtaaaaaagtcaagtaacatctcaatattatgataaaaatagttttgacctcatggacaccttgaaatggtctctgggccctgaggggtctatttactgtgttaagaaacactgatataagtctagccgattcaagtaaatttaaagaattagaaaataacaaactcctaagacaggggtaaagttttgttttgatattccctatcacagtgctacttacaaataggtactaaaacatattcttttctgcttagtgataaaaattggtaattattatataaaatatcactaaaatgatcagtttatttcacaaatctaaggtactactaacactgcaataaccaaaatagatgtaaaaataactaataagctagaatacaatcacgctcatgcctagtatccagaaggtcaacaataaaaaagacaacttaaggaataaatccttaaccatcataacctcagaaacgatactgttccatcttgaaaagtcaactatcaagtaaccaggaatactgctataattaatcaaaacatttaatactaaattttaaatctgggaagaaataatatgtttctctacaaagttccattaaactaaagcagtttaacgtggaataacatttgagatttcaaatattttatacacaaacacaacattctaaaaatattctgtaaatattttttaaatttcataaaattttgttctacattaactttaattaatctataactccttatggcaaggagataaaaaatacaaaaacaattttttaaaattatatatattttaaattatatatatatgtgtgtgcatatatgtgtgtgtgtatatatatctgtgtatatatgtatatatgtgtgtgtgtgtgtgtgtgtgtatatatatatatatatatatatatatatatttttttttttttttttaaagagacatggatagtctcactgtgttgcccaagctggcctcaaactcctgggatcaagtaatcctcctgccttggcctcccaagtagctgggattacaggcacacaccacgcctggctgattttttatttttgtagcaacaggatgtggaattcctgggctcaagtgatcctcccactttggcctcccaaaggacgggattataggcatgcactaccaggcctggctaattttaagttatctttaaaggtagtagtaaaagtatgagaaaggaagaattttaaaggctgactaaagtattatactttaggaagcaaatttttgggcacagcaaagagtgattcaaaattatagcagtaaaaaaatttgttttattgtcaaaggtccagaagatgagtctttctaaagaaaaagctgtttcctaatgaaattttctaatatctgaaatttattaaaatatttacaattatttcaatttaataagaaaagataaaagcaaataaacaaatgtatgaaattgaacaggtaaaatgaatagatgaaataccataatacaatattttaaatgaacattttagaaagtagaagacatcaaaaagcagtatatagttaactgattaatcaaaggtagagatcagaggtgctaaagatgttcaaaggagacactgcatgcataaagaataatataaaaggattttgaccaaaaaaattaatttgtataaaagaagagaaagaaggaacatggactggcaagtaaaaaatttctatgtgatagaacacagggttttacacagggttttactgtaggtttgaaaagataggttagaagttagatcacagaagatatcaaatttcaatcagaagcgactgtcttacacaaagtcccctatgccacagatatcctaactagcctggtgaaaacttactaggaaaattgcatttccatctcttgatgagatataataaacacagaaacatttactttctactgactttaagcttctccacaaaagttcttatgttattcttaggcccactattctcactatatgcaaaacttggtaacttaaaaaactgtaaattcaaatgactatgaaattcttatagacagctttagaaaagagaggggctatcaaaatgacagaaaagaacaggaatgaatatttattatttcctccctatccctcatttatgattaatgaaggagctactttcaaggacactgctaaaatatgaaggcctaagtaccagaattgctttagctgttacctatgtgacctaaccaagtctctctctcagccatctataactttagacccccaattctgcttaattttttcatagatttatcacacatgaatattatacatacagtctttctaagctctgtaaaaacaaacactttttttggtttagtcatgtacacccagcaattagaaatgtgtctaactcactgtcaggattcaagcaactattgaataagtcagaatctgtaaagaaggtgaaatttaccagatgattttggtattcttccctttcagattctaaaaggctctagtgtatttggagaacaaaggggtaatcacaataaatacatctaaaggtatattttatagatcttagaggagatacagaatcttacattaggtagtaggtggtgcaaaatgctatcttcattgatttattacacacacatttattgcaaacattctatgtgtaaaaaatactgtttaatactatgggagataaagaaatgcatgataccagccttgctatgtaggaccctacttctttaatgagtgtgtgtaaaaatgaaccataatacaggatagaaagtgcataaggtaatgagaaagaaaaagaggtataaaagttcagcgaggaaaaagagaacttcctcctttaattccagttcctctttttccaactagaaagagctcgcgttacattacaaaacaagtgaagagagactggcataaagagatgcaatcttataaacatacaaaaataagtattcctttattaaattatgggcatacacctctctgccataccacatccccagctgagacagttcagattaaaaactaaaatgaattttccctctgaaacctatcgcatttttattatattattctacagaaaaaaaatcattttgaatcacaaccaacttctggaacataacaaacattaaaaatggtccaaataagaaattaaaataagtatttgagctgggcacggtggctcacgcctgtaaccccagcactttgggaggccgaggcgggtgcattgcctggggttgggagttcgagaccagcctggccaacatggtgaaaccctgtctctactaaaaatacaaaaattagccaggcatggtggtgcactcctataatcccagctacttggaaggctgaggcaggagaatcacttaaacccgggaggtgaaggttgcagtgagccgagatcgagccactgcactccagcctgggcgacagagcaagactccgtccccaccaaaaaaaaaaaaaaaaaaaaaaaaaaaaaaaaaaaaaaaaatttaaaagaaagtattcgaaaatattttatttgaatgaaatatataaataacttccatgaagagagaagacaaaggaaagaaatgtccttactaaatgtattctctaaggggggaaaaaagttatcaaagttacaactggccttttttaaaagttgtatttaaagtggtttgaatgtgttgttttgaccagctggatattttatgaaatgatgtttaggcataaagaaccatcaaaatgcaagaggcgtagaaatcaccaggttcaattcagtgtttacacatgaaaaaaccagacacaaggacctttatttaaataggagatttctaaatacctagcaccaagagaccagttatccaattaactagctcaatatactttccaccagcaaatacaatgctggaataataaggggttgaactttcacactgctctgggaaaggtgactttaaattttacatttagggatcaggctgttaactacctgaacccattgtttaattactaaaagtgggacaaacaaacctaacatgcccccgatttatgcaacataaaatacacagcacctcctataaagaattcttgtccccccaataaacaataatctactagaacttttagacgtgtaaataacttccagtacatgaaaattagtaaagcaaatacaggaataagataaatcaatgtttctcaatgtaaaagcactattaacattttggaccagataattctttgttgtttggggctgtcttgtgtaatttaggatgtttaacagcaaccctggcctatactcactaaatgccagttagcaacactccttcaggttgtaacaaccaaaaatgtctccagacattgctaaatgttcccttagaagagaaaattaaaaacaacaacaacaaaaatcatgaaggagaaagaggttgagaatcactgggttaaatataagccaaaaaggaaagtctaaaatgtggaacattttgcagcaaaactgaccatttccttcaagtaagtagaatgggagcaaaaaatcttttttgaatagagtaagaactgttctgaattacagagactcgagagatataaccagcaaaataataggtcttacttaaatcctattcaaacaggacaactgtaaaaacagtatttttgagacaagaaatctgaatgtgaactgggtattagataatataaaggaattactttggttatgtaagaaaatatccttgtttttcagacatgcatactgaagtatgaaggaatagtgtcggaaatttgtcatcaaatacttaaagaaaacaaagcttcatggcaaattcttgaaaatgttgcatctgagaaatagatatatagagggtttttttgttttgttttgttttttttgagacagggtctcactctgtcacgcaggctggagtgcagtggcagaatctcggttcactgcagcctctggcctcctgggttcaagcgattctcccacctcagcctccttctcttccttcagcctccggagtagctggaaatacaggcgcatgataccaggcccacctagatttttgtgtattttggtagagatgagttttcaccaaaacacaagttttgtgtattttggtagaggtgagtttcggcctctcaaaagtgctgggattacaggcgtgagccacttttacccggtctatagagtttttttttatacgagtctctgtacttttgttcatgctaagtccttttaattttgaaagactaaaggtgatgacatttcactgtagaagttgcttttatttaaacagaaaaactattatttaacagtaatattacttagatttctaagataattagaattctttttcactttctccccaaattaagtctgacttaatacaaatatttaataatgaaaaccaaggtcttttaacaatggtcagagctgaatgaatttgtttgtcatta

SEQ ID NO: 600 - DNA, 237300 bp, Homo sapiens
atagatcagaaagcctatttaaaatgtattctaagcgttaatttttgggtaaagtgctatgagctaatcattaattacttctagtaagagacaggattaaatgtatgttgtacttagagtgattcttgggaaaacccacaggatacagttatatactatatattgttagagaaaagggaagaatgacacatatacataacaaaacatgaaaaaaaaatctattctaagcttcagatttgtttcataaaaatcacattaaaatatgacaaattttgaacattcttgaatgagaagcattttaaacaggttaaaaatgaattattcaatgattacctggaggtgcccatagcttgttctgttaagccaagttcttcactggaaactccgtctttaattataaggtcatcaataatgtctgcaatatcagtcaatccagtcatctggagcggatgtactgaaacacttcatttgcaaatgtaatttaagaaatataaatcagtatctacaacttaattacattaagcaaaaataaacatgtaacaaatgaacacaaaatgataaacatatatctactgttccttctatttctgtaattctagtatctctcagtgaaaaagactaatcaacaaaaagtaatgacttggtagattttctttaaaaaggaaacatatggtccagaagaaaacccctatagattctgtttaaatttaatccatatttatataagaaaatgtagtaaatatagtctattgaattctaactacttgtgctaaaacagtaagagatataacaatcctcaatttcttaaaaatattccatacccaatgaaaacttatattcctttaaaccacaaagatatatataatgtaaaaattcacacacatatgaacaaaattttcactatctacacccaactttaaagaaaattgtgaattaactcttaagatatttacctctcacacaattcatcactgctattcatacctaaaaaaaaaatcattattaataaaaattttgggtttttttttgctttcaattgttaatctaatttagaaattatataaccagaaattaaattaaaatacttttaaacttccaaattggtttatagatatatatttacagcatatttatcctcttcctgaatatgctatctgatagtgaatactgtctacatattttttgagaccatgtctcactctgtcacccaggctaagtgcagcgacatggtcatggcatactacaacctctgcctccgggctcaagcaaacctcccaccttaacctcctgaatggctgggattacaggtgtgtgccgcaatgcaggctaatttttgtattttttgtagacacggggtcttgctatgttgcccaggttggtctcgaactcctgagctcaagtgattcacctgccttggcctcccaaagtgcttggattacaggcatgggccatcgcacccagccagtataagattattactttttctatcctgagtactcagtgtaatatgtcagaaggcacaacccttctttgcttagtacacagtttagagtactggagtgcaatttactttataaaatatacacaaacaaaaaacaaatctctggtgatctgaaagtaatatattttagaaaatatcttatttaaatccgagaagcaatttacctgtaagaatgtgtcccaaaatataatttttaagtcttgtccagtattaactatatgtcttcagagaaaaacacttaatctattcagtcttctatatgtttcattctaaatgtttaattcttctatatgtttaattctaaaaacaggattgaattaatatagggaaaagtgttctgacatctcttctcaaaaaatattccttaagattttattatcttgagataaaccaaatctgtccctaagacttacacattcacatggttttaatatgaaatacctgttttcttgaaaacatattgttctatttaatttattaacctccaaatcaaggattttattttcgttctcagaatctgggcatttgtgggttaagagcaactaattcaatttaactaagagagaaatatttcacataaatctaagattagcgtaatagtaatagttctaccccttatagctttttactaggtagaaaaagatattaatcctatgtacttaggaaagagaaggtccattaaagagacactttctatcagtatttgagaggcccctgctggcctattcacgaaaaaaagcttgaaggattctcttccaataacgactgggctgcatatggggaagtaggtgagattagcgaagatggtgacctcttgggttaaagattgaagtgtttgtcatcaaaggttggtaagtaacaagttgccctttctcctattagtaacccaggatcactaacccacggccacagtacctgtttattaccaagtaaacgttcttaaaacattatgagatttatgcatggactttttttttttttctagctcatcagctattgttagtgttagtgtattttatgtgtggcccaagacaattcttcttccaatgtggctcagggaagccaaaagactggagtctagactttgacatcagacctagttatacctttgccttagactctggcaacactaaacaaccacgttccccctctcctcctcttttacccacctagtcactgagtaccatcagttactaattcaaaatgtctcgtttcttctatttctttcccacaacactagccaggccctcattatttcccaggtcagattttagtagcctcctcagtggtctctatgcctccattctatttttcctcaaaacctccttgttttacttctctgcttggaattctcccatgttcccaaggataaaatggagtgtaaacttctcagatataattagaaccctctaccatctagccatatgagtcctgtttaacctcatttgtcaatcctccccagagaagagaagagaaaagctatcagtgaccaagaaaataaaacaagattctcagatgctttatatatgatactcagtcttcacaactttgtgaagtggaaattattatccccatatgttgatgactaaaacacacatggcatctagaaagaactgagaaaataattacaagatttaaagtcagcttcttaataggttttcttttatttaagtaacagtaatgccatttaaaatagcatttttactgtttatatcactttaataatggtaatagaacatatactaaacactcagtaaaatcattttaattgaccatcaatatctgagagaaaaaaaatatttccaagccactgtcagtgattgaactgatgtatttactatgttctattattcataggacaaagtatattcattaggactaaagaataacagttttaattgctacctccaaatgaaataaaacaaaaagtggcactaaatccttctaaatctcaatctcctcaactgtaaaatggagataataatagtgtctacacctcatagatcaggcttaaaccagaatctatgcatataaaacagtgatgtttggcacatggtagaggctcaagaaatgatggctactattttgttttcaaattaaaattcaaagttcttataattggaagagttttaatttttcaatttttgtaaaaatcaactattacagtaattccagttgctatatatttcatattaataagttacaccaagatatgatacataattgcagtatgtcttatgaaggtgacaagatgtcacagttcttcatgtgactagcaaaagttttaactttccttcccctaaaataaatattacaaaatgacttcacaaacctttcataactatattcccagtaaatcatgttcagtaacattataatggagaataagagtatgtgtaaatgaaaaagtaaagaacaataccaggagaagtagtattctgatcactggaactggaaaggctgacagctgaatcggcagtaggaaacacacaggttttctgaccagaataattttctgttattgaaaattcaggttctgaagtctcctttttgtcactttgatcttcttcatccatatgggtcaaaaaacgcactaatccagagtatatattacaattaaaataaaatagtagaggaaaaaagatcacatggaaaagacaattgccactatttccaactggcaacccagatattagaagtttgtcacatattatgctaatagctttctactgtataatgaatttaataaaaaatttgaagttaaagctctcccacagtaaataaacaagatttattagactgagctgaagtacataggcctatgccctttcataaaaacatagacatgctaaattacaaaaaaaaattttaatatacgaccaatctttctaaacagagaaatcccatggtgccagaaaagaaaaaggaactcatagctggagcagtaagtgggcaatgatgctgggatagtctactgaggaataggagatgtggttctgtacactgcaatgagggaaaaactgagctaccttcatgtatcttagagcactgaaggacagctttgtccataaaataggaaaaagaaaatctctcccctggtgaaacagcaaataagttttctatctgcatggacagcagctgagagaaaaataaaagtcaactttgagaaatcaacaccctgacttgccacaagcatgaacagggtctgaatttctaccatcaataaagtacagcaaccccaagtgaagaaacgtatactaaaatttgtttcaattttttcctacttcaacgatagcaaaaagcaaatgcaaaactactccaaagacaaacatataatctagcagaacttccactaatgataagcccatgataaaaaattacaattcacacaaaggaacaaccaaccatgaaagacagtcagtatgcagattcaacaattgataatgtgcacatatgaaatacaataatcagaaaaggttagtcataaaacatgactgaaattatgaaacagataaagcataggaacagcaataaaaaaacaggacacaacatccaaagagcagatagatttgaaaaagaaataaatacaacttctagatattaaatgtagccaccaaaattaaaatcataatgaatagctaaaacagcaaagacacagcaaaaaagagaattagtaaactagaagacagatatgaggaaatcatcctgagtgaaccactgataaagggaggaaattatgcagaagaggctgaatgagataaggaggccaggcacagtggttcacacctgtaatcccagcactttgggaggccaaggtgggctgatcacctgaggtcaggagttcgagaacagcctgaccaaaatggagaaaccctgtctctactaaaaacacaaaaaatttgccagtggtggtggcacacgcctgtaatcacagctacttggaaggctgagacaggagaatcacttgaacctgcgaggcaggggatgtggtgagccaagattgtgccattgcactccagcctggacaacaagagcaaaactctgtctcgaaaaaaaaaaaaaaaagatataaggaacagagtgaggaggtccaacatgcctctattaggtgttttagagagaaaagaaaaaatggggaggaagcagtacttcaaaatattatgggtgaaaagtccccaaagttaaatcttaaaactaaagaatcattcctactccaatataaggtaaataaaagaaatacggtcaggcacggtggctcacgcttgtaatcccagcactttgggaggccaaggtgggcggatcatgagatcaggagattgagaccatcctggttaacacggtgaaaacccgtctctactaaaaatacaaaaaattagcccagcatggtggcaggtgcctgtagtcccagctactcaggaaggtgaggcagagaattgcttgaaccctggaggaggaggctgcagtgagccgagatcgcaccactgcactccaacagagtgagactttgtctaaaaaaaaaaaaaaaaaaaaaagaagtggatgcaagaagcaactgtgggcaacaatagcagagaagagaaaataccagagagcatctcaggcaataaaaggtatcatgaaacttgttttggttttatacatttgttgcctacatatttacattatttaaattagaaattttaggccgggcacggtggctcatgcctgtaatcccagcactttgggaggccgaggcaggcggatcacgaggtcaggagatcaagaccatcctggctaacacagggaaaccaagtctctactaaaaatacaaaaaattagccgggcgcggtggcgggcacctgtagtcccagctactcaggagactgaggcaggagaatggcatgaacccaggaggcggagtttgcagtgagccaagatagcaccactgcactccagcctgggtgacagagcgagactctgtctcaaaaaaaaaaaaaaaaaattagaaattttaaaatgaagtaattgttggcaaagaaaatgccaaacgttgagaaatcttaactaagtgctgacttaaaaaataaaaggcaaggggaactaaatgggagggttaaaaacagagtagatctaaaatatttgaaaacagttatcagaggccgggcgtggtggctcacgcctgtaatcccagcactttggaaggctgaggcaggcagatcacaaggtcaagagactgagaccatcctggccaacatggtgaaaccccatctctactaaaaatacaaaaaattagctgggtgtggtggtgtgcacctgtagtcccagttacttggggggctgaggcaggagaattgcttgaatctgggaggcagtggttgcagtgagctgagatcacaccactgcactctccagactgggccacagtgtgagactccatctcaaaaacaaacaaacaaaaaaacagtatcagagaagatggagggaacaaatcagcgctaaaaaggtctaaagtccttctattgtttgggaggtagatatattcaccttaatttaaaatgaaaaaaattttaagagacggtgtctcactatgttgctcaggctggagtgcagtggctattcacaggtgtgatgatagcatactacaacctttaattcttgggctcaagtgatcctcccacctcagcctcccaaatagctgggactacaggtatgcaccaccatgtccaaattcaccttaaattttaactcacctatgaatgttaaaaattcaagaataaccactaaaaactaaaaatctaatgtataatttctgaaccaatacagcaggaaagagagaatacagaaaactccatccaataaaaggcaaaaaagagggacaaaagtaaaggaaataaatggcaaaaaaaccaccatgaaataagatattagaaataagcacaaatatatcagtaaatacaataaatgaacagtgattatgcttgctggttaaaaaagactgtctaattatttaaaggaatgaaatctaggtacatgctggacacaaatacaacataatcaaacagcctgaaagtaaagggatatctaatttacaagaaatacagaggagaaaacaacacattaaatgacatcacagagactcaattagcaaaactcagactctgaaaaacacttcagaacaactatcttgtttcttcaacaaagaaaacttcaaggaagaaaaaggagagaaggaacccagaagttaagagacttataagccatcaaccaatggccacttatagatcttagctgggttccaactgtaataattaaaaagcttttttttttttcgagacggagtctcgctctgttgcccaggctggagtgcagtggcatgatctcgactcactgcaagctccgcctcctgagttcaagcaattctcctgcctcagcctcctaagtagctgggactacaggcacccgccaccacaccaggctaatttttgtatttttagtagagacagggtttcaccatattggccaggctggtttcgaactcctgatcttgtgatccacctgcctcagcctcccaaagtgctgggattacaggtgtgagccaccacgcccggcctaaaagactattttttgaaacgagacaattggcaacatttgaactctgattagatatataagtatattaagaattttttaaaggagtgtcaatattattgtgcttatgttttaaaaatggacctgatcttttagagatacatacaaaatatttatacataaaataatgtgctgtctgggtttcgtttcaaaataatcaagaaaaaggtgggaagagtgggtgggtgtataggtaaaaaagggattggccatgagttgataatgattaaagtttgttgttgagtatatgaaagttaattgtatgattctgccttctattaaaatagtgtagaaattttacataaaattttaaaaaataaagcatatcaaaaagatataccagaacacaggggtagtaatgttcatattaaacaaaattgactataagtcaaaaaggattattagggataaagagggttattacttaatgataaaagagacaaaatccaacaagaaatataacaatcctgaactatattcaccttatagccttaagatgaatgtaacagatttacaaggagaaataattccacaatcattatgggtaatttttaatgcaaccttctaagaaatgaacggatcaagctgactaatcagaaaaaatacaaaaaatctggacaacacaatttagaagcttgaccaaagggagatatatacacatacactacatacaaccaacagaaaatgtttggcctcttcaaataaatgtggaacataatgtaaaaactgactatcctcagccacaagggaaattttaacaaatatctaaggattgatatcatcatacacatcagctaatcaaaatgcaatgaaaatggaaatcaaccacaaaaacatagcccaatattagaatgcttaatatttagaagctaaaaactccttttacaagctaaagaaatcataatgcgaactacaaactatgtagacctgaacaccaccagatgatgatgagtatcaacattcttgtctaggtccatgcagaaacatattcagcctcaattacacatattagaaaataagaaaaaataaagttagaaaaaagccaacaagttaatgcccccaaaatagaagaaataataaagattaatgaaaaaggaaactgagaaacaaagagaattaacaaacactggtttttgaaaagactaaactgacaagactgaatgagaaagagaacacaggtatgaaccacagacacagcagaaggtaaaaacaactattctaatttcattctttcaataaaaaatgaaaaaacttaatacctcaccactgcctggccattttaccagaacctcaaattccagctcagctgatgatcacagacaaacagcaacctcagcacaaagctctgtgcaatcctcagcactatgaggccaatggcttggaatccacaaaaactgagctccaggccacacttgccccatcctagtataaaatccagaggaggttactgccttctcaaaaaaaaaaaaaaaaaaaaaaaaaaaggccgtgaggtggaagctaatcacattacaaaaaaataatcctaatctaaaaactgggaagcttatgacttcagctcacataatgaaaactactcctacttctggcactccacaaaacaatgcacattctttcagatcaactaaagcaagacttcagccagcccctatcagcccctacaaaccttcttcagaaatgctaatggtttttgaagctaatgtttttttgaattcagggccagaagagaattcaatgtgatccactggtccaatctgtagaaaaaacacacacaacaaaacaacagtaatactttgataatttcaaaataacaaacagttttatgtaagttttaaacacttgcattaatgcaaaagtgaaaaaaatgggattaaatccaatataagctaaatggtagggatcaataaaacagaggaaatttttacttatttgtagcttaactgagttataaacttttaaaaggctcaggaaaattgtatcataaaattttagaatgaagaaccttaattactatctagacaaattcgtattaaagatgagagaacaaagcccagagagattcaatgacttttttagtggcataacacggtcaacccaggtcttcaagactatttaccactcagtgtctgcccagagtatccctgggcctcttccaggactataagctgttttcttaagttaggcaagtgaagatgtttgtatttatgtgtacattataataatgtgagagcattttttaaaaatataccaaacctgctgggcccagtggctcacacctgtaatcccagcactttgggagggtgaagcaagcagatcacttgaggtcaggagttcgagaccagcctgtccaacatggcaaaatcccgtctctactaaaaatacaaaaattaggtgggcatggtggcaggtgcctgtaatcccagctactcaggaggcaaaggcaggagaattgcttcaacctgggaggcagagattgcagtgagccaagattgagccactgcactccagcctggatgacacagtgagactccatctcaaaactaaattaaataaataagcaaattgtggtgtgtgtgtgtgtgtatacaaaattaacattatttccttcaaagtggtcattttagaagactaaatatcttccttttccctgggagatatgttccaagacgcccagtggatgcctgaaacggtgggggtagtaccgaaccttatatatagttgtccctcagtatctatgagggattggctcctgacatcaaaatccacagactcaagtcccttatataaaatggtgcagtatttgcatacaacctatagacattcttcccatatactttaatctctagattacttataatatctaatacaatgtaaatgttaactattaatagttgttatgacgtattgttcaggaatgacaagaacaaatctgcacatgttcagtacagatgcaaccatccttttttgtttttattaaatattttcaatccacatttggttgaactgtcagatgcagaacccatggatatagagggccgactgtatactatgtttttttctatgcgtacatacctatgataaagcttaatttatcaattaggcacagtaagagattagtaatagctaagaataaaatgcaacgattataacaatatactgtaatcaaagttatatgaatgtgttttttttctgtctctcaaaatatcttcttatactgtacagaaggtaacagaaacctcggaaaacaaaactgcaaataagaggggactactgtacgtaagggctttgagcaaatgcttttggaactcttcctttgaaattgtctcccaaccttgtaccacaattataaataactgttctactggtgaatctttagtatataaatgtgattttattagtgccagaatcaaaactaagatagcaaagacaaccattgaacaaatatttattaaatgcccaccatgtgtagcaaaagacattgtccctaccttcgagtcttaaaaggcttgagagaggagccctatcagaatttttgagagccttttcaaaatgccaagtcacctccacctccccaacagattcagcagggatagaatgtatactctgaaaaagcatctgagtgatcttgacatgcacaggagtccaaatgcttaatggactcagacatgtggaaactccctcctccaactcctgctttggctggctttctcctgagtctcttatgacttcagactgttctcaagtcttgttgaatactcatccttacaaggcagtgtttccacaagattctttaccctcttcttttctcctccatgtgctctccctgaggagcacctatgctatcatgatttgaacttccccctaactgattactccaaaatctgtaccttcagcccagttgtagctcctcagctgcttttgaggaactgcctacttatctcacagcacctcaaatttatcatgtccctgatagaaatcattgtgcctccctcccccaacacacacgcgcgcacacacacacacacacaactcctcctcttccttagtttggaaaatggctccaccattcacccaggctggaatctggacaccactgtgaatctctgttgtcttcttcaccttcccacagcttatcaatctctaagtcctgttaatgccttccctccattcttactgctcaaattcaggcatatggttatttcctgccatggatatttagtggatctcaaacacttatcagtggacctggtatagagctagcagcataagaatcatttgtgaagcttgttaataacacagattccagggctctaaccagacctacttaaaatcagaatttcagggaaatggggcccaggaatttgcattcttaacaagtttcctatatgattctaatgggcagccattagatttggaaccactgtgacccatgtggtctccttgttcccaggcttatcctttccaatctaccttccacactactgtctgcatatctgataatatcccttcactgtttaaaattcttcagtggtttcctactgcctgcttataggagaaaatcccaatcgcttgacatggtaaatgctttctgttcctccttgtctcccctctcctacctctactgccagatgtcttaaagtccaatcccactaacttctacctctaagtaatgctcatacagctccccaaacactctatgccatttggtacctttctcctttgctcacaatattttgtcagcctttctttaattaactgatgaataccaattcattaccagctcgagtcacctccacaaagcctcctctgatgccacagcttcacttaccccgtccagtcacaacatgtcaggcatatctatgtgcctcattagacccagtatgtatgtattcattggtatatacatctatcttcttttattagattttacactccttgagagtaggtactatgccttatttatctttctattcctagaatttagcacagggcctaataggcagtagttgctcaataaatgtttgttgaaggaattaattattcatgaactcctgtgagagtgagcaagccaggatcaagactagattcgggtataaatcaaatatctggctgtagataatgactactaaactagctcaaaaggcaatttcaaaagagattctttgaagtaaggagttccaacaactgctttgatgctgtacatttatttggatgtgacagatctaaatctgggtttaaaaaaacagaaagcaggccaggtgcagtggctcacacctgtaatcccagtactttgggaggctgaggtgggaggatcacttgggcccaggagttggagactggcctgggcaacatggtgaaaccccaaatctaccaaaaaaaaaaagaggaaaaccaccaaataagcatcatagtatcattacttagtattaatatttttagcagtagtcctgcctcataacctttcagtatagtttcacatatgcttaatctttatttttaaatgtgttaaatgtttggattaaaggtgtactataaacctaataaatacattttttaaatgtcaacatgctagcaacctggaatttttgtaaggtaagtcaataatggaattcttatcctgcagactattttgcatttcccaatattagactttaagacatttaactttgtttttttttaagaggcagggtcttgctctgacacccaggctacagtgcagtggcacaataatagcttactgcagccttgaactcgtgagcgcaagtgatccttccacctcagcctcccaagtagctaggactacaggtgcacaccaccatacccgacttattattatttttatggagatgaggtctcgctacgttgcctgggctgatctcaaactcctggcctcgagtacccaaccatggtctcatttaacctattatgtgtaacataatatttgttctttaatccttttgatataaattgttcttcctttaaaaaaaaggacaaaatgtgtaaaataatttttgagacttcctattttatttaactaccattatatatataaacattaatttattttttatgtctaccttttatagaaaactaggctggtgtggtggctcacatctacaatcccaacacttttggaggccaaggcaaggctgtttgaggccaagaattcaaggctagttcaagcaaaatagggagaactcgtctccacaaaaaaattttaaaaacttagctgagagtggtggtgcacacctatagtcccaggtactcaggaggctgaggtgggaggattgcttgaacctgagaggttgaggctgcagtgagccatgatcacatcactgcactccagcctggataacagagcaagactatgactcaagaataaaaagaaaaaaagatatgaaaaatttctaaggaactgattactaactctcttatataaaatatttaaaagaaactgacaaaaactccaaatagaaggacaataatatttgtaaaattataaaatctttcagagaaaaatgataattacaagtggggttcctttaaaatcacattctagttttgtaattcatgtatttcttttcttggtaggaagcatgggtttacttcctttttgtatgggaggaccctagacaaagctttatttagagcagaagatcagctgaatagccctatatctacagaagaaactaaatttatactttaaaatgtcccaacaaacaaaactttaagcatcttcagggaagatggcttcactgaattctaccaaacatttaaggaagaaatagtaccaatcctataaaaaattttccaaaatatagaagagagggtaatattttccaactcattttatgataatagcattatacatgggtttacttcttaaaagcttaaggtaattgttctcaactgagggtgattttggctcccaggaacatttggcattatctagagacatttttgactgttacaactagggagcagtgccactggaaaccagtgggtaaagaccagggatgctgccaaatatcctacaacgcatgggacagtcccccacaacaaagaattaactggctcaaatgtcaatagtgctgaggttgacaaaccctagcttaaagaaaacaaagttctcattattttgaaaaatcaggtatccaaagttatatcacactacaaatctaataattcagtagcaaacaaaaaactaaaaataaaggtagtctaccttatcacaatgtagatctagcatttcaggcttggggaaatcctgttctatgttttcagcaatgttctgtattgctagcaactgctcgtcaattttctgaagcttagcactgagatgctctagttggtgagctgcagagcttggtgcagggcaagctgcagagacaccttgcagccgtttccacaatagataatcttctgcagagtctgactttgtgctctgtcctttgaatcggaactctggttttggcagacctaaatattaataagaataaaagcagaattgattataattaaagaagaggtattattgatgatctcattttttgatgacttcattttaaaccaacacaacactactttccaaatcagttttaattaaatatacctaaaaattccttttcagcttcttgatttctgggataagaatacataaattactacaacaaagttccacaaacaaggaagtctgaatattactttcatcccttgctacaaacatatacttcatcaaaaagcaactttaatatttttatgactttttcaaattctacttgaaaaccaaaaacatcacacgttaaaagctatccccaatattggctattactgactttatatgagatctcaggcaaacattaaacctcctaaaaccaaaatcaaagccaatgactcttcttattcttaaactcagttgattcttctcccaaatttgcaatagttcttttttttttttttttttttttttaagagatagagccttgctttgtcacccaggctggtctgaactcctgggctcaagcaatcctcccacctcagtctcccaaagtgctggattacaggcatgagccactgcgcctggtctgcaacaccttttttaaatgcactctttttctgatgttggggtctcctcctcactgtattgctcatacttcttcttctgccatccattccttttacccataagtacttcctgggctgccagcctcaactcacttctctactcactcttcccactttctctgagttatgtcattgatgaaagatcccaaatctatatggcactctttcttagctccagctccttatatcctgaacatcccagttaggttgtcccataagcatataaaaatgaattcactgcttctgcccctccaaattgctccctcttccttgttccgcagctcagcaaatagcaccaccgttcagtttcacaagccagagaccagaaagtcactcgaggctcctctctttccttcagatccaaagtgacaacaagtattgatgattctacctgctaaacacctacattcttaataccactacttggctgaagctttcacaataaatagaccccaaatgatatccctatctgtaatttatctctagcctatctagtccatcttccacaccaggcccagagagatcttttaaaaacagaaatcatgttccttttctgtccaaaactcttcagtgtgtctccaataccttcaccttaaaagtccaaatgcctccatatgacagacaatggcacacataatcttccctctctctacctctccagcttcatctcttgctatttctttaaacgaacaaacaaaatactactccatttgactccaaacataatgaactttaattttcttttcttttctttgagacatggtcttgctctagcacccaggctggagtgcagtggtgagatcttggtttactgcaacctctgcctcctggactcaagcaatcctcccgcctcagcctcttgagtagctgggactacaggtgtgtgccacaacacctggctaattattctatttcttatagagacagggtctcactatgttgccaaggccggtgtcaaactcctgagctcaagaaatccacccgccttagcctcccaaagtgttgggattataggcgtgagccaccacacccagccaaactttaattttctcaaactaagcaagttccattaacttactgcaaaatctattctctctgtctgataaatgaaattaatctgtagcttatggtcatttgaaatgctggcctaacatactcaggggtcacagagagaaaagtaaaacgtatctaagctattaaatgacagagctgggattcaaatccaggtctgttctatgtgaatctaaaagccaggctcctttcactttcccacatacttcccctgtctgaaagattgctagcttcatacatcctccatccaccactcatgcatcttagcagccccatgacagaagagagaagatgaaggctttaaaatctgaaatgctggcacttgtttgtatatgcagctgttaatacacatgccctaacacatcctaaaccatcccttccttgctcctcatgtctcctgagtgcccactgtcattatacaataatcaggcagagctagactctgtgcccaagcatcttgcaaccacagggctgactaggtccatacctcacaaccactgtggaacctaggggagacttaggtttctgttgcaggaagtctgattgcatattggattaatctaaccagtcacaggatgtagtagcttcaggttgtggagggatattcttctaggctgggtgtggtggctcatgcctataatcccagtactttgggaggctgaggtggaatgatcacttcagaccaggagtttaagaccaacctgggcaacatagtgagaccctgtctctatgaaaaattttaaaaattagctaggcatggtggtgtgtgcttgtaatcctagctacttaggaggctgaggcaggaggatcccttgagcccaggagttcaaggctacagtgaactatgatcacaccactgtaccccagcctgaacagctcagcaagactctgtctctaaaaaacaacacacacatatatatgtattttattaaaaattttaaatatatatagtcttctaaatcttgcaaaaagttaccataatgcaacttgactataaaactgaatatttataagtactattgaattgcatacacctggccataaagatggaaacaacagacactgaggactacaagacagagaaggagggaggaaggtaagggatgagaaactacctattgggtactatgctcattacctgggtgatgcgtccaatcatacctcaaaccttagcatcatgcaatatacctatgtaacaaacttgtacatgtgtcccgaatttgaaataaaagttgggaaaaaaagtactgttggctaccatgcctgtttatttttggtgtgctatttgagaatttcccaccttttacaatatgagaattgctttctaacatcaaaacactcatgaactcacaaagaatatttatttttagccctattaattgagaaaagacatatgcataaacagatctgtgacttcttacaaaatatccatggttcccagctttggaatcatgtctctatttcatttacctacttgcccccatgctccttagcaagggacaaccctttttctggtttcttttgcaattaccaaattttggtgcttgtttccaatacaacagtaattcaggagagggtcatgctatacctcttggctgtttacctttgttctgctgtatgtctgatggtgtaggtgaggtgacactaggctccttcacttctgtaatgcctgctctcaagctttttccatccagacaagctggagttacttctgcaggtttagaaaataaatccatagaggaattggctgattctatcaagactatgaaaagcattcaaagactgattctaaacttctaaataaggtaatccgaagattaacagaacatttctgtgcatgtaaacatccaaaaatacagtgggtttgtaggaggagaggtaagagatgtgagtagggataacaatgctatattaaagaacttttcaaattatatttgttttaaaagtaggaaaaaattaccttgactcttaaaattatgtgggggaacagcattagtaactgaagctgccatataatgtaactctgcagacgatggaactgctagatgatcgctttgctgtttgataacattatcatttgaaggctcttctctcacaggtaattcctgtagaagatcattagcttcaatgtcaatcacatttatataagtatgtccaacctgagccaaaacacataaaaccaaagagggttacattctttttactctatgtggtcactccgccaaaaaaaaaaaaaaaaaaaaaaaaaaggcttaattcttcattcttattaaaaacaaggaaagaagggcctgaatgtgcctaacttaggaaaaggagcaggaagtatgtattattggtcttagtttataatatttttggcataatgcttaaattaatttttgaacctttactacaaagctacatagatgagatttttaacctcatttcatctacccaattgaataatgtctacatgaccataatacattttagcgcaaaggtattattaaaacttctgaataaaacacaaaccaagtttgttactgtatgaggtattgagggtgaccaaggtttctctgacatttcactggaaagcttcagatttagatagacatctgggaccaagagctgaggagcagtcaaaggctcatgttctgaaaattaaaaaagaaataatcaggaacattcaaaaaaaggctgtaaactgctccaaatcatcagctttgtatgaacaagttagcaacaaacaacataaattgtacttcttgaaatctaagtagaagtgacatgggtataaataattaaagcacattctattctaagggcaatttaaagtaattcataattgaatgtaagctgactattgtttctctcatatgaatgatttacaagaacaataaagtaactaaattacatcaagaaaatgctaaaatttcctatttccgtatcagatatagtaagtcatgcttgtctactttagggaagtttcaacaaaaccagattttagaagattaacctataactaatttttttttaacttgaacactttcttgttatttgcttatttttattgacagctttattgaaacataattcacattttttttttttttttgagacagagtctcgctctgtcacccaggctgcagtgcagtaacatgatctaagctcattgcaacctccacctcccgggttcattctcctgcctcagcctcccgagtagctgagactacaggcacccaccaccacacctggctaatttttttgtatttttaatagagacaggatttcaccatgttagccaggatggtctcgatctcctgacctcgtgatccgcccgcctcagcctcccaaagtgctgggattacaggcatgagccactgcgcccagctaattcacattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgattcacccgcctcggcctcccaaagtgctgggattacaggcgtgagccaccgcgcccggcctaattcacattctttaaaagggtatcattcagtggtgtatagtatattcacagagcctataattaaattttaccacttaaggtgttttaacatctaaatttcacaaacgttaactgcttcttatttaacagtaaaataaacaggcctgtcacagcagatcaacaaacagtttaactctgtgccttttgttctaggcctctagccttatcttctagcactgtattttcaataaagcactattttcaaatgtaactcatattgagtacttgttaccaaagcttaaatttaaaccacttaaaactagaaaaaaaaggaaaataaaaatactgaaatcattccctctctcttaattgattggtttaaccgcttttttaagggggatggtgactagctttggcataatgcagatacatctttaataagtcatactgttcttaggaaaaaaaagaaatcacacatgatatgcaagaaattatttgctgcttggtaccacattcagaaacaacttcttgagaagtagcttccttatcttgtagtacattaaaaatttaagacaaaaagagaaaacaaaaaaatttcacaaacacaagaaaaaattaaaatatatgaatacagataattagatattatgcataaaaggtgataggtagaaacaaagagtgacaacttaacaatgtaattttaaataattaatgtaatttcaaattttattattatttatatcttgggccttcacctagatgaatagcagactcaggaaacagctgccaacttcgataaactacttagcaacaaaagcaatgtacctccaaggctttctcaaagacatgcttagataatgaacatttaagaatgtttctcagttccgatgtggtggttcaagcctgtaatcccagcactttgggaggccgaggagggcaaatcacttgaggtcaggagtttgagacaagcctggccaacatggtgaaaccctgtctgtactaaaaatacaaaaattagccaggcgtggtggaggtcacctgtcaggagaccttggctatttgggaggctgaggtaggagaattgcttgaacctggcaggcggaggcaatcttgagccaagattgcaccactgcactccagcctccagcctgggaaacagagcaagactccatctcaaaaaaaaaaaaaatgtttctcaaatgcagagtcatcatttatatcaaaaccattttacatgtgctcaacttcattcagaaagaaatacaaattaaaataatgactttttttttttttttttggagacagagtcttgctctgtcgcccaggctggagtgcagtggcacaatctcggctcactgcaagctctgcctcccaggttcatgccattctcctgcctcagcctcccaagtagctgggactacaggcgcctgccaccacacctggctaattttttgtatttttagtagagatggggtttcaccgtgttagccaggatggtctcgatctcttgacctagtgatccgcccacctcagcctcccaaagtgctgggattacaggcgtgagccaccgcgcccagcctataattactttttttgacctatcagattggcaaagttaaaaagtttagctaaatcacagtaataaccaaaaaagtctcttatgcaggaagatactcattgaagcataatttgtaggagaaaaaactggaaactgtctaatgtatagctggaagaaggaatatgcttatgaagtacttttttgatgacacagggacatgtttgccatacatataaatcaaagtgaaatgaacaggatagaaaatacgggtatcccttgtaatgcaaatctaatccactcctgcaaatgtgctggatagtgaattttctgattccaggagactttatgacagtatttcaaatggaaataaaaaggtgtcctagcccatctaattttcccaaacatcattaaacaactcttaaataacaacccatcaaggataactacatataaagcattttaaatataactttttgattaatattcatttaattcattagttagcattcaatatgcaataatactgaacacattagagatgaattgccgtcaacattgtagcaaacatactatgatgcaaataacaaaataaataatatgttaaagatacactctaatttaagagcatcccaaggtacttggaaaaaaataacactgggacccaggaggattaaactaaactctcatggaaaagctagagaagatagccataatatctggacaatgagagtttagatagtaagggaggacacctatgctatatactgtatttaacaatgtaaaatgcacaaaagactgaaagaaaaaacaatatcaaaccgttattgctaagtggtgtgattatggttaattttcatcttcttcatagattgctaaatcacccaaatattctacaatgattacatttttaaaacataagataaagttaggctaaaaagcatgcacaaggttctgtacatgggtaaaagaaattgtttactaaaaatcataaaaaagaatttctgtgataacaatgggtagagcactattcaagatgctattcataatgataaataatattaaagaggaaatttgtcaggaaacattccaaataataggtcctccaacacttatttcctctgctcctggacacagttaaatacccctccctcaccgaacccagtccagtccttcctagctcaccttcactagccacaatcccaggcctcccaaccttgggcatgcaattccagtaaaggtaatcaataacatagagaatccaaattcaaagcattatatttactgacttaggatgtagtctatggcaattttgaagaaaagtgtctattatgttttacttaagttatcaatttgatttctacagtatataccaagactggaaagaaaaatctaggcagagtaaataatatcacataattaaaaattccctttaaatcactgtcttaaaggaaaagtctagataacttaattgtatcaaaatatatgaatttttttaaaaagtaaaacagcatttacctgggtctgtatttgtacttgcatcttgacttcctatagctttcttttttacagaggccatgaaatgcaatccagctgaagtattatcatcttgtagcatttcttaaatataataaaacattggaagtaatcattgagaagctaacagattaccaggagcccagcagcacagtacctaactcaatggaagtaaaatatggggtgtcaggatgttattaaatttttttttttttgagatggagtctggctctgctgcccaggctggagtgcagtggtgcaatctcggcttactgcaacttccccctcccgggttcaagtgattctcctgcctcagcctcctgagtagctgggattacaggtgcccaccaccatgcctggctaatttttgtatttttaggagagacggggtttcgccacgttggccaggctggtctcaaactcctgacctcaactgatccacccgcctcagcctcccaaagtgctgggattacaggcgtgggccaccgtgtccagcctaaaatgggctttctcaatgaagtgttatgtaagttgaatctcaaagacatggtagaatcaaaaccaaaactgttgaggactctgcacgtccagcttagaaacctagatattcttctggctaatgaagatccagtagaagctgttaagcagagaaatgatatggtcagattcatattctaggaaaacaacctagccagtgtgtggaaaataggtttgagtggatatacctagtaatggtgagggatggggaaacaggttaaatttaagaattacaaaggaagcaaaataggtaagaattggttactgaatggataagagggaagacagaattcagaatcatgtgtttctggcttaggctgatatcaacacaaatggagaaagagaacataggaggaaaaaacagttggggcagagtagaaataatgaattcagaattcacatggtgtacctgaggtaatttctacacaagtggaaaaactcaagaggaaagaaaatcaaaatccaaagtctactgtgagagtttgggtttacatgtggatttctctgggagatctcccaggaagactaggtagaataagaaagtattaattatggagcattgtggtataatgaaaaatatatatttggtctacaaagacccagtttcttgcacacaggtcctcagaatcttgggatttcctgataggagtgtctgttatttctaacgagccccttttgatcatacctaagtttatgctagaggtgtctctttgcaagcccttagatagcttcagcataggccctagtcaccagaggaaccaaccacatgatgagagggttagaactaccagcccccaattcactcatcctactgccacttctgggaaagagaaggggctggagattgagctcaatcacaatggccagtgatttaatcaattatacctatgtactgaaaagtcaataaaaattctgaagcaaacaggttaagggagattccaggttggtgaatacatggatgtgctaggagaatgaccatcccagagagggcatggaagccctgtgctgcccacccccaccactgcgtatcctttataataaaattgtaatcataagtaaagtgctttcccaatttctgtgggttttctagtcaattatcaaacctgagttgaggggggtggagtataggaacccttgaatttgtagtcagctgggcagaaatgtaggtagcctcattttcatattgtacatatttctagaaagctaattttaactctaaacttagacattacattaatcatacacatacataccaaaaggaacgtcgaagtcatccaaaggatgggaaccacaatgttcttgttgttcctaaatgaattcccacaggattactctatgattaactcaaagatgtgtattatttttgaaaaaaaaatcaatagctatgaagattgaattctcatgtataacttcaacttccatcattctagacataagtattctatcaaattatttactctatcaaagtaactctacaaatgaattcagaaaatacataagccaaacaataaaaaagagcattaccaatttaatgtaacgttcctaggttaccatgtgcaactctcttctacagagtagctttgataatactcaaatagtacaccatcctgtcaaaaatctttcatggactcaacaaacatttgtactaagtgcctctaaacatgctcttgaggactgactgaaaaagcatgccttttaaaaatcaatgtaaacaaaactattaatacgtctctatttaatctgttgttgcaaaaatagttagtcaccaaatatagaaggtatattttaaaagacctgacttaaagctgggcatgatggctcacacctataatccaagtgttttaggaggctgaggtggaaggatcacttgaggtcaggagttggagaccagcctgggcaacacagcaaggtcccacctctcaaaaaatattttttaattagctgggcatggtggcacacacctgtagttctagctatttgggaggctgaagcaggaggattgcccgagcccaggaggtagaggctgcagtgagctatatttatgccactgcactacagcctgtgcaacagagcaaggccctatctctaaaaaataataataaattaaattttaaaaaaagacgtgacttaaaatagaggttacacaacaaacctgtttgggaaatcctagaggaatctcagagaacggtgaaactgtattaggagaagcccaaataacataatatatatattaagatgtcatagaaataagcaaagggtgatttcaaatataaaaaagccacacaggcagatgctctaaactgcagtttttcatgtaccatcaagttgcttttcacattcagaactctatgtctactgctctgtggagggaggcagcagggactgatatactgaatgatatgaagatcctcctagtcacagtcagaagctcccagcaatcagactagataaaccacaaagacataccaaactcagtgtacatgcaaaccagggaagaatctatagcagtttttctataccttgggtttcttaatgatttctgaatcatcattattaattatggaattctctggtcgaaaagtcacatttggttttctcctcagtttctcacatcttttttcttgcagctctttctcagctcttcttctttgcctgttaaacataatagcataaaacatacttttacaactatagcaacatttgcttttcatttatcatgctatatagggatacagttgacaaaattacgttcataaattattttcaatagcatttaattaaattggcaagatattctgcaaatacaagcaaatataagcaaaacaccaaatgtgaaatttatttctagaacctctactactgaactgactattctatattagtcactggaatctaaggacaggtttacacaccttaggtaattattaaactctcttttctgtggatttgaagctggtgccagaaaccctatcagatacctccatttgtctatttgaagacattaagcacacttagtcacctcagcaaaattacagcaaggaggaaagaggtctcaaaatgctaaagggaagacttaatttgaagagggaatagatggaaacagaaaatttctggaaagagagcactagtgacagattttacagtctgataaatgtgaaattttaaaagtattttctagacttagtaataatctaccaatcaatatatgcggtaaaacactacagtaagtgctcttcactagaagtcacagccttgcttttcacatacacatttcttagtgccctgaaacaatttacatcacctaccctcctgcttactgtaagagtctaaagaatacggtaagatgattggttcaaagtattagatgatacagtagtccctgcttatccatggtttcactttccaaggtttcagttatcagagttcaaccatggttcgaaaatagatgagttcagtgcagtaagatattttgagagacagagagaaagagatcacattcttataacttgtattacaatatagttataattgttatattttattactagttattgtgcattgcttactgtgcctaatctgtaacttaaactttatcattggcatgcatatatagaaaaaaacaaaatatataatagggttcagtactatctgcagtttcaggtatccactgaaggtcttggcatgtattcctggggataagggaggactactgcatatgggatattgtaccaaatatttgagcagcaaatgactgttcatcctattaccgacactgtaaaagaatcctccagtctatgaatggtaggaaagaattccttaataaaatgggaaaaaattatagtatttgtctcgcaaaataggaatttttctcacataaaatgttttcagatgcatgacacttgaaaagaaaactgaatgtgcaattgtgtatagcctaggagactgaaccagattactgtgtgattataaataataatgaacttgctgatatatgatattatcaaataaaatttcacttaagccttgcctttttttactgtcctttccttgtcttacttcaggtggttctattttgacctttagaagttgaaggtgtccagcatcaccttgttcaaataaattatgtgttagtttctgttggctttgtttaaacgcaatgaggttttcaagtgggataagttgtgtttttttgcactacaagaaagaaacaaagcataagaatgacaaattgcaaactcaattatgtaatatttcaacaaaagactgaggaaaaatacatttgtttaaattaaactgtgcaacagttagaacaaatcaaatataacaaattgatttaaactggcaatatgagtatacatatcttagagaaaaagtgatttaaagtgctgaaagtttcaaatgggtcatcctatttcagaaattaagctagaagttctcaacttcctaatttcattcccttattaaaaagctttcctctggccaagtgcagtggctcacgcctgtaatcccagcactttgggaggtcgagacgggctgatcacaaggtcaggagtttgagaccagcctgaccaacatggtgaaaccccgtccctactaaagatataaaaaattatccaggcattgtggtgcgtgcctgtaatcccagctacttgggaggctgaggcaggagaatcacttgaatctgggagttggaggttgcagtgagctgagatggcgccattacactccagcctggtgacagggcaaggctccgtctcatacataaaaacaaaaaaaacctttcctcttataaatgaaattatataatgtccagcatttaacttaaaattgtttggaacagggaagatgtagaggcacaaaaaccacagatggaacagaccagcaatatgctgaaaatccctgaagccttgggaattgggtgataaaaacttggggttcttctttggctcgttatatgttcagaagaaaaggaagcatggtaagtattttttctaaggaataaccatttcctttcccagtaccatcttcaaatcataaaagtacaccacagaatgcattactcaattacctccctaagatagtactgctctcctcaaaactagagcctaaaccattttaatttcataaatcaaaagttatacctttaaagaggacttggtgggtttataaaactaccattttaatatatatgctactaatcacagattctgggtctatttaacaaatttaacctgtcaaagatttgaagatcatacaataattgctaggaacctcaaacaatatgtgtgctcacttgctctccactctacacacacataaacaagagcatctggtaatttttttgctttcttttttgagtgtttaaatctgacacagagtacctggtaattttacttcttatttcttcccagagcagcagaaatatttatgaaagagtccagtaaattccagtattgatagaaagacctaaaacctttaaaatacacaatttttttttaatagagacagcttctccctatgttacccaggctagtctcaaactcctggggatcaagggatcttcccatcttggcctcccaaagtattgggattacaggcatgagccaccatgcccagctacaatcattattttaaacctaatttttatatgctattttctataacaagcatttttttatgtacaagagcttttcagtgaccatacagtacttatggtatgaaaaaaatagtgcaggacactgcttttgcattaccatacaaaaattcattaccctattttctggggacaaatgtgaatgaagtaatgacaatcttgggtattttctttcttctgctataggttggataggtgttgagggaactgtaatagatgctcttgaggttgatggaaacatattaggaggtttaagtggcaggtatagtaacggaagtccaaaggaatggtgaggagatatctcaagggtccctggcttaacatcaaatagtttttctggttttataaacactgaagagtcctgttgaggtgtcaaattttcttgtccaacatattgatccaagttcacatgattaggaatttctgtaattacagtttctgcccacgtcttctgctcaacttctttttttctggcttcagtgttatactggcttacattcaaatgggatgctggagtagtttgtgctgctctctgtggcagagcaggttggaaggagtcagataatccccaagcctctcttggttgtggcaaaggcctgaagggaacttgtggaatacttcctgtatgtaagaaaaggggctggaattcttgtttagacttaaattgaagcaaaggaaagccatcaccaggactaaatgtttttgcatgtgggataagtctaggtgccttctgaacaacagaaggtgtggacaaaaggtagaggtgagtatttccagcaggagctggataaaacgaagtggatggtaagttttgagatgatggaattggtccttttttccggggctggccatttaattgacataaaggaatactcccatgtggaacattctggaagagaaaaaagatattatgtaagtttagaatatattagaaattccttcctttgtaaatggcattcagtatgttttgcagtgggtagaatgtagtaactgctaaaaaaaaaaattatttattcaataaaaaacacgatgactattgaactactcaggacattattatttttttttttctgagacagagtcttgctctgtcacccaggctggagtacagtgacatgatctcggctcactgcaacctccacctcctgagttcaagcgattctcctgcctcagcctcctgagtagctgggattacaggcatgcgccaccacacccggctgacttttgtatttttagtagagacggggtttcacgatgttggccaggctggtctcgaactcccaacctcaggtgtggcctgccaaagtgctgggattacagacatgagccaccgcgcccagccattaatggtatttttacatacattacctgtacgtttccagtactattttgaccagatgggatagttccttcatggcagtgtgggctgttcttgcgaggctctctggcgttctctcccattgactgtggtttaataaaaaatctctccttaagatttttgttgctgtcttcaacatcaccacatcctcttaggtttgattcttggctttcccctaaatgcacagactgagactgctgtacaagttgttgtgtatctgggagattagcaaaggatgatcctactatttgcattaggctcatgaagttgatctgttgcagcttgaataaaacaaaaattgaagcgatatcttaaaatataacaaaaagaatctaaggaataacaataatcatctgagtattctacaatagtcacacgtttgtcttaatatctatgagaatcatgaatgctgagcaggaggcagtcagggaaattttttttttttttaaagggagaggaaaaaaatgataacttcctgtcaaccaggcatatgaatactcacttgcgaatgaaacttggaactatttgtaaacagtttacagtattcagtttccataaacatcccagggatcaaaggagtgggataaagacagattctcagaataggccgggcacagtggctcacgcctgtaatcccagcattttgggaggccgaggcaggcagatcatgaggtcaagagattgagaccatcctagccaacatgatgaaaccccatctctactaaaaatacaaaaattagctgggtgtggtggcacgggcccgtagtcccaactactcgggaagctgaggcaggagaatcgcttgaaccagggaggcggaggttacactgagccaagatcgtgccactgcactccagcctggtgacagagtaagattctgtctacacacacgaaaaaagacagattcccagaataagtatattttggacagttttcagcaatgagcagaaagcagtacacaggtgaagagcaaggaattcccttggaaacgctgactaggtgaaagtagtcagacaccagttgtccccaaactttgctgcacattacaatcacctgagaagtatttataagtcccgatgaccaggtcactccctatcaataatcgcaatgtctgaggataggaaccagcatctgtattcattaagatgaccaggttatttaaatgtccagaaaagcttgggaagcactagcatagacattggcttagctggaacaagagatttacagcaggcataatgaaaagataggctagtacagaagttcacaaacttcggcatgcatcagaattacctggaggacttgaacgactgctgatccctatcccaagtttctgattcaacaggtctaggatagggatctgagaatttgtatttccaaagtctaagtgatgctgatactactcgtccaggcatcatactttgagaaccactagacttgtgaaagtaaggcaggaaaggagggaaggtaaagacttcaaagtgaagtttttgaaggccaacagaagaatttgcatttgatagaacaaaccaatagggaaatagtgcaggttttaaaaaatgtagttttcttttaattataaagtaaatacacacaggaaaaaacagaaattttaaaaataaaataaatatcattcataatcctaccctcaaaaataatgagcattgacattttagtatatttcctttctctagcttactctctctctctctctctctctctctctctctctctctctatctatctattctatctaaaagacaaggtctcaccctgctacccaggctggagtgcagtggactgatcatagaccactgtaacttcaaattcctgggctcaaagcatcctccaacctcagcctgccgagtagctgagactataggcatgtgctaccatgcctggataatggtttgctttttgagtttttgtttgtttgtttgtttttgtagagatgaggtcttgctatgttgtccaggctggtctcaaactcctggcctcaagcaatcctcctacctcagccacccaaagcactaggattacaggtatgagccacctcttataaaatttaaaaatataaagaggctggcttctttctatttttaaaacaagattgatatcatatattatacaaatttgttcctgaaatttactgaagatttttaaacaggtgactaatattattaaaataatacctgaagaaagtgtcctagaatatagaagacaatggaagaacaaaactaagaatctaaggttagccactgctatagaaatagcaagtggctattaccgacatatagtatgggcaaaaaattcaagagggcatagtaaaacactgggtaggggttgtgaaagaaggcaaagatgacttttgaagatagtgattcttaatcttttgtgtgcatcagaattatctggataatgtgttaaatatataggacagtgaccagtgaagtccccaagtaatccatctaacagtttgagagatgtctctaaaacattaagatggtagaatcagtggtgctactaaacagaaaaaggaaagaagggactagggagaataagaataaaattagtttcagtaagtttcatgggacagggggacatgctgaacaactattctcatcaaggcccctaagttcaaagagaaaattagtgcagctgggcacagcggctcacgcctgtaatcctagcactttgggaggccaaggcaggcagatcacctgaggtcaggagttcgagaccagcctggccaacatggcgaaactccatctttactaaaaatataaaaattagccaggcaaggtggtacatgcctataatcccagctactcaggaggctgaggcagaagacgcttgaacctgggaggcagaggttgcagtgagccgagatcgcgccactgcactccagcctgggcaacagagtgagactccgtctcaaaaaataaaaatataaaaaaaatttttaaaaagaaaattagtgccgagaatcatcaatatggaaatggtatatattacatcacataaaaggatatggaagtgaatgtaggacaaatgagcagaggtttagatctgaaggaaactaatgtttctaaaaaggtaaataattaaccattgttggtaaacagaaaaaaaggatagccaggtatgatgaaagtcaaagtgaacagtaatttgaaatgcagctgagagtttcaactcaagcacaagaaatatggataagaaatatgtgatagtgtcagctggaaaataaaccttggatacttttgagtaggagcccactaatctggtttgattactccccacctcacttttgtgagcagctgcatcccaaagagctcagtaaaaataggtcattgtgagaagtaggtagcttagcctagacctctgggccctagaggtcttttttttcctagtagaatttttttttcctagtagagtttcctagcagagtctcactatgttgcccaagctggtttcaaactcctggcctcaagcaatcctcctaccttgacctcccaaagtgctgggattacaaacgtgagccactgcgcccaaccagttataaacatttgaatgaaaagtacccaaagcagagaaatgcttgtgatataattttaccttgtcaatttctggaaatctattaatattttaaaaccctacatgtacactatgtgtagatttacttacttatatagagatgtgcttacctgaactaatttaaacatttcatcttgcagcatctgcctaacggactccgaacaatctggtaactgagccgtgaattcatttctctgggtcttctgaggtgttggagcaggtggttgtgaagcaacattgactccatttgatatcagaagtggaactgaggaagatttttctttatatgtagaaatctgtgcactgcgtggaaagcatttaaataaaaaacatgcattaaaattgacaaaaaacaaattgaatgtctatgatcagaatattttgatcccacttttgtcttccaatttaaaggttattctagtagttttctagaaatttaaaccctaaagcctttctctctagtgcccgtcagccccccagacacattcgtcatcagctcaattttcatctttattaagggattgtctagtcagtgatgggctccttcatagggtgttgcaaacccaagagctgacatatattttacttgcctggtccctgtggacatctgaatttgagacctgtggaatcattctgattagctgtacagacttcacaatttgtaatttggcttagaaatatgtttttgactaaaattaatgatccagcatagagttaagaaaactacggaaaaactgggtttaaaaaacttaattctaggatcagtagagaaaactactgtttatcatcattaaatgtgaaacaatagtactgtgaacatttcatttccaagcaaacctcagagtttaaatgtaccataaaccctaataaaaaatgcttatttacaaataaaaattaaggatcaaagcaaggtgtttaggttttttttttaaaaaaacaaaatgactgttgggggatgactcctcaaacatagcagatactcaaagttttctacattttataaactaagcaagggagcaggcagttatcagattcaaacagatcactgtttccaaaaaagaaaagaacatattaaatttcatatagacttatttaggtttacactcattcccatttggcaataatatttgccttttatcgagcatcttaacacacccaataaaaaaactttatttggcaaattcacaaaaaataggcattacaactgatctatcttttccttttctgccaaagtgaaagctttgagtgttgctccttgagaatcatgtttctcacagctgctgccagcctccactgtccccagctttcttagctgggtgacaagggagttagttgcccagtgacagggatctggaatctaaagagtaagcggagccaaagaaggtttaggaggcaccctctggcgactgggttcctgaagtgtgatggaagggggaatgggtttcaggctgacccctcttcaggcattcctagtaaagccacaaggggctccagggctgtagaggtccccttgggcacagggtgggtgcattcatgcttgcacaagtcactggcactcaggaaggccttgggacagtaggggcaggtataggggtaaactgagctgtaggtacagctggatgtgcacagcccaggccagtctcagaagctctttaaactgagtgtagcaaaagggccggatctgggtatgaggactcatgcagacgcaacaacattttgtgaagaaggtctccttgcacaaacagatctgcccattttaaaacaagtttattgggctttgctttcaacaggtctcaaggagatcgattctaactatgaaaatttttttctgaggtaaagctgtgctatattttcctatttcggcaagatttctaaacactaagcactctgttcaaaagaaccggatgagtctgttctgtgagagaattaaaagcatttcaaacactacaagaaatcagttagaagctgaaaatgagcaacaacttcatctttcaataatatatcactactttttttcagaaaagactgttcaacatagttcctgtgtaactttaaaatacaatcgctagtggaaactcagtaatgaaagatgtcagatctgtgtgcttatgctgctctttcaatgttttatgttgctttcatttttcttagtttttagtcaaaatgtagcaattgtttcaaaaatggtacagtcggcatactttcactctgtgatttgtaaaacacaactatttttaaatggtatagtaggcaaaacttcttacctagaaatttctgaactcgtatctacttgcattgattgaggagtggtatgcccaggatgtgaaaaggcttcgatcatactatcaataaaaattaacaggtgattagtaagcaagatattctttgcattatctaaggtatgagtgatctatgctcagccatctaagagtctaaacatcctctaatcttctataatgtttagctcataattacaatctgtttacatttgtctccatagcaattagtaacagatctaagcaaaagcaaaaaaatatgtctggatgacttaaaacaccacttaaatacggctgactgctcagcaatgaaaacaacagaacccaaaatgaggggacatgaggttagttaagacccaaatttcacctatagaagagggagacactatgctcagaaccctagagcccattgtcacatttgaaactgtaaagaggctgggcacgatggctcacgactgtaatcccagcactgtgggaggccaaggcaggcagatcacctgagctcaggagttcgagaccagcctgggtgacatggcgaatcccatctctaaaaaaaatacaaaaaaattagctaggcatggtggtgcacacctgggcaacacagcaagaccctgtttccaaaaaaagaaaagaaagaaaagaaaaaagaaactgtaaagattagtgtttgtcttctctctctctcttcttgggtaattttccgaaggaatcatttttatgaatagaagtatctaaattacttgtaaaggcccatagtattaaatgcattctttttaactgtccacagaaaaactaacaaaatttgcatactgaacagaaaaagaaaatctaattatgttgccttttttttttttttgagatggagtcttgctctgttgcccaggctggagtgcagtggcctgatctcggctcactgcaagctccgcctccccgggtcatgccattctcctgcctcagcctcccgagtagctgtaactacaagcgcccgccaccacacccagttaattttttgtatttttagtagagacagggtttcaccgtgttagccaggatggtcttgatctcttgacctcatgatccacccgcctcggcctcctagagtgctgggattacaggcataagccaccacgcctggccatgttgcctttctgatctaagggaattctaaaatttagaacttctaaaattctaaagatttagaaatcatgtccaaactgcaacacatgaaaactgccttcagctctccttgaagcaataagctagccggcagtgtatgtgtacatcatagccctaatgaatagtgtatagtaatcatcacaacagtgaaagattttatacatacataaaataatttataatcattctttatttgattcaataaaaatggaataagtatgaaaagtggttccctacttagcagctaaataagctttggcctatttacagctttattttgataaggctgatagtgatgagagaacaaaaggcattttagatatcattatttatttcactctatcaatacatagaagtataacatttaccaaaaatcattttaccataactataaactgaagttacagtttcactagaaacacaataccaccctaaatcatgtattgtaaattatgaaggaaaaaagctgaaagcttcactgaggtaaccagtgacaatcactgtcatacttttttcccccttaccctttttgttcagtcgatttttcctccataattgtctccagtggttcttccctttgacactgaacctcttctgtgaactcctgttaaaatgaatagtacccaaaaagaaaacaggtaaaacaaataggtattactgtcttgagtattttgagtctcatattagccacttaaccagagtaacaacagtctacaagcaagtgagaaatcaaacagtaaaatgtactcccagtcctgctctgacctaatctttatactgtgtgaattgcctccactctgtcacactgggctattgagcatgctaagttacaaagacaagattgtgtcagtagactaacacactgtaaattatatacacctaacactatatgattattcatttccctgtaaaaacaactataaaaccaggaaaaatgaatcttttttgaaagaattgttacaaggcaggcagatctacttgaggtcaggagctcaagatcagcctggccaacatggtgaaactctgtctctataaaaaaatacaaaaaattagtcaggcatggtggcgcatacctgtagtcccagctacttgggaggctgaggcagaattgcttgaacctgggaggtggaagctgcagttagccaagatcacaccactgcactccagcctgggcaacagagcaagactgtctcaaaaataaaaataaaaataaaaataaaaaagaattgttacaacagatagggcacggtggctcacacctgtaatttcagcactttgagaggttgaggctaggagttcaagaccagcctaagcaacatagcaaggcccagtctctacaaaaaaatgtttttttttttttaaattagctgggcatagtggtgtgcacctatagtaagacccagctacttgggaggctgaggcaagaggatgactttattccaggaattccaggctgcagtgagccatgatcgtgccactgcactccagcttgggcaaaagagcaagaccctcatctcgaaaaaaaaaaacaaaaacacagaattgttacaataattggaaatgtctatgttccccctggaaattcagtgtatagagttttgagaaaaataatatcaaaaagtatatatatgtataaaaagtatactacagctgaattatactttttaatttttttttttaaaagacagggtctcactctgttgcccaggctggaatgtagtagcacattacagctcactacagcctcaaactcctggagtcaaatgatcctctcacctcagccttctaagtagctgagactactacaggcgcatgccaccatgcctggctattttttaattttttgtagagatggagtcttgttctcttgaccaggctggtctaaaactcctggcctcaagcaatcctcccgcctcagcctcccaaagtgctgggattacaggcatcagttgccatgcttggccatacttccatactttttaaataaaggacacatttgctactcttgattaaataaatttgctaaagcagtttatgatgtgaaaacttcattgcctgaaattattggacaggttactacactgtactagaatttcagggaaagaaaaatgccacacagcatggctatattctacaacccatggtgcatttttaagagctagccctgctttgatatatttaataacaatgaataaaaacatgtataatttaaacactatacaaaatgaaagaagaataattatatccactatttattgacttacttcttctaactgctgtggtaaagtcatcatgcaaatggcaagactgggacttctgaaacctccaacagattcttcaatgtcttctagcgataagtgaagatgaagagaaaactgatcatttaaaaaataagctattgactttttagggggctcagggaatattaccagaaacaatataatgacagaaatattttctatcctttttataaagacagtctttgaaaacacctggagtctattccatcttcatcaggtaaatcccagatgagccttgagaggccttattattcagtatgtttaactccacgtagtgctctgagagtttctgtcttaaggaagactgctggggagaggtttatagagttgcttcacagaaattaacagaccataattattatataagcagcacaagacgcccaataatggtaaaagagcaccaacataaaaataccttagatcttcttggttttattaaaaccaaaattagagttaatatgctcaatatttcataaatatttaattctcttaattttttattttaggctactgtaaacatactaacttaggtataagactaaataagttacctcagataatattatttaccaatttcaaattaataaagccaaaaaaatagattatctaaatgaactgaccttcatagtctgatatgtgcatatccatttcctcttctgtaaatgcttctacttctaaaagattctcatcaatatctataaattcttttttagtattatgagtgatggaaataatatcatcattgatttcttttatatcaggattttttgcttcagttggcattctactgaaaaaaatgcagcaactaaaattacaactattcttggagataaagagctaattcagttttgggttttttttttgtttttttttttaagatggagtctcgcccaggctggagtgcaatggcgcaatctcggcttaattcagttttttaaaagcaaagaacaaactttggtttcatatttataaaatctttctttaaaaaattctgatacacagaagctcaggtaaagattgttcagtaaataactaaacatcatagtttttatttactcgaatgattggaataatttcaactaaaattatcattctcacaaaggactcttcatgctataatgggttttgccttggtattcaaagctatgttactcctagcattgcttcatatataaaaatggatgaaaggattagttcaacttctgatatgggaaataaattgataaaggaatccctcaggatgaattaattgctctctcagaagatataagctagaccaagagggaagaaatacaatttgcaatgaattgttaaagcacctcagaaagctcactgcctgctcctctacttcaaaaaatgctcattcctttaactttcaagggtttgatcttccctttaagcccaaatgccatcaaactacatgtcttatattgaaaagaagagtataatcggcaacttacttcaagatattttgacaagatttattctgaccatttctttcctcagttccacctggagttgctactgcaactgaaccgccagcatctgatttgctctccctctcaatattgggtccaatctgacacccagtgtcacgattctctaccatctaaagcaaaccatttaaagtatttagtatttattgaaccctttatttttcaccatattttaaaattattcattctttctacaggaattctgaataatcctcttattcatttatcaaatatttactgcatttctacaactcaatatttgttgctgaagcaatgatcaagtctttattctaactggaaaaagcaaatctgactacctaaatagtattcaaaagaaatcagccttacaaatttgtaaggcatattgtcattgttttcaggccacaaaacaatggcaaaaaaattataatatcctcatttcattccctttgctatatcataaagacattcagtagttatttcaaaatgacatagtagacaaaaatacatgcagctaaaaacacaaggtacatcctttttgtctcacttaaaatttccatatacattacctagaaatacacatttcaaggatgactaatatcacagtatcatataaactgtataccttatgataacagaaaccaatctcaagggaaaaaaaggactagtgtggtggctcccacctgtaatcccaacattttgagaggccaaggtgggaaggtcacttgagctcaggagtttgagaccagcttgggtaacaaagggaaaccctgtctttataaaaaatttaaaaattagtcaggcatagtggcatgagcctgtggtcccagctgcttggaagattcaagtggaaggatcacttgagcccaggaggtcaaggctacagacagctgtgatcctaagactgcactccagcctgggtgataaagcaagactctggaccaggcgcagtggctcacacctgtaatcccagcactttgggaggccgaggcgggcggatcacaaggtcaggagtttgagaccaccctagccaatatgatgaaaccccatctctactaaaaactacaaaaattagtcaggcgtggtggcgcgtgcctgtagtcccagctactcacaaggctgaggcaggagaatcgcttgaatccaggaggcggaggttgcagtgagttgagatcacgccactgcactccagcctgggtgacagagtgagactccatctcaaaaaaaacaaaaaacaaaacaaaacaaaaagcaagactctgtctcaaaaaatgaataagtaaaaaataaaacaaattcacatattcacatacacacacacacatacacacacacactcacatccttcagcctagaataaactacttcagaataaaagcacttgccattgactagggaagaaagaatagttaattaaacactaactcctctactgactcccccatctgcctttctgtgtttggttctccaacctcttctggcctgagagtataagaaaaactatcccctaacggacttgatgagacatcagtaattaaaactacagagccacctagtcctccttcatctgaaccaaaacctgaaactgaaaggagaaataatatacgtgtaataccacttgtaatatcacttaaaattatctccttcctttttttcttttttataaatacacataaaacttcaaaacctcacagcctctctgaaagcactttattgttaagaattaaaggaaccactggaagaaaaaaataggagatactgattataatcaacattgtcattaattttctattatttaatgattctttaaaagatgggaaatgtaaacatagttttaatctaaaatgagaattctcatttgtaagtaataaacaattgatatgcttaccttaataatggcattttttgccttatatgtagcaaaatagggttgttccaaaagccataatgatgtaagaatggcagctgtagaggtctttacacgaattactggactgtactcagaggatgactcagttataccagaatcacagagtagccttctattagaccaccttatcatccattccagcagtcttcctatactgccaaaagtgtttagtgctaaaggaagatcttcttgagggttaatatcattgcactgaatagctttgaaaatacatcttctagttttaatggacttgggagtccaaaaaatgtggtttgatgatctctggattagacatttctctctagtgtcatcttgtattttgtaaattgacctttgttttaaaccaaataatccactcattccttcattcttattgacttcattcgaaggatattgtaaaaaaggtttgatcccttgattaaccagtactgatgatgaaagtttctggttttctaaatgcatgccatattcatcatttaaagaggatgatttttctgattcataggactcaggagcaacaacaaagcaagaaccagctctaaacacattctggcttttagttttgctctgatgtcgttttaatgttgtatgtacatcaaaaagtaaagaattaagttcatgttctctaagctttccagaaaaactagttagaaatggaatgtcagcatccctggaataaggtaggtctctttcaagaatgtaactcaaaaacagatcaaggaatttaatatattcatcatcatcacgttcaaattcccaaacacctattacaggaagtgtattttgtgataacttttcatgatcttctttctttgtaggattttctttctgattacacattttccttttatcagttggcttatgaattgatgttaattccatgtgatttggggcatttctatagcaaaaaaataaaataagacaaaattagagatcatttaatcactaaaactgatcttagaattgacatggaaaattctctccaatgattaagtcatgtatattttgtgtgcctcaattacctacatttcaaatgagggagtgggactaaatgatttctaagtgttttcaagagtggaacatttctactatgagatcaaaaaaaaattactatcaaaagggaaaatttgtattagaagagattaaaatgtgtccacagaaatttcactataaaagaacatgaataatttttctgtgggtaaaagaaatagtcctctaatgggtcagattttaggaatacaaagtcaacaaaaactccaagccactgatatacaacaaaatttaggatttcttgtttctctcttgcatctgcccgctcagctcccctaataccatgtgtaataagcaagactgaccttttttgttttaccacacaaaaactgggaactttttctaaacacttttagctgttatgaaacctgttgggcggacaccttaactgcccaacaacaattccttttaaatgtttcttctcaacatgattcctagggcagaacacagatccttagttccctcagtaagagaacaggtgttggccacctgggctgaaagcatcccatcccttctgattgaggcaatttccttccctgaaatatttcccttaaaaatattaaggaaatttaaggaaaaatttccttaaaaataatatggctaactcagtaacctcaaactatttaagtctaaagattactaaaaaaaactgaaagtcctccagtgaagtgtagaatttcatctactcctttgattttataatttcagatggcaaaattatttcatatatcaataatacttaaagtaaattttcgaatgtatagtctcattttatactcctaatattcttatgagtggagggggtggcacttatcattcatattattaatagcacaatcagtgagggttgctgggaccagaaatcagctcatcagatgcctgaaagctacttttcaaaggaagtgaatgccagtgattaaaagatctcaattgtacctttgatagatatttatcctacttttttcttcaaccgacaaagcttcagagaacgtatctgcatcactgtgaaccacagaatctcctagttctgtgagtgtacttctgctcaaactagtccccagggaatatctgtcaacacctggagcctcatctggtttctcttcttcaattggttcccatatattcacttcaaaagagcctatatttctctgcacacgttttagagctttcaccctcactttctggatagaatgcatgacaacagacatcatttcctcagtctggggtcctggaaagaaaagaataaaaagtcttagtgttcattaaaatatttcaattcaagacataggagacccaactctggtccctcctggggacaagaaacctaactgatgactaaggcttatttccacattcttactggtcgtgttttcttcagtatttactggaaagatattttaaagtagaactgcagaagctaaagaaggtccattaaagaacacagtaaaagagacagaacctagacctcatgaagaaaaagtatgccctggaaaaaaaaaactttaagtgatttaactgttttaaaactcagaaggataattatatttaataaaaagaataatgaatgttttttctattatcacatagagaataagataaaatgaggataattctagccaaaaaaatcaaggacatttttcttactaaaagtaataagaaacaatagcaagggaaggttttcaaggctgcctatagaaacattttaaaacattatttaatacataaacagaatattttagaggatgtcaaaaaaaagtattaagaaaaatacaaatcacaaatacaatatattaatagaataatacaaaatcactggacatacctggacttaaatactgaattatagttttaaaaagcagggtaattttaattctttaaaaattctgcaacattgtaaatgtacttaatgtcaatgaattgcatattttaaatggctaaaatggtaaattttatattatatgcattttaccacagtaagaaatgtgtgtattctaattttgaagaacaaaattagaagcataaataaccataaagggaaattacttgttttcaacaaatacttgcaatatacaaagtaccatatgctcattttatattatcttacttaatcctctctgaatacacatcataaagcaggtaatactatgcccactttacaaataaagatatgaggctcagagagactgagcaacttgcctaagatcgcacagttactgactgacagagccatgagccgaagtcagcttcatctggttccaaagcaagagattagtctttctgcaatggagaaatgtttctaccttctcatactcctatctcaaggaagaggcaaaaatgcatagacacataagcaacagtaaataaatattttcaaaacaaaaagggaatcttctgcaatttatctgttagctatctgagaaacaacaaataatacctttcacaacacagtgtctgagtctctggtgaagagagtgatatttgtctcttaaaggaaccctcacgtcctcaggatagggaaatgctttcacgaaaatttctgctaccttcagaaaaaaaattgtttaagttttatgagaaacatcattctttttttttcttccattccacaaatattttattttaactcaaaatataaatgcacatttcttactaatcttttgaagtcaggtcaaagcctctctctgagcatctgtctgctaataggagtttagtatcaacttacttttttattttaaaatatgtaattgacaaaaactgtgtatattcaaggtgtacaatgtgatgatttaatatacgtatacattctgtgctgatttccatagtcgaattaattagcacatccatcaatacacacatttaccattgtaatatcctcccttatcaaatttcaggtaaacaatacactacgattaactgtagtcactatagcccggcgcggtggctcacgcctgtaatcccagcactttgggaggccgaggcgggcagatcacgaggtcaggagatcaagaccatcctggctaacgtggtaaaaccccgtgtctactaaaaaaatacaaaaaattagccgggcgtgttggcgggagcctgtggtcccagctgctcggaaggctgaggcaggagaatggcgtgaacccgggaggcggagcttgcagtgagccgagatcgcgccactgcactctagcctgggtgacagagcgagactccgtctcaaaaaaaaaaaaaaaaaaaaaaaaaaactatagtcactatattgtacattggatccctagaacttattcatcttgtaactgaaaggttgtaccctttgaccaagatctccccatttccaccacatccccagcctctgacaaccaccattccactctctgcttccgtgagtttaacatttttatattccacacacaagtgaggtcctacagtatttacctttttgaacccacaagatattatgctaagtgaaataatccaaagaaaggcaacatcatccttaattaaaattaaataaaaatcttttaaagtctctgattctgatgtagtttactttcacctacaagcacattacctttctgattggtggcagttctccaataaggctcaaaattatatcctgaataagttcttccatattaaaaaaccgagagaaaggcagcattctataagcccattccactgcactaagacagtgctcaatcatacaagaatcaaactccacttcaaggtcctaaaaggatattgaaaaacattcatttcctttttagtttagatggtagaccagaatgagttcaaaagaaagttttgctacaaacaataaaatcttcttttaaacaataatttcccacttaacgtgtgttcatttttcttatttttgccctggtaaataccttttctccttttacattttctcttgctttctgatattgcctgcaactataggataacttatcacggacatgcagcatccaacacagagcacaaagttctctgaagcaacctaaagcaggaacacaaatatgaaagaaaatcacatgagtatgtacattaatattataacaactccaactctgctgatcatttttttcaaaataaaggtctttatttcattcattataaaatgaacacatgctcattgtaaatttatataaaagtccttatataaaagtcatggagattgacttataagtcactaacagatattcatttatgtttaaacatttttaatactaaaaactatttctaatagtaaataattttttattaaaagcaatacaagtacacaaagatatataaaatcatactatgtatgctgctttgcaactagcttttttttcacctactatatcttagatatcttttcacatggtaatatactaagtcttcttgttgccaatatggtgttccattgtatggagcatcaggatttaactatacacaatgcacaggctcacaatccagctatcaaaacaagttttcactcttctgctaatcttaaatttctattatagttaacatgtgaccaattaagtgaaaaccatctcatgttctatggttaataggaccttttcaacggggtggtgtaggctctgtagacagagcaagaccttgtctcctagctacttggacacctgaggtgggaggatcgtttgagcccaggagtttgagaccagcctccatgttggcatggatgtggtgaaaaggaaacacttttacactgctggtgaaaacgtaaactagtacaaccactatggaaaacagtgtgaagattccttaaaaaactcaaagtagatctaccatttgatccaaaaatcccactactgggtatctacccagaggaaaagaaatcattatatgaaaaagacacttgcacacgcttctttctagcagcacaatagcaagaccatctctggaaaaagaaaaatataggaacttttcctttggaggaagaaagataatattctaaaatttagcattcattcatttatgccttaattgtttatttttatttattttattatgattatttttttgagacggagtcttgctctatcttgcccaggctggagtgcagtggtgcgatcttggcctccacctcccaggttcaagtgattctcctgtctcagcctcccaagtacctgggactacaagcgtgtgccaccatacctggctaattttgtatttttagtagagacagggtttcaccatgttggccaggctggtctcaaacttctgacttcaggtaatccacctgccttggattacaggcataagctaccacacccagcctatgccttaattttttaaataagccttatttttacaataaactgacttttatattagtagtcagtattttcattttctttagggagctatttaatatgctttttaaaataaatattacaaagtcaaaaagaacagtttgacattatggaaagtgggcagaaagcaggtcttctacacattctattcatcccaatagtgagagaggatggtgggtacatggccccagggggactatcagggtctccagtgagcattttcacactacagcccaccccacacatcagattctcatagattctgccgggggagcacggcccaatcttttgagaaaggcatcattactgacagatgtgtttcattatttcatatttcacaggcaagctgggatagaactaaggccaagaactagcaagacacagtgcagcaacatactaaacagtgactcatctaaaaacatcctttatctgtgtttttcagactgtggattacaaccttttattagttactaggctataaaatcaattcagtgagtctcaatcatctttttaaaatagaatacaacagaatatatcaagcgtgcattgcagccgggcacagtggctcatgcctgtaatcccagtactttgggaggacgaggtgggtgtatcacctgaggtcaggagttcgagaccagcctggtcaacctggtgaaacctcatctctactaaaaatacaagaattagctgggcgtggtggtgtgcacctgtaatcccagctacttgggaggctgaggcagaagaatcacttgaaccggggaggtggagattgcagtgagctgagatcacgccactgcactccagcctgggtgacagacttgagattttgtctcaaaaaaaaaaagaaaagaaaagaagagtgcattgcacacagtaagagtaaaggtagttcattaaattttcattctaacttcatatgggtgtgtgcatgtattaccttgctataaaatctgcacttattttaaatcatggtcaaaaatgtttgaataccaaaaagatgtaaccaactgaaaccagaatagaacgggttctactagacaaacgatcgagtttccacaataaataaagggcatgaaacagaatgggggcaaggaaacttttatagattaagatggacttataggccaggcatggtagctcctgcctgtaatcccagcactttgggaggtcaaggtaggactgcttgagcccaggagttcgagaccagcttgggcaaaaaagtgaggccctgtctttatgaaaaaatgaaaaaaaaaaacaaaaaaaccaggcctggtggtgcacacctgtagtcccagctactcaggaggctgaggtagaaggatcacttgaacctgggaggtcaaggctgcagtgagctacgatcacactataaaaagagaaagatttatatatcaaccaaaatgcaatgtgtggtggaccttgattggatagatttttttaaaaaaactatagaaaagacatatttgaaattatcaagtaaatttaaacatgggatagataacatagtcagatgccacataatggcactcaggtcaatgacagactgcatatactatggtgcacccataagattataatggagctgaaaaatttctgtcacctagagacatcatgacatcatagtccacacattactcaggtgtttatggtgacaactgtgtaaacacacctactgcactgccagtcatataaaatctagcccatacaattatatacagtacataatacttgataataataaacaactgttactggtttatttatttactatactatgctttttatcgttattttagcgtatactcttacttattaaaaaaaactgtaaaatagcctcaggcaggtccttcaggagttattctagaagaaggcattgttataagagaagacatctccaagcatggtattgcccctgaagactttccagtagaaaaagatgtggaggtggaggacagagagattgatgatcctgaccctatgtaggcctagactaatgaatatgttgtgtcttagtttaaattaaaaaaaaaagtttaaacagtaaaaaataaactttaaaatttttcaatagaaaaaagcctggccaagcacagtagctcacacctgtaatcgtagcacttcggcaggctgaggcgggaggatcgattgagcccaggagtttagaccagcgtgagcaacatagtaagaccatgtctctattttacaaataaaaaaaattaggccaggtgcagttgctcacacctgtaaagccagcactttgggaggtagaggcaggtggatcgcttgagctcaggaggccaagatcagcctgggcaacgtggtgaaaccccgtctctactaaaaatacaaaaattaaccaggtatggtggtacatgcctgttgtcccagctactcaggaggctgaggcaggaaaaatgcctgaacccgggaggcagaggctgcagtgagacaagatggcaccaatgcactccagcctgggcaacagagaccccatctctacaaaaactaaaaaataaattagctggtacagtggcttacgcctgtagtcccagtactcaaggggctgaggttagagaatgttttgagcccaggactttgaagttgcagtgagctgtgattatgccactgtatgtctcttcagccaagtatgattacaagagtcaaaaaggttttaatttttttttaagttcataaagtaaaaacattacaataatctatggttaatttattatggaagaaaaatatttttaataaatttagtatagcctaagtgtacagtgtttataaagtctacagtagtgtatagaaatgtccgaggccttcaaattaactcaccacccactcactgactcccctggggcaaaaacttccagtcctgtaagcaccattcatggtaagtgacccatacttaccattttttaaaatcttttatactgtatttttactgtaccttttcaatgtttagatatgtttatatatacaaatatttaccattgtgttaaaactgcctacagtattcagtgtagtcacattctgtattcagtactgcagtattcaatatggcaacacttctttttagagacagggtctcactatgttgcctaggctggagtgcagtggctattcacaggtgcaatcattgcatacaatagccttgaactcctaggctcaagcaatcctcttgtacaggtttgtagcctaaaagcaaaaggccgtatcacatagcctcagtgtgtatgaggctatttttgtctaagtatatcctatggtcacacaacaaaattgtctaatgacacatttcttaggacgtagccccatcattaagcaggcctgactatatatgatattaaagatttattgtaaattttgtcagtcatgataatagaattatggttttaaaaaatacctcatctggccaggcacggtggctcacacctgtaatcccagcactttgggaggccaaggcgggcagatcacgaggtcaggagattgagaccatcctggctaacacggtgaaaccccgtctctactaaaaatacaaaaaattagctgggtgtggtggcaggcgcctgtagtcccagctactcgggaggctaaggcaggagaatggtgggaacccgagcttgcagtgagccgagagcgtgccactacactccagcctgggcaacagagctagactccatcaaaaaaaaaaaaaaaaaacaaatacctcatctgggccgggcatagtggctcacgcctgtaatcccagcactttgggaggccgaggcaggtggatcacgaggtcaggaattcaagaccagcctgaccaacacggtgaaaccccgccctactaaaaagtacaaaaattagctgggtgtggtggcccgcgcctgtaatcccagctactcaggaggctgaggcggagaattgcttgaacctggaggcagaggttgtagtgagctgagattgtgcatgccactgcactccagcctgggcgacagtgcaagactccaactaaaaaaaaaacgacaacaacaacaacaaaacttcatctgttcactacatatactgaagtacttattgtacttatgatgtactcagatttgctttcatgtgttgacaattgttgcaagtgggtgagaggtactcgagtgcttatacatctctactttggtttaaattttccgtaataaaaaaacttcaaaagagtgtgaaatcctgggccaggcatggtagctcacacctgtaatcccagcactttcggaggctgaggcaggcggattacctgaggtcaggagtttgagaccgacctagccaacatggcaaaaccccatatctactaaaaatacaaaaattagctgggcgcagcagcgggtgcctatagtcccagctactgggaaggctgaggcaggagaatcacttgaacccaggagatggaggttacagtgagccgagattgtgccactgcactccagcctgagtgacagaataagactccatctcaaaaataaataaataaataaaattaagagttaaaatctactattttaggtaacaaactagggaaaggaaccttgtttttttgtttttgtttttgtttttaaagaaacagggtcttgttctgccgcccgggctggagatcagtagcaagatcatagctcactgcagcctagaaatcctgggcgcaaggaatcctcctgcctcagcctccccaaagtactgagattacaggcataagccaccgcacctggccagaaaggaactttttttttctttttttttttttttgagacagagtctcgtcctgtcacccaggctggagtacaatggtgcaatcttggctcactgcaacctccatctcccaggttcaagtgattctcctgcttcagcctctcgagtagctgggattacaggtgcacaccactatgcctggctaattttttgcatattttagtagagacagggttttaccatgctggccaggctggtctcgaactcctgaccttgtgatccgcccaactcatcctcccaaagtgctgggattacaggcatgagccaccacgcccagccagaaaggaaactttttaatctagccaaatcacttctcaacaatcaagagaccaaatcaaacaaaagaataattaaacagtagaactcatgatcaaaatgaaaatattaaaaatatgtgttcaaatctttatttaagtcatttcaaaggactatgtccctatttatgagcaaatatcttttaactgggattgttgtgaatttaactcacttcttacagacctagatttttaagaaataaatgagattgtacatacttttccagatgacacctgcctggcccttttgttacgtgaatgaagagtctatgaaactaagctcatgacaggtgagagaagcaatcaagaagcatttcaatgccgtttcggttggaaaaacagacaatctgagccccaggacatgtaagattatactaagggtgagtgagttaagaataaacttttttttttttttttttagggacaggctctcactacgttgcccaggctggagtgcggtggctattcacaggtacaatcattgcacacaagaccctcaaactcctaggctcaagcaacctcctacctcagcctcccaagtacctgggattacaccactgtgcccagctctaaaataaacattttaatcaaagtctaaagataagatcagggctggccaggcgcggtggctcacacctgtaatcccagcactttgggaggccgaggcaggtggatcacgaggtcaggagatcaagaccatcctggctaacacggtgaaaccccgtctctactaaaaaatacaaaaaaaattagccgggcacggtggcgggtgcctgtagtcccagctacttgggaggctgaggcaggagaatatcgggaacccaggaggcagagcttgcagtgagccgagatcacgccactgcactccagcctgggagacagagcaagactccatctcaaaaaaaaaaaaaaagataagatcagggcttaatataaatagaactgataaggattaaggaaggattaaggaggaaagagtgaaatgatatctaaagttttacttctttttaaacttgttaggcaaataactggacatagaccacgaattaagaaattaatttaggtcaggcgcaatggctcatgcctgcaatcccaacattttgggaggccaaggcaggtagactgcttgagctgaggagttcaagatcagcctgggcaacatggcaaaaccctgcctctacaaaaaatacaaaaattagctgggtgtggtggtgtgcacctgtcatcccagctactcaggaggctgaggtggaaggataggttcagcccaggaggtgtgttgcagtgagttaagatcatgccactgcactccagactgggcaacagagccagactctgtctcaaaaaaaaaaaaaaattcagttaaataatgaagcatgacataaggtaataggtatcacaatttgtttatataagaaatttctgacttactatcatatatatcatatatatatacatagctgttaaagtacaatatttacttgtaaacacaaagtaaaatatcagagcatattgtactttgaagagtcaatactttcccaaatcaaatgaaaaatataccatcattcatactctaagcaagcagttcattttggacaaacctattgctctaatggaaacttcatcaagcttgtggtctccagctgctccaggtctaaaaaatgcgatacctcctttacagtaattaagtaatgactgaggaaaaggactcagtgaaggaagggatcctttcattcgaatctaaaagtaaagaataaccgaacatgttaattatcagctgtataaatcacttttaaaagaaactataaaagaatcaggcaggtaagataagccacacagaatggaaaacacagcacatgaaatcagctatattttcagaaacttacaaatttaattcaggaaagtcactagcttgttatctcaaaaaaaaaaaaggttctaagtaaatcatttgtactctcttgtcacaattttgcctgtataagaagaatttaatgctatttttccctggctttcctcactggcatagcaaagaaaataaagaaatttaagaatcttaatcttatcccaaataaagctgtgtacagtaactaaaacaaatacaaaaaaattatgcctacatacataacttttaaaaaactaatctataaatggcagaattagaaagacaccatttggcagcccctaataatgactctaggcaaggatcattagtaaatgctaacagagtaaaaagctgaggggttgacggggatacttgatagagggtgtgacacgatccaaactcaatctcctcatccctaaaattaaaataagcaaacacatgtgccatgtgcgagagagaagtgcacaatacttatgaaagattcatttctaaaaaaatttgaggccaagcgaggtggatcacacctgtaatcccagcactttagggaggccgaggtgggcagatcacttgacgtcaagtttgagcccagcccggccaacatggtgaaactccatctctactaaaaacacaaaaattagttgggcgaggtggcaggcgcctgtagtcccaggtactcaggaggctgaggcaggagaatcacttaaacccgggagccggaggttgcggtgagccgagaccatgccactgcacccagcctgggcgacagagtgagatgctgtctcaaaaaagaaaaaaggaaaaaaaaaaagaaaatttgaactccaatctatttaaacctctctacctcaatgagcacagattaatgaccgggttacaggggtaaaaaaaggaaagagaaacaagctaaacgacactaaatgaagaaacgatcagacaaatctagaatatggtgcaggaaaaattacctagttttttttttaacaaaccaagaataaaaagaggggagcttctacagataacaggctgatttaaatatatttggagatgataaaatttatttccacgtttcaggaaagggctctaagagacataaacctgggaaggaagcattaacagcaggcttgcaattgattttctcctgctagtgtcacttccagaaagacacaatctaatcaaatctcctgggaagcatgctaatgacagacttcttgtcaaatacattaatggcatttactaccaggatggtactaagaggtagagagagagagagccagcaaagaaatgggggaccacagttctacagccacatgcaactgaattctaccaacaatctgaatgcacctggaaacggatgttcccctagtgcctctagaaaggaatgtagccccgctgccaccttgattggccttgtgagactctaagcagagacctagctgaaccaccctgtggtggttctgatgcacagaacctgtgggatattaaatggctgctattttaagctgctaaatttgtgttaatttggtagggtagtaatagaaaactaatatggctcagaatctttgtttcagcaccattttttaattgagctataactcacatatcatcaaagtcatcttttaaaagtgtacaattagtggtttttagtatattcacaaagttaggcaaccatcatcactgtctaattccaggtcattttcatcaccccaaaaagaaaaacaaaagtagtcactgtccacttcctcctctccctaaccccggcaaccaaccactagttactttcagtttccattgtgtttcaaaaatacttttagataacttatcaaagttatctaaaagtctctccaaaggttcctactaaaaataattatattgttttaattaggctgaattaatttaattttacttaggctgaattaaaaatatttggagatgatgaaatttatttccacatttccaagagagacagcaggcatataaaggattttcagctagataaaaagacctaccaggtgtcctatctggctagatatctgataagaatgaagcgacagctcagctgaagtcaatatagaaggggatgaacacctgggaatcaaactgaattgcacatctcagaaaatagcaagggggagaccctgactagtggaggctaccggatggaaacagacgagaatgaactataactttccattctctgaacccacagaaggccccacagaacacagacaacacctcaaggagaactgggagaaagccctggactgagtttcaatctttaatgacaggggagttggaaaaaaaaaaaactgtaattgcctggaattaatggactagattacactatcttttgctagacatggtggaactaacctagagaccctgttcagagtcctcacctttcaacaggaagaatctggtctgtttgtttatgaataaatctgaaatttgtggatttatagggcaggactccttgggaaaatataacaattataaaaacaataatataaatatgagtaatttcagttaacacagcatgtaaatgactaagatatttccataccttctgcatgacttttcttgcccacctcaactgcaatatataccactgtgctacaggaaaagaacactgagccgcccggaaaagcaggagaacacgctgaaggattccagataccttctggcgattatttttttcagcttttaaaagaagatcatcaccatcttcctgaggaaaataaaacaatccattttagtggctagtaatgagaaaatttagaatgttaaaatgaaaataaagataggctaatgagctgagcacagtggctcacgcctgtaatcccagcactttggaaggctgaagcaggaggactgcttgagctcaggagttggaagctgaagtgagccatgattgcatcactgcactcaagcctgggccacacagggacaccctgtctcaaaaaaaaaaaaaaaaaaaaaaaaagataggctaatgatgctcactgcttctcaaactaggatgttcctggagatttataaaggaaattctgaggcacgggctctgagatttcaactatggctatttctagaattgagaaatgttatctcccctcaacgtaaagggataagctgacccttgttcccagtcttacgctagaacagttaaagcccgctactccagactccattggtgggatgttacagagaggtccatctaagcagaatcccttttctcttcctctgctgggaagaatcctacttatatttcaatgttacttcctctgtgaagcccatccctctgtgctacaacagcactttgttcacacttctactgtagctttcaccaatttattccatatcaatttatacctgtatcccactgtactcagaactcccaagaggaagggccttgtcatttgtcttcgtatggccacagtgttcacactcaagtctgatacatagtaggacccaataaatgtttgttgaataaatgctatccaaaccagtagctaaagattattttcccagataatgagataatgtgagcattgtaaacatctgcttccccaacatccttcttccctgcccacttcttaacagtactcagtttttgagtatctgcccatctcctacatggctcatatgattgagggaaagctcatcccacctcaaggaaggatctattcacaggccaagcagtaccttgtgttaagcctagccacagtgactgtttaaaggacaggcatgtgacccaagccagtctcactaagagtgaatctcaatcctcttgcttggaatgctgggacagaaataattttgccacttctctttgtctcaatcactgtgcccatggacatggacaaggcatccttagaagctgttagtggccattctgctcccacaaggggagctagtcttcaggtgaagatgacacctcagaaaacaaactagagcaaaagacagagcccaagtctttggtaacataactaaatcagaaacctgccctacaactaggcttcttcatcacgtgaaccaataaatgccgttattgtttaaaccattttgaccaagtgttttattacttgcaacacaaggggttctaactgatatacggtgacatttagaagaaaccttaccaaggagaattgctttaataaaaaagaataaaatgaagcactactaaaggcagtaaccactcaaactactcgaactattatctgcacaggctatccaaaaaactttaaatgtcatttcaaatttctaaaccaattactaaagactcagatgcaagaggaaagatgaattattgagaaatgccatggactttttattccttccatttgtaaaatcaacaagtaaaatgttttagactattgaaatataaccaaataggacaaatgagaaataaaaaactagaggtagaagtcgccaatattgaaacaggagatagtaaaaaaataatacccagaaacacttcaaagtgttaatcaaatacttaaaagtctaaatgtaagtaatttataataacactttaaatcttaaaaccagctaactataatgttatgattttttaataagagcagataaaaagtttctgagaggaatatagtatttataatatagaactatcaattgaatagtgtaggaaaaaaaaaaccttttaaaacaaagtcaaataaaaataagtctttcttttcttttttgagacagagttttgctctgtcacccaggctggagtgcagtggtgcaatctcggctcactacaacctctacctcccgggctcaagccatctacccacttcagcctactgagtagctgagactacaggcacatgccacgatgcccagctaatttttgtatattttatagagacagggtttcgccatgttgcccaggctggtctcaaactccttgactcaagcaatcttcccgccttggcctcccaagttctgggattacaggtgtgagctactacacccagccaagtctttcaaaaaaggcaaagacaaagagataaataagagactgaaataatgtatggcttctaattctgacactcattatttcatttgttagcctaaaaaatgcctaatttttaaaagtctggatattaagattaattgtgctatattgttacaataattttaacatttattgaataattactatatgtcccaggtcctgagctagaagattttacaggatatctcaatcctcacaaaaatgccatgagaggtactattatcatctgcatttaaccgatacggaaacttaaacagcagtttagtacattccctaagattatacaattagtgaacagcaaagctgggatctatacgtttgtctttagagcttgaatttttaacctgatgattattatcaagttaattattttaaaaacttgacaaaatcaactttaaattaatttaaaagttaatgctataagcttacttcactaagaatagctggctggggacagtacaatggaggagctggaagatacaagccgaatggcactaagccccacagtcttttactgaagtccttggcagagtctatcagaagttgaaatgtctccgaaagaatatctgcatcggccataactgatgctttcagtacttcttgtactgaaccaaatagcagatttgcatcttcctcttcaatgggatctatcaaatacaaaaatttggtaaaatagttaaagcttgtattaaacttcttatccattttgtaggaaaaaatttcaaatctaaaaacattcattgtcaagaatgaacacattggttgacatacaaacatccaaacttacagacagaaattacaaactatcttgttactttaagattataggtaagaccatgagacatttttatacaagatattgtagaaacaactatacaataaaaatattcttagaatgtagttctgagtcaaaaataattgaaaaaatattaatgggaaaagaatgtcaagaaagacaccaaaataatataaaagattgtgtgagagtaacttttccttttttttttttttgagatggagtctcactctgtcacccaggctggagtgtgaagtgcagtggcaggatctcggctcactgcaacctctgcctcccaggttctaccaattttcccacctaagcctcctgagtagctgggattacaggcacacactatccaggctaatttttgtatttttagtagagatgaggtttcaccatgttggtcaggctggtcttgaactcctgatctcaggtgatccacctagcctcctaaagtcctgggattacagacatgaccaccgtgcctggccatttttccttttcttaatagtacatgatagtactttgtaataataagttaataaaaatgacttatgaaggaaacaggaaaacacaaaatagtcatatgtatagtacggcttcaactatgcaaatatctatatatatgtgcacatgtcccaaaaggcaaaatgtaagatgtggtggtagaactggaaactcagggatttttctactatgaaatattttaagcatactgtaaaatatagaatatatgaaagtacagaatataatatgtcaaacacttatgtactgacttctcatccttgtctgatattaacatttttgctatattcaacttaggtagccactatccagcatttggtgtggatatactggaattccaattaaatatatgttgtctttctgttgtgtgttctacaaagcttaacttctctttcatatttttcaaatctatgtccctatctattttgtatatatttatctttctttatatattttatatatatatatgtatatgatagctcagatgaatagctcagattcatcttttccagttcacaaatttgctcctaaattggtttagtaactttaaccatctattgaagtttttgtttttaaatcaggttgagacataatttacatactatatccatcctttttaaagtatacagttcaataaaattaaacaaatctatattggcttgtaataacatttccatcactccaaaagttatacttctttgtagtcaattccctgtttattctcaggcaacccctgatctgttttctgctcctatagttttgttttttatagaatgccacagaaatggaatcatacggtatgtagtcttcgttcctgacttctttcaggacttcttaccatgacggttctgtgattcatctatgttgtcacaagttatcagcaatttgttcctcttcactatttgttattccattttaaagatatatttgaatttgcttatccattcaccagttgacggacatttgaggtgtttccaaattttggctattatgaaaaagttgctataaacattcatgtatggatatttgttttgtttcattttttgagacaaggatctcactctgtcacccaggctggagtgcagtggcacaatcatggctcactgcagacttgacctcctaggctcaagggattctcccactttagttagcttcccaagcagctgggactacaggcatataccatcatgcctggataatttttgtattttctgtagagacagggttttgtcatattgcccaagctggtctcgaactcctgggctcaagtgatctgctggccttagcctcccaaagcattgagattacaggcatgagccactgcgcctggcttcatgtacacatttttgtgtacatgaatatttgaatgggcctgtttctatttctctttaatggaatggaattcattcaagagcagctaaagagaaaaaaatggaaccctttgaatttttatttgcttgttgtttctgacctctggcaattccccttactttatttaaagcttggcctttaagtggatattttttgtattttatctagaaacacattttatctatgtatttatcgtggaagagttttcagatcatttaaaacaacatattgccaaaactcaaagttcagactggggatattttagtcccttctttaaaatccaactttcacacagtaacatcttttcattgattaaagcaaaagaactgcacagaaaattatcaaagaaaagtttatagtcagatttccaagcattataggttctctcaaaacagaaatgttataagttttaggaatctagagttagaagtctcactctttactggagcaaagcaccaataaaaacagaagggcctcacagttgccctggttttacattaaatatacgacattaaatgactgatttcattactttttatctaaatttctccaactgtaaaacagataaattttataggattcctgtgtgaatccatgtaatacatgtaatattctatcatttttaattttttaataccattttgaacttttcaaataaaaaagatctataatttatgcactaggtgagagttgaaataaatcactcctaagtacccttccaggcttgagattctacagctccaaaagaaaatgatacaaatgaagcgaaatataattagtgtaaaggtatgtatgaaggctactctcaacatagtctctggggtggccttgctctgcaggaggagtcagagagctgtaacactgcggcatcaagaaagctactttaatatttaaaaaaaaaaaaaaaggcatgtatggaaaatcagaaaatcattcagttatcaacccttgtattgtaagctggcatcaattttgggtgttcccatggttaagtataaatatcatactttcatttttcagccgggcgcagtggctcatgcctgtaatcccaacactttgggaggccaaagcaggcggatcacctgaggtcaggagtttgagaccagcctggccaacaaggtgaaaccctgtctctacaaacactacaaaaattagccggacgtggtggcccacgcctgtaatcccagctactcgggaagctgaagcaggagaattgcttgaacccggcaggtagagtttgcagtgagctaagatcacgccactgcactccagcctgggtggcagagtaacactccatctcaaaaaataataaaataaaataaaaataaatatcatactttcatttttgataagtttatttcaaagtgttaatacatttgtagacatgtataaactttttaaggtattataaggtttatattaatctgacacgaatcagactatacatacataacacacctgtaaactgtttatattttgagcccatttcattttttgcttccaaagaggctggttgacctaaaacacactgcagtttttcctgaaaaatctgtgctggagtcatacggagtggtagattcagactctttttcttggacctgaaatgacatcaaattaagggaaatgaatccaaattttgaaaaaaaaggaaaggtttcacatatcaaggactaaacatgaaagtttaagaaacaatggaatttacttttttatctatcgtacatgtaaaaaagatatattcaaggaaatattgtattaagaccctccacgattatgatcctaatatactccccccattcttatttctaattgctaccctaaacacgggctttactaacacataagtgtgctaaataaatggtttttgtttgttttgagacagggtctcactctgttgcccaggctgacgtgtaatgacatgatcacggctcactgcagccttgacctcccgcgctcaagtgatcttcccacctcagcctcccaagtagttgggaccacaggcacgatcatcgcccctggctattaataaatgttttaacacaaataagtaagccactgagctgttcaatacagtaaccactaactatatgtggctattttaatttaaattaactaaagttaaattgaaaatttaattccttggtctcactggctgcatttcaatagttacttgtggtgagtggctaccatactggacaacacatttctatcactaaagaacgttccattgaacaatgctgaactaaggattccacataaaatgtaaataccagcaataagagaaatataaaatacatagttcaatcatactatatcttaaaattgcctaaaaatccatacctcatgaaattgctatcacgtttacagaacagctggaaagccacaccaattgaaacagacgtcttccagtctccaagtttatatgccaaccacacagcctctggaaccaggccaccaataaatagtaattcaagtgcatattcaactgtccacacattagagagattctgatctctaacaacactggccaccttagagtgttgcagaggaataagtcgaaaggactgctctgtgagtaaatttttaaaaatggattattacaatcacatccaaactcatgcttctttacatgggcatatttatctcttcaatcagtattatctacaaaaaaccaccaggaagatacatacaaaatgggctaaagtaatactcaacatgccctagaacacttttaacactgaagaatgtgcctcattcgtgggtcatgaaacaaatgccagcattattttaaaaatgaaacaaaagagaaaaaaaacaaaacagaatagaaagtatcagacacaaaataaaggtaaatactgtttaatgaaacttttgtgtcaggtaatatgtaaacacatacaaaaaacatttatatctactatactactggttcacaaagtacaatttattaccgtgacatgggtcacaatgtgcaatttattactgtgggatgctcagaaatacatgtttatttctcatactagattatgaaatgtagaaggcagagactacattttatctgactttgtgttacccacagtgttatgcaataaaagactaagttgaggtaacaatgaagcatattaagtgtcaatattagtgttgattacaaagcagaaaagtgtgatgttcagtaattctgactaaataataagattgccatctggcctgtgatttaatacaaaaggataatatcgttccccctggccttctgtccctttccctaattgaagtaacttgataaagcaacttaaaaataggataaaagaaatgttattaaaaaatacatgttgatgggatttttactcattctctcaaaataaaagtcataaacagcattcatgagcttctctgttcctcgaaatggtgagtttctcacatgacctatacaggctatgcctactgcaagaactaacattttagctctctgacaaacacatcaggaaaaacaaaaagttttcaaccacttggatgtctgattttgcataagcaaaggagccaggagactggctaaatttttcctatttttattcactacgagcaaggtaatataccattaaaataacttgaataattaaattttctgaaaattttactactttcacacagtaaaaaagttcacgaccttttaaaatatcacaccaaataagcaactcaaatccctagaaacattctgattagaaaaattaacatgaaatgtatatgcatcctgaaacattcacagaacataggagtttgaacacatagttcaaaatccatggttctacgactgattatatttgctgaccacttgttgccatctttattaaatttctgatagtattttaacttgtactactctaacttaggtgtgccttgtacatacatatgtatctgttcatgtctactcttgcttaaagccctccaacagcttcccatgatacttaaaattcagatttcttaacatggcttacatcatctggcccctttactgaatgcaactcatatcactctccacttccttctctagtttttttttgtttgctttggtttttttgttgttgttgtttttgttttgttttgttttgttttgtttgagacagtcttgctctgtcatccaagctggagtgtaatcacgtgatctcactgcaacctctgtcatctgggctcaagcaatcctcctgcctcagcctcccaagtgactgggaatctcaggtacatgtcaccatggcgggctaatttttgtattttttgtagagacagggtttcataatgttgcccaggctgatctcaaactcctgaactcaagcaatcggcctggcttcccaaagtgctgggattacaggcataggccaacatgcccagccctcctcctctagtttacagccacacagatctttccgtttctcaaacacatcaaacttgttcttgccctggggcttttacacaaactcaggttagaatgccctgtgccttgatgtatccaactcttttttgttattaagagttcggcttagaggccgggagcggtggctcacgcctgtaatcccagcactttgggaggccgaggtgagcggatcaggaggtcaggagatcgagaccatcctggctaacacggtgaaaccccgtctccactaaaaatacaaaaaattagcccagcgaggtggtgggcgcctgtagtcccagctactcaggaggctgaggcaggagaatggcacgagcccaggaggcggagcttgcagtgagccgagactgcgccactgcactccagcctgggcgatagagcaagactctgtctccccccccccccaaaaaaaaaaaagagttcagcttaactttcacctcctcagagagctactcctgaaattccaatctcaaattgccactcagtcacgctgtattgctctattttaattctctccataacagttataaccatttgatatatcttgtttatatatttaaatttctgtctcaacatattagacgtaaaccccgtaaaagaacaagtactttatcactttgttcattgcagttaggataaatctgtttcacagatgaaaaaaaaaaagaaaagaaaaaaagaaaacatgcgcatgcgccgtagctctccagaacgggaaggctgtactgagccggtctcgggagacgaaggatgggatgtgaggcggtcctgccttgccgccttctgtccctagtctccgggtccccgccctccagccgcctttgattcgtgactgggtcacggtcctcactcattcctcagaaccgcgaagaaaggaagctagcgtgtttgttagaaaacctagttgggagtgcaaggcagagagcgttcagcacccttgttcctcccgacccctcaggacagaagcagggctctggagggcagggattccccctcgtcttggccctacagccccagctgggcactaaactcgggccacggcggggcgagcgaggcgggctccggaggaagctgacggctgatgatggctcagtccaacatgctccccgtggctgatgtgttgagtcaaaatgaactgcgcaaaaagctataccagacatttaaggatcggggtatactggaaacactcaagatacaacttcgaaaccagctaattcatgagttaatgcaccctgtattgagtggagaactgcaacctcagtccatttcagtgcaagggagctccctcttaataagtgcctctaactctttagtggcagatcacttacaaagatgtggctgtgaatattcactttctgttttctttctagaaagtggtttggcaaaagaaaaggtatttactatgcaggatctattacaactcattaaaatcaaccctacttccagtctgtacaaatcactggtttcaggagctgataaagaaaaccaaaaaggttttcttatgcattttttaaaaggattggcagaatatcatcaagctaaagaaagttgtaatatggaaactcagacaagttcgacatttagcagagattctctggctgagaagcttcagcttattgatgatcagtttgcagatgcttaccctcagcgtatcaagtttgagtctttagaaataaagctaaatgaatataagagagaaatagaagagcaacttcgggaagaaatatgtcaaaagttgaagttttttaaagataccgaaataggaaaaattaaaatggaagcaaaaaaaaagtatgagaaggaattagccgtgttccagaatgattttgagaaagcttgtcaagcaaaatctgaagcccttgttattcgggaaaagagcacccttgagagaattcaaaagcaccaagagattgaaacaaaagagatttatgctcaaaggcaacttttactaaaagatatggatttgctaagaggaagagaagcagagctgaagcaaagagttgaagcttttgaactgaaccagaagctccaggaagaaaaacataaaagtatgactgaggcacttaggagacgggagcagaatataaagagttttgagaagacctatgaccaaaaactcaagaatgaactcctaaagtatcaacttgaactaaaggacgactacatcattagaactaatcgactgattgaagatgaaaggaagaataaagaaaaagctgttcatttgcaagaggagctcatagcttttaattcaaaaaaggaggaactcaatcaatctataaatcgcatgaaagaacttgagcttgaattagagtctgtcaaagcccagtctttggcaataacaaaacaaaaccatatgctgaatgaaaaggttaaagtgatgagtgactattcactactaaaagaagagagactggagcttctggcacaaaataaattacttaaacaacaactggaagagagtagaaatgaaaacttgcgtctcctaaaccgcctagctcagctggctcctgaacttgcggtctttcagaaagaactaaggagagcagaaaaggctacagtggttgagcatgaggagttcgaaagccgcaaacaagctctgcacaaacaactgcaagatgaaattgagcatactacacagttgaaggcccagatactaggttacaaagtttccataaagaggttaactattcaggttgccgatttaaaatcgcaattgaagcaaactcagacagccctagagaatgaagtgtactgcaatccaaagcagtctgtgatccatcattctgccaatggattaataaatggcaacatggtgcttcacaatggtgagataagtggggatttcttgaacaatccttttaaacaggaaaaagttctagcaggtacggttgcatcaaggatcacaaattatccaaatgcagggatggagggtagttcccctgattctgaccttgagtttgtcgccaatactaatgcaagggtcaaacagcttcagcaagaggcggaacgcttggaaaaggctttcagaagttaccatcggagagacattaaaaactctgccaaaggcccactaccagcaaagagcccaccatctctgcacttgctggaagccttcaaaaacattacttccagttccccggaaagacgtatttttgcagaggacagagttgtctctgagcagcctcaagtgggcacacttaaagaagaaaggaatgacatcttggaagccctgacaggcagtgcagcctcaaggctatgcgggggcacttcctccagacgcctctcctccacaccccttccaaaagcaaaaagaagccttgaaagtgaaatatatctggaaggtctgggcagatcacacattgcttcccccagtccttatcctgacagaatgcccccgccatcacccgctgagtctaggcacaacctctccatccctcccttctccagccctccggagcagaaagcgggtctttactggagacaaaatgaacttcaagacaaaagtgaattttcagatgcggacaagctagcttttaaggataacgaggaatttgaatcatcttttgaatatgcacggaatgtgccaaggcagtttgaaatggatgggccctctcctgccggggatatgcttcatatgggcgcagctgtagctgctgtgcccctctcatatcagcacccaagtgtagatcagaaacaaattgaagaacaaaaggaagaagaaaaaatatgggaacagcaagtgaaagaacgaaagcagagagaagaaagaaggcagagtaacctacaagaaattttagaaagggaaagaagagaactagaaaaactgtatcaggaaaggaggatgactgaagaatcactgaagattgaaatggaaaatgaattagaaatgagtaatcaagaaatgaaagacaaatctgctcacagtgaaaatcctttagagaaatacatgaaaatcatccagcaagaccaggagtcggcagataagagctcaaaaaagatggtccaggaaggctccctagtggacacactgcaatgtagtgacaaagtcgaaagtttaacacgcttttctcatgaagaaccagatgactcttggtaaccatgtttgctgcccagcttctaacttacataccatgagaaattacataacatttactcctttgtaaatgtttctctatcaacagataaaactctgaataaaaatgtgtaatccaaaaaaaaaaaaaagaaagaaactacaaatgttttcgtattatcaatttcatgtggtgcaagctagtatatgtgcagcactaagaatactgtgtggcaaatagtaggcacttaataaaaattagaatgaatgaatatcatagaaatttgtgtacctgtttatactgagagcagggcagttatctagcacaggattagatgcattttgaccatactaatgaaagtattaaatttaaaaagtaaatggtccaaataaaataataaaagtaaatcatccaaataacattaaatactgaattagcaggctcaatatttattaaatctctacattttgacataaatgaaggtggcagctctttcactttaaaaattgaaacttcagctgggcacacctatagtccctgctacttgggaggctgaggtggttaagatcatttggccgggcacgtggcgcacgcctataatcccagcagggaggccaaggcaggtggatcacctgaggtcaggagttcgagaccagcctgactaacgtggtgaaaccctgtctctactaaatacaaaaaattagccaggtgtggtggcatatgccgataatcccagctacttgggaggttgaggcaggaaaattgcttgaacccaggaggtggaggttgcagttagccaagatcacaccattgcactccaccctgggcaacaagagcgaaactcagtctcaaaaaaaagaaaagattgtttgaggccaggagttcaaaaacagtctgagcaatatagcaaaattccatctctaaaaagaaataattaataaattaaaatttaaaactaaaaactttataaagatcaacttgtcccaattttgtgattttaaaaagccatgttcagtaaaaacgaatctaagccattacttttctcagattctattcattcatagtcataaatcacctcctatgtttcagatactatgctagaacagtatcattgagtaatggcctctgtataatatgttttaaatattatattatgtgcaatgcaaaaaaagtttaaaaaggatttgtttactacattacctgttttaatatgaagtgggggaagaacattcacatgatgagggggcaaaatgcaaagctgctgattggtgaaataggcagccatgaaacgagccatggactggacgactctcactgctgcctcaggatgaacaccgcccaccattccacactcaaaatgagactttgcagcacctaaggaatacagcaatgacctaagaagattgtgatcaactaccaaaagtaataatatttaagttcccaacattatacaaaaagaaaattgcaatacctttttttctgagataagcacccatggccaatacaagctgaattataataggtaccgtacttcttaaagacaataaaaccagaaacaattacaattgacccttgaacttcacgggtttgaactgcataaatccacttatatatacagattttttttccataaatgtactagaaaatgttttggagatttgtgacaatttgaaaaaatttgtaggcataccacataacctagaaatatcaataaaaaaagaaaaaggtatgtcatcaatataaaaaatatatgtaaataattattttatcatttagtaccataaaatacatataaactataaaaagttaaaatttatcaaaattggctgggtacagtggcttacacctataatcccagcactttggaaggccaaggtgggctgatctcttgagctcaggagtttgagaccagcctgggcaacatggtgaaatcccacctctacagaaaaatacaataaaaagaaacattagctgggcatggttgtgcgcacctatagtcccagctattcagggtgctgaggtaggaggatcgcttgagtctaggaggcggaggctgcagtaagctgagattgtgccagtgcactccagcctgggcaacagagctagatagaccctgactcaaaaaaaaattatcaaaatttacacaaacacttacaggccatatatggcactgttcacagtcaagagaaatgtaaacacacataaagataaagtattaaataactgcataaaattcattgtagttcctactgtactactgtattaattttgcagctacttcctgttgctattttgaggagttcaagtgttgcaagtatttgcttaaaatactgtgtgatgctaatcatctctgcatgagcagttcatctctctagtaaagtgcacatggcaataaaaagcaacctcacaattcttgtgtagttctcatcacgtttagtgcagtaccataaaccttgaataacaccataagacctacaggaagtgccaccagagatcctggaagtgttctgaataagcagaaaaaaatcatgacattacaagtaaaagttgaattacttgagacataccatggattgaggtctgcagctatggttgtctaccatttcagacaattaatcttggaaacagataacataaacttgtggtatcaataaatacagtacaatactggaaatgtattttcccttatgatttttttttctctttttgagacagagtttcacttttattgcccaggctggagtgcaatggtgcgatctcagctcaccacaaacctcgccttctgggttcaagtgattctcctgcctcagcctcctgagtagctgggattataggcacgtgccaccacgcccggctaattttgtatttttagtagagaccagttttctccatgttggtcagactggtctcgaactcttgacctcaggtgatctgcccgcctcggcctcccaaagtgctgggattacagacatgagccactgtacctggcctcttaggattttcttaatacaactttcctttctctggcttactttattctaagaatacagtatataatatatacaacatataaaatatatgttaatcaactatttatgttaccagtaaggcttctagtcaacagtaggctattaatggttaagtttttcgggagtcaagttatacacgaatttttgacagcatgagggtgttggtgctcctaacccctgtgatgttcaatggtcaactgtagttagtaattatgtgcacatacacctaagaactgttcacaactttaagttttattttttaaatggaggtatctatacaaaatgacccaggcacgacagccttgcaagcttagaatttcattatttatttcccgtttttccttctctttccttttttttttttttttttttttttgaagataaacggggcagggcttactacaaaaataatctaaaaagcactgatataagatttttttctttttttcttttttgttttttgagaaagaatcctgctctgtcacccaagctagagtgcagtggcacattctcagctcactgcaacctctgcctccaaggtttaggccatcttcccgcctcagtctcctgagtagctgggactataggcacacgccaccttgaccggctaattttttttgtatttttttggtcaagatggggtttcgccatgttggacaggctggtcttgaactcctgagctcaagtaatcggtccgcctcagcctcccaaaatgctgggattacaggtgtgagccaccatgaccacccaagattcttaatgcttttgtctgtaccattagatctgagaatcttaatatactcccattagtaatagtagctcactagtataagattttggggggcaggcagtagcaaaaagaacgtgtggggtgggccaggcacagaggctcatgcctgtaatccccacactttgggaggcccaggatggaggatcacttgagtccgtccaggagtttgataccagcctgggcaacatggagaaaccccatcactgcaaaaaaatacaaaaattagccaggtgtggtggcatgtgcctatagtcccagctactcaggaggctgaggcaggaggatcacttgagcctgggaggttgaagctgcagtgagctgtgatcacgccactgcactccagcctaggtgacagagtgaggccctatctcaaacacacgcacacaaatgtgtggagtgaagggagatggctagatagcaggtggacagaagaatcacatcaaaatttctggcataactccaaagtgcactagcaggattagaggacatgcgtcattcccacttgagaatctcaataataatataagctggcattcacaaatttgaaaataaattagcttaaaactactaaatactgtatagataaatactaggataacattagttggtatgaagtgtatggctccaacaatagaaaggtatctttcttttccagaagtgatctgacacatattcatgggaaattacattttatatgtgtatggatttctatcttgttcactgtatgtcccagcacctagcacttctcctctcatatagtaggccctcaaaggaatattgttaataaagaaaataatgttaattaatgttacctggtttctttttttaaacaaaaggaattgagaaaattttattagccttcaagcagtagtcttcatttagtcactgtaatatttggggggaaaaaccacactatttcttcacattcgagttagagatacctgggtaaaaatttttttctcctgggtaaaacttatggaggaattatacaaaggtaagattttcagtaatcttaatcattcaaaccttatgcaaaactcaggaatcagcctcttaaatagggagtgacctgatgataaaagttattgtcacagaataaagctgtatcaatttagaagttaaaaaaattttcaaagtgtaaatctcgaccgggtgcagtggctcatgcctgtaatcccagcactttgggaggccaaggcaggtggatcacctgaggtcaggagttagagaccagcctggccaatatggtgaaaccccgtctctactaaaaatacaaaaaattagctgggcatggtggtgcacgcttgtaatcccagctactagtgaggctgaggcaggagaatcactttaacccaggaggccgaagttgcagtgagccgagactgcgccattgcactccagcctgggcgacagagcgagacaccatctcaaataaataaataaataaataaataaataaataaaaataaagtgtaattctgtatagggtgcagtgctaatgttaataacagaaacccggctgggcgaagtggctcatgcctgtaatcctagcactttgggaggccgaggggggaggatcacctgaggtcaggagttcgataccagcctggccaacatggtgaaactctgtctctactaaaaatagaaaaaaaattagccaggtgtggtggcaggagcctgtaatcccagctactcaggaggctgaggcaggagaattgcttgaacccgggaggcagaggttgcaatgagccgagatcgtgcctctgcattccagcctggtgacaagagcgagactccatctcaaaaaaataaaaataaaaataaaaataatagaaaccctatttaataaaaattaaataactatagacaattatttaataaggtaggtgtgcagaaaggaactaccatagcatgcatgactgcttgaaatgcttgcttgtaaggtggtccttggctggtatctgggaacttggattttgggaggatttccaccaccctaactgataagaagagctcactgaacctaaactgtataaacaatgtggtttacgctgaacatctgttttccctctgagagtgtagaattttggtttgtactaaggcagaaggggtttatgtgaccagccccccaattaaaaaccctgagcactgaggttctaatgaacttccctggtagactatatctcacatgttgtcacaacttgtcactgaggaaactagggacatcctgtgtgactctactgggagaggattcatagaagcttattcctggttttctccaaacttcataccatgcaccttttccctttgctgattttgctgttttctttcactgtaataaatcatagctatgagtacaactatatgttaaatcttctgagttttcctagtgaaccatcaaatctagggggtaattttggggtccccaacccagtaagtatatgcttaatatattttaagcaatcatcattaaaaattaagacaaatgagctgggcgcggtggctcacgcttgtaatcccagcactttgagaggctgaggtgagtggatcacctgaggtcgggagttcaagaacagcctggccaatgtggtgaaaccccgtctctactaaaaatacaaaaattagctaggcatggtggcaggcgcctgtaatcccagctactcgggaggctgaggcaggaaaactgcttgaaactgggaggcgaaggttgcagtgagctgagatagtgccattgcacactagcctgtgccacaagagcgaaactccatctcaaaaaaaaaaaaaaattaaaacaaatgaattactacaggttcaacttatcatgaaagttaaatcacgtaaggacaatattgcaaaaataaacaaataaataaagactatcctgtcatttaaaaagtcatatacagaagtctttcaccctgggtacagtggctcacacctataaccccagcattttgagaggctgaggtgtgaagatcacttgaacccaggagtttgagatcagcctgcgcaatataccaagactcatctctacaaataataaaataatttttaaaaattagccacgcatggctgggcacagtggctcacgcctgtaatcccagcactttgagaggccaaggtgtgtggatcacgaggtcaggagtttgagaccagcctgaccaacatggtgaaaccccatctctactaaaaatacaaaagtcagccaggcatggtggcgcatgcctgtaatcccagctactcaggaggctgaggcaggagaatcgcttgaacccaggaggcaaaggttgcagtaagccaagatcacgccactacactccagcctgggtgacagagcaagactccatctcaaaaaaaaagaaaaaaaaaattagccaggcgtgaggcacatgcctgtggttccagctacctcatttcccagcagactcatttctcggaatttatcttagagaaattattagtaatgctcacaaatatttaggtacactgcagcattatttaaaatagtaaatacatggcaacaaaatgtacaataatgggaaaaagattcaatagatttttttaagtttattggcactggaaaatattcatcataattttaaatttataagactatccagctccggtaatatatacatatacatgtgtcaaaaggccctagacaaaaaaaaactaaacttgtaagtgattttgtttcctttctacttttctgtattttcaaaattgcctaatatgaacacgtattacttccttaatgaacataaaaatttaaaaagataaaaatcagaaagtaagccaagcacagtggctcacacctataatcccaacactttgggaggccaaggtgggtggattgcttgagcccaggaagtcaagatcagcctgggcagcatggtgaaatcccatctctacaaaaaaaacaaaattagctgggtgtggtggcacacacctgtagtcccagctactcacgaggctgaggtggaaggatggcttgagcccaggcgccagaggtcagataagctaagatcactcaaccacactccagcctcggcaacagaataagaccatatctcaaaaaaaaaaaaaactcacaaaataagacatttataaacagtggctgaaacaatcaagaatgaaattgctatcaactctgtttagaaatttcaaatacattgggcctttcagacacattcgtatatacagtaaacatctagcagtctaccaccctataagcattataaatatattacatgttcattcatatatatctttccctctggttattgcctaatttaaatatacctctttgaaaaagtcaatccagatactctgcaatctcttaaacagatttttttttttttaatttgagatggagtctggctctgtcacccaggctagagtgcagtggcgctaccttggctcgctcactgcaagctccacctcccaggttcatgccattctcctgcctcagagctgggcctacaggtgcccgccaccaagcctggctgatttttttgtatttttagtagagaaggggtttcaccatgttagccaggatcgtctcatctcctgaccttgtgatccacctgccttggcctcccagagtgctgggattacaggcgtgagccactgtgcccggcccagattttttaaaagactaaaaatattctcggaaaatgatttttatgatttcactaaactgctgtaagcaatagttaacatactaaggaaaaaacacttgggtcctaaaattatgtctaacaaatagggttgtaagaaagcaatcatactatcagctcagcaggcaattactatactgttaaatcctggggattctaagatttaaaaacaaacaaacaaaaaacttcaacatagtccctgctattgggaagctgagagtccaaaatccaacataatatacttaatcaccagagaggtagaacaaccaacttttatgtataagcaatttcatgtctacactaaaaatacaaactaacaagtaaacatactgcattctgtagtcctagccacttgaggcggctgaggtagaaggattacttgagctcaggggtttgaagccaggctggcaacatagggagaccctgtctctttttaaaaatacaaagaaagaaaaaaaaaagcatacctgaaaaatctttattttcttttacaggtagttgggaccatctcaggatttctcttgctagctgatcacacaatccttgagcatcatttaaattatagctatagaggtggcagtataagagagaaagataatagcgtatctgaagaaaatacgtccttcttcctcctgaaacaagaagtaagctcaccttaaaagtatgtaagcaaaggaatgcccttggtgtagtgctcaattgacgggagtgtgtagtttgtgaaaattcatcaagttgtacactcatgatatgtaaacttttctgcatctgtttcacacttcaataaatgatttttttcacaggtgatctgggtacattacatccccaaataaaattggaattattttactcagaaagaatggataagaggtaggcaaccagcagtttcagtcttcagatatgtaaaggcagttgtcaggggctcctatcttatatttttttagcatactttgctctttttcattttaaattctaaacaatttattttctttcatcacaccctaggatgacttagattttatccaaagaaagctgcaaattcttatcatcttaacattaaggtctactaataacttttatctcaagtatacacagtatgaaacaaaagggaacatgccacaaaaaactccaaggaaccatatgtatatcaaagggatggccaaagagacttactgaagcagaagaaacagttatccaataagataggagcccctgacaactgcctttacgtatctgaagaatgaaactgctggttgcctacctcttatccattctttctgagtaaaataataccaatcttatttggggatataatgcacccagatcacaatttctccctagatgtggccatgtaaaaatgtgactatgttctgattcaagagataacattgtatgcaatttccagaaaagctgcttaaagaaaggtaaatcagctaggaaatgcaacctttctagctcttccaacctttgtcctatttgctgcctagagcatggatgtgatagctgaaggtccaggaaccatcttagcttaggtaatggccttaagattggaagcaatgcactaaagatgatgcagcagaaaaactaaaggagcctggggccttggtgataccatggaaacaccaaatcagccccaaactgcaacttctgccctcctttcacaaaggaaagccactctttctctgttgaagccactgctactttcaatctccattactagaagccattcctaatggatgtagttgtaaatgaaattaaacaaaatgtccataatggaactcattacaaaaacttttctatacccagaacttcagatctcagtgaatgctgctcttttcatccagatggacaatccccaagtcagagaactacactagccttctttctccaaatctactcaatcacaagtagactgatcaagcctattaaataactgtcaaatgtaacctctgttctccattacccttgacattgctttggtttcaaggcttctcgtctgactgattttcttgcctccaagtaaaacccacgcccctatgtcatagtcctgcaactggccttccacaactgtaccaaagtgatctttctaaacagcctattcttatttgtacaagtccctttcctacctaaagtgtcttaactgattccactgtcttcaagataaaatcttaattccttaccactccattaaagaccctccttcatcatctgttgtccatctgcctctcaacttagctcttatgatcctaccgccaatatcacatatacatatatcacataatctagtcctactaaactacttgaagtttaccaaattgccatggtttctcaggcctttttggttttggaacactatatactctgttaagtcattcccatgaccttaattggccaatctctactcaattttaaatgtcaactccaagaggctttccccagactgatgcttgcactccagcctgattgtattgaggtgttcttctgtgctccctaaacatctaccataaaacataatgagaaaagtgactgtaggcaacttgaaggtaaagttgtttatttcagttatccctagtgcctaatacagtgctgggcacatagcaggcactcaacaaagactggttaagtaaatgaattaatgaaatatacaaagccacagcagtcagaaaataaatgtaataatagaccaaatctgaccacgtaggagttgcagtcagggttccagggtcaccagctgagaacctctgtcatctcagccataccctcagctctgtatcataaaagctataacttgtttctaacatccacaccccatatccttatcaaaaactcctcgaagcccatacttaatgcaatgatacgtttaacttacatacaattcttaaagttaaattacttaaaggcaaaaagccctcgctccatgtttctctaagtctgtaagaaggtggtgaaatatatgacctatagtttcctattgagatacttgcagtctctctaaatgacaaaaaaaaaaccacattattttatttaggatctaaatctcatttttcccatcaacaatcaaccacaggctttatcacaaatcaaagaaaggacagaaggagacttatctacagatcactgaaaagatttttagtgttaccaattccaaggttaagaataattttaaataagtattcatgagtgtcaagttgcctacaacatgtattctatttggcattaggatatcataagcactctgaaatttagaattatttttaaggtctatggcaagctaaaagatgtcctgctaatataatggcacatattttttggaatttagaattactgttaaggtctacagcaagctaaaaggagtcctgctaatattatggcacatattttttaacactctcttacctttctcttcgatttcttgtagagcttttttccacagctgaacagacttttcatatgatcctaataaaaaacattcttcccctagaaagtttttaaccaacaattagtcatagttaattatattacttcataaaaatttactttgttttaaaatccagttaatggagctcagccagaaattattttgaaaaacaaatcattacaaccaattagaaattcaaagtctggttaactatgtcatttattcatggagttagaaaatattcataagatactgaccattgatagatttaagttctaaggtttgattcaagcaatctccagtactctgtaggttagcctgcaaatgacataacagggacttgacagtagatgcttcatgtgtcatcttttcagttaactgactatcagcttcaggaactcttcgatttaattgtgcttgataccataaagtttttttgtacagtattctccagagaataagcaatctgcacataaaatcaggtaattatcaaaagcaaatttcaggctaatgatgagtttagcctcctttttagcctatttttttttttgcctgtattcttcatcggtataacatacatacaaactgatcacatttaaatatagtgcaaaataaaatgattaaaaaatgccttatataaaatcttcataaatattttaagcacctgtaatcttttttttttttttttttttaagacacaaggtctcactacgttgcccagactgatctcaaactcctgggcccaagcgatcaccctacctcagcctcccgaacaggtgagattacaggtatgtgccactgcactccagcctgggagacagggtcttgctctgttgccaggctgaattgcagtggctccatcacagcttactgtagcctcaacctcctgggttcaagcaatcctcccatctcagcctcccgggctcaagcaatcctcccatctcagcctcccaggtagctgggaccacaggtgcaccacactgttttttttttcttttcaggcaaggtctcctcctgtcgcccatgctggaatgcagtggcgtgatatctgctcaacctctgcctcctggactcaagcaatcctcccacctcagcctcctgggtcgctgggattacaggcacatgccaataggcctggctaattttttagttgcggagtttcatcgtgttgcccaagctagtcctggggtcaagtgatccacccacctcagcctcccaaagtgctcgatcacaggcgtgagccactgcgcccagcctaattttttaaagaggtcatttttttaagaggtcattttggccgggcgtggtggctcacgcctataatcccaacactttgggaggctgaagcgggcggatcacctgaggtcaggagttctagatcagcctggccaacatggtgaaaccccgtctctactaaaaatacaaaaattagccaagcgtggtggcaggcgcctgtaatcccagctactcggggggctgaggcaggagaatctacttgaacccaggaggcggaggttgcagtgagccgagattgcatcatcgcactccagcctgggggacaagagtgtactccatctcaaaaaaaaaaaaaaaaaaaaaaagaggtcattttttaacagtacttaactaaaccaaaatctttcaagatcatggttttccgagactaagaaaatatgtattgtacaacatttggcataaatctaacaattttttttggcaaactaaaagtgtatacatttatcacgtataacatgacatatttaacatgatgttttgaaacgtacttaaatattttaaaaaataaaatctataatgctgagtgctaacagataaaagatttctttctggggtgataaaaacgttctggaattagtgctaatagtttcacaaccttataaatatactaacaaacactgaatagtacattttaaaatgatgaattttacaatatgggaattgtagctcagtttctaaaaaagtaaaaaaaactaagctaatagtatcccagtattaaaataagtgattatacctgtgtcctggctgttgcacaggatttactacttgaggatgaatcttgaaaaatgagttccaagaccagtttttctgaaaaccactatcttgaaacatctgaaaaataggtaccaccaatgagtcttgagctgttattttacttccatcagctgatgctgaaataacttcaggttgaagaatgtatacaccatttaaattgtcagctaccattttgagtaaataaaaacaagctaaaagtttctctgagaataactgacccttttgttgctgagtcagcaaaagttttacagtatttgaggtcagctttatcaaatgccccacatcttgtttgtatcttatatcccaataatggattgataaacactgatgaaaaagttgaaagatacaaagtatccatgcattatgtcttgagcttttgcttaaaacaagatcaagtttaggaaaaggacattttataaattgaagaatgtaaaaaaaatgagtgatacaaactactatgtaatttaacattaaatttttttctgtcacagtttttgaaattcctatagtccacgctgcaagtagacttttctggatagaatgcagttctgtaatggttctatctgtctcctcactatcatcctttgcatgtatcgtatcaaacatagatgcaaattccaatcttccttccttcatactactacacagcacatcatctcttttgttccaaaaaggacataagttgtctggaaagtgtctgccttcgttagtttcttctgcttcaaaatcctaaaacatgaggggaaaaaaatgatacttaataccatttaataccttatcaatagcatcactttggcgttcttaaatttctcttccctttaacaagagaaaaacagaatatgtttcttggaataaagtcataattgttccaagtaaataaaattctgctgctaagtacctgaaaatctgctgcattttcatttattgtttcttctgcctgcaagaatttggggacagtgaaatcggctgaactttcatttccttggtgttctaacaggctagaccttagggaattcagtgatcgcaagttcagtcctttgccttttggctaaagaagaaaagatgaaagatttccaagagcaaaatgttatctgtaattctattataagcaattaaaaattctatagacaactgtatacaattcaaggacattattgtcagtaaagttttaaatttgaaaagaaaaaggcaactttccccaatgatataaaaaagcactataccttagacaatatcacactttgatatattttctcaagcctctgggttgaatcaagtagaagtgatctcatgtgtactgatggagataggctatcaagaaatcgaagggttgtgaccatatatccatcagatataacgaggtagggtaaccgtgagtgtgcttttatagaaaatctctgtctcatagggtcactatcagaagctgatgaatcaacagaattatttgaatcttgaaacgtaaactgctgtggtctagtaaacaaacatcaaaatacaagaatcagtaagagaaagatcttacggaaaacaataatgtttttcaaaaaagaagaaaaagttacagaacaatgaaaaagcaagcaagtgaaacacacaaaaatattaaatgtgtttatatctttcaggaaaacataacacaggataaagacaaaataatatataggttcatgtgttttaaaattttcctaaatggtagcatttattctattttgtatttatctacatacaacctatttcagaaaataattcaggcagtttatttttactattaaagagagttaaatagttaactttcctcttaccatatatttaaatatgcttacacaaataaaattatgaactatcagtatactttttattaaagaggagaaagaaaaaagttgagaagatttggagagaatggtggtgagtaaaattttacctatttaaatttgagtttccacttaacttaaacatacaatattgttattatgatgtacctgattctgattacttaatatcactccttattaaagttggggctttacaaatataaaaggaacaaaccatcaaagtatattgtaatttttttctggttaggcaactattcaaatacagattttttttattagccaaatggcaacaatagaaagttggtaattataggacatacaccccacagacttctgtagaaccattaaaaataatgcctaacatggaaagatgtaaaagatatactgtgaaatcaaaaatggaaaatagtaaacaggatatatcacattatctagtttttaaaaaagaaactaatattgctattatcattgttatatgaatatttttaaaatgtgggggacaacatactaaaatgttaataattgttacctttgaagtataggattacaagtatttagttttccacattatttaattttgtaacatttgatttttgagtgctaaaataaataatgaatactatactttcataatcagaaaaaaagcagtttggaaggccccaaatattaattttaaaggagaatatgagaaaattctaatgaattatgaattagaccataacaagtaaggaaaaaatactttcactgcaggaagtgacacgtttttccattagcattgccaattgctaaaaattgtcatttttgggaggctgaggcgggcggatcacgaggttaggagtttgagaccagcccgaccaatacggtgaaaccccatctctagtaaaaatacaaaaattatctgggcgtggtggcgcgcgcctgcaattccagctactcaggaggctgaggcagaatttcttgaacacgggaggtggtggttgcagtaagccgagatcacaccactacactccagccttggtaacagagtgagactcggtctcaaaaaaaaaaaaaaaaattaaattaaatgtcatttttgctaaatataatcgaggaggccgggcgcggtggctcaagcctgtaatcctagcactttgggaagccgaggcgggaggatcacaaggtcagtttgagaccatcctggccaacatggtgaaaccccgtctctaaaaaattagctgggcgtggtggcgggcgcctgtagtcccagctactcgggaggctgaggcaggagaatggcatgaacccaggaggcggagcttgcagtgagccgagatggcgccaccgcactccagcctgggggacagagcgagactctgtctcaaaataaataaataaataataaatataaatataatcaagtaaacaccctacctcagtttcctttctataaagcaaacggaatagattaatttcaaatgtcttttccaacttttctgtcttgtaaacagttatgcatatgtgtctagccacatataatcaacatcaataacaacaaatatttactgagcactaactttatgccagacagtgctgatttataattatgtattaccttacttcattctctaaaccctaagacacaattagcgtcacactgctttcatagtaaaagaaactgaggcttaaagaataactcttctgcaagatgggagatcaaaataaatttttaaaaataaaaaaattggtacaggctcatgcctgtacttctagcactttgggaggccaaggcgggtggatcacctgaggtcaggagttccagaccagcctgaccaacatggtgaaaccccgtctctactaaaaatacaaaattagccaggcatggtggcacatgcctataataccagctacttgggaggctgaggcaggagaatcgcttgaacccgggagagggggttgcagtgagccgagatcacaccactgcactccagcctgggcaacaagagcgaaactccgtctcaagaaaaaaaaaataaataaaactaagaatgaaaatttaaaaattgaaaaaaaaaaaaagaataactaacccaaagtcatacaactaataagtaaaagaaccggtatgtgaatcttgatctgactccaaagccaaattgctacttcatctcacaagtaaaaattataatatgacacatgctatccaagtaacaaaatatcacatgtatcccataaatatgtaaaatattgtatatcaataaaaaaaattttaaaacaacaacaaaaattaaaatacggctaaatcctacagttttctatccatttccaataactttttccctttgggaaaaaagtagataaatccatatgtcaagttaattttgagttattaattttctaagtgctattattttataacaataaatgctatatcatactttattaacttttatatcaaagaagataatttttcgtgctattaaatatttaaataacttatacttacatagtcacaatgtcaaattttcaccaggattaagccacaaaaagaaacagaagaaaactacaaataagaaacagatattgagatgacagactcaaagaaaaagtaagacaatttgaaagatgaaattttttttgaatacacagtaaaagtaatacaaaacagaaaaaaaatctataaacaaattaacacaattcaaatgtctcacctatacgttattagtggatgaagaggaataaattctgctgggccaaattctatagagcaaccaaatgtaattaatgttagcaattcaccttggcaggtcaataaaaccagagagccacgttttaacatacaagccagaaaaagactatcatgcgtccagctgatatcacctacccagtaggacctataataaataagagacaacatgtttagaagagatactttacaatgtctatgacgatttaaaatgggctgtaccaagcagaggtgtgaaagttcaaaaaatgagggcaaaagaatgactaatagtagacaattgccatacacatttcatgaattttacttcctagaacaaaggagtttgctcataaacatctatttcaacaatattccaattagaaattcataagcaattaaaaaacgaaaatattcggccaggcaccgtggctcaagcctgtaatcccagcactttgggaggccgaggcaggcggatcaactgaggtcaggagttcaagaccagcctggccaacaccgtctctacaaaaatacaaataagccaggcgtggtggcgggtgcccataatcccagctactggggaggctgaggcaggagaatggcttgaactggggaggcagaggttgcagtgagccgagatcataccactgcactccagtctgggacacagagaaaaaatatatatatattcctaaagaactgagttttttagtcactcacatattagaatgaattttaatcctagtagagtctacaatcaagatctactgatagatttcaaggccacatctgtcctctctgcaggctgttagagtccctctcaacagcagactctccctcttcccaaagctctaactggtactactccttaactatttcgtgattttttaatttattttatttttattttttaaaattttatattttaacccttattcccgtcttttcacaggtgttgatatctggtgatactaatgtttaatgagacaaacagtaggtcctcctcagaaaatgacagacactaaatcaaaaagaccactgaactgagactaatactttcaaagtattatgaataatatgaatgagaaatttaccaaagagaaaggaacttgtggaaagtaaaagaaaatgaagaggcagggctagataaacctaaaaactctgaaaatgcatagaacagcatggaaaagtattcagaaaaggaagttagaagctgtaagaggaaattctcctactctgtaattttgcatggatcctggtggtagctcatatgccatcccaaatcaacacttatgttactattgactcagatgtacaggatacatatgtagggacttgtttaaaaaactaggcttggccaggcacggtggcacaggcccataatcccaacactttgggaggccgaggcaggtggatcacgaggtcaggaattcaagaccagcctggccaagatgatgaaaccccgtctccactaaaaatacaaaaaaattagccaggcatggtggtgggcacctgtaatcccagctactcgggaggctgaggcagagaagtgcttgaacccgagaagcagaggttgcagtgagacgagatcgcactacttcactcccacctggacgacagagcaagactccatcttgggggaaaaaaaaaaaaaaaaaaagactaggctctctcggccaggtgcagtggctgacatctgtaatcacagtattttgggaggccaaggtgggagaattgcataaggtcaggagttcaagaccagccagggcaacatagcaagaccctggctctaccaaaaaaaaacaaaaaaacagtcgtggtggcgtgcacctgtaatcccagctacttgggaagttgaggcaggcagggggatagcttgagcctagaagtttgaggctgcagtgagctatgatcacgccattgcactccagcccaggtaacagaacaagaccttgttgcaaaaaaaaaaaaaaaaaaaaaaagaaagacactcagctcaagatagctgactagacacaggtagcatgtaactcctccatggagaggaaccatggactgtccacttactattaagtagtaagtaagactaagagtgggaaaaggctcctgaacacagggaaacagtaagagaaaaatccacagggcttcataccccaaaacaggctttcataacctctgagtgggagaaaccctcaacccactagggctttgggcctgacacatggagctgcctaaagaatgctcagagacattgctccagaaagggaaaacacatggaatcccacaggcatccaagcctagagcagcgtcagaaagcctagataccagggatctacagacttggctgctactgcactgcttcagggaggaagaggggagaccaggcactctcaggcactcctgggaggctccctatcaccctgctgtgggctgctgttgagactgagatgtgagcaggctgcacttctcacagcttcttgcctacactgcttgcctgggagggataccaccctctctggtcccaggcccaaggtaccattttgactgtttagagctgggctacgtcccacccttgggctgagtttgggttgaggtggctgcagtcaccacccaactcagggaacaggggagaccaagctctccgaagcacacttaggagaatacccaccaccctgccacagagcagctatgtcatgggggactagtccccccaaaccatcacaacttccagtaactccaacatggactacttgggtcccagtgggttgcttcaccactactactgccatcgcccacaccataccagatacccaggggcctgagaaaccactcacacacctagaccaccactccgactactagtttctaagcatgccacctggaagcccaagaatcagccttcaggacccatcaataccagggccagtataaggtggtctagggcctaaaaacaggcacactcaccccactgctgccactactagggcctgaagactggctcagttgttgtccaagtccctaacaaaacttcaccataaccccaactaataactacaccttaagccactgaggaaatcacaggtgccaccaaccctgtgtactactgaagaagtcatacaaagattacactactacaagtatgcaaaatcaaagccaaagtatcctactcaatcaacaacatacatacatcttcaggaaaaaaattctcctctataaaagcattttcaaaaaattaaaacaagcaacggctgtaccagatgcacagacatcaatggaatgccacagaaaacataagaaaagcaaggagatatgacaccaccaaaggaccacaaaaattgtccggtaatagatgccaatcaaaaataattcccccaaaatgccagagaaataattcaaaataccgattttgaagaagctcaatgagatgcaagaaaatctgaaaaccaatacaaagaaatcggaaaatcaatatgaatgagaaatttaccaaggagaaagattaaaaaaaaaaaaaagaaattctggaaataaaaaatgaattgaaggaaatataaaatacattcaaaagattaaataatagactacaccaagcaaaagaaagaatctcagtcagacaaaaataagaaaaaaaaaaaaagaatgaacaaagccttcaagaggtctgggagtacaaaaagtgagtgaacttataaattatcagtattcctgaagggtaagagagatcaaaaagtgccgaaaacctatttaaaagaataataaatgaaaacttcctaagtctagcaagagagttagacattcagatacaggaggcccagtgatccccatgcaaatacatagcaaaaaggactccaccagcggctattatattcagaatgtgttaaatcaaagggaaagaaagaattttaaaattagcaaaagaaaagagtccagtcacctataaaagaaactcatcaatttcctctaggttttgtagtttgtgagtgtattatttcataatagtcttaatagacgttgttctgtggtatcaactataatgtttagaactggaacaatacaaggatgcctacttttaccacacctattcaacataatgctagaagtcctagtcagagcaatcaggcaagataaaaaaataaataaaaggcatccaaattatcactcttcactgacaatataatcttatatctagaaaaccctaaagactccacaaaaactcttagatttgataaatgaatatagtaagatttcaggatactttatattaacaagatgaatatacagaaatcagtagaaaatacaccaataactatgtagccaaggagtgaatcaagaaggcaatcccattaacattagctactaaaaataaaagaaaatacctagcaatatatttaaccaagaaggtaaaagatctctatgaggagaacactgataaaagaaattataattataaaacgctgataagagaaattgtagatgacataaacaaatggaaaagcatctcatgcttatggattaaaaggccaatatcattaaaatgaacatactgcccaaataaatctacagattcaatgcaatctctatcaaattaccagcgccatttttcacataattagaaaaaacaatcctaaaactcgtatggaaccaaaaacaaaagaacaaagctggaggtatcatattatctaatttctttttttttttttttttttttttgcaatggagtctcgttctgtcacccaggctggagagcagtggtacaatttcgactcactgcaacctctgcctcccaggttcaagcgattctcctgcctcagcctcctgagtagctgggattacaggggcacaccatcacaccagctaatttttgtatttttactagagacagggtttcaccatgttggtcaggctggtctcgaactcctgacctcgtgatccgcccaccttggcctcccaaagtgctgggattacaggcatgagccactgtgcccagcactttttttttttttttttggacagagtttcactcttgttgcccaggctggagtgcaacggtgcaatctcggctcaccacaacctccaccgccagggttcaagtgattctcttgcctcagcctcttcagtagctgggattacaggcatgcaccaccacacctggctaattttacaaaatccaatttagtagagacagggtttctccatgttggtcagtatggtctccaactcccgaactcaggtgatccacccaccttggcctcccaaagtgcgttagccaccatgcccagcctactaatttcaaattatactacaaggctatagcagccaaaacagcatggtactggtataaaaacagcacacagataaatgtaacagaatacagaacccagaaataaagccacatagctacaaccaactgatcttcagcaaagtcgataaaaatatacactggggaaaggacaccctattcaataaaaatagtgctgggaaaattggatagatgtgcagaagaatgaaactggacccatacctctcatcatatacaaaaattaactcaagatggattaaagacctaaacataaggcctgaaactaaaaaaatcctagaagaaaacctaggaaaaactcttctggacattgggctaggcaaagaatttatgaccacatcctcaaaagcaaacacaacaaaaacagacaaatgagaattaattaacttaaaaagcttctgcacagcaaaagacacaattgaagtaaaaaggcaacctacaaaatgggagaaaatatttgcacactatgtgtctgacaaagggctaatatctaggatctatgagaaactaagacaactcaacaagcaaaaaaaaaaaaaacctcattaaaaactgggcaaaggacatgaacagacatttctcaaaagacatacaatcagccaataaacatatgaaaaaatgctcaacatcactaatcatcagagaaatgcaaattaaaaccacaacgagataacataccagtcagaatggctattactaaaaagtcaaaaaacaacatgttggcaagtatgcagaggaaagggaacatgggaacatgtttctcatgggaacgtgagaaaagggaacaaacatgattggtgggaacgcaaattagtacaatcattatggtatagagatttctcaaagaaccaaaataggaactaccattcaatctagtaatcccactattgggtatatacccaaagggaaagaaatcattatatcaaaaagatacttgcactcacacgtttatcacatcactattcacaatagcaaagatagagaatcaacagaaccatctatcaacaaaggattggataaagaaaatgtggtgtgtgtatatatatgtatcatggaatgctactctgccataaaacaaatgaagtcatgtcttttgcagtaacatggatggaactggaggtcattatcctaggtaaaatcactcagaaacagaaagtcaaatactacatattctaacttataagtagggactaaacaatgggtacacatggacatacagagtggaataataggcattggagactactaaaagacgggaggggagtgagggttgaaaaattatctgttgggtacaatgttcactattaatactaaaagcccacacttcaccactacacaacatatgcatgtaagaaatatgcacctatggccaggcacggtggcttacgcctgtaatccgagcactttgggaggccaaggcgagtggatcacgaggtcaggagattgagaccatcctggctaacacggtgaaaccccatctctactaaaaaaaatacaaaaaaattatccgggcatggtgacgggcgcctttaatcccagctacgcgggaggctgaggcaggagaatggcgtgagcccgggaggcagagcttgcagttagccgagatcacaccactgcactccagcctgggtgacagagtgagactccatctcaaaaaaaaaaaagtatttaaggccttccttatataaagtgacttttaggctgggcatgatggctcaggcctgtaatcccagcactttaggaggccaagatgggaggatcacttaaggccagaagttcaagaccagcatggtcaatatagcaagaccctgtctctacaaaaaactttaaaaaaattagctacatacagtgacacacacctgtagtcccagctactcagaaggatgaggaaggaatgactgagcccgagagttcaacgctgcagtgagctatgatcacaccactacactccagcttgggcaataagtaagaccccatctttttttgtgtgtgtgtgacagagtctccctctgtcatccaggctggagtgcagtagtgcgatctcagctcatggcaacctccgcctcctgggttcaagcaattcttatgcctcaacctcccaagtagctgggactacaggaacatgccaccacacttggctaattttttttttttgtattttttttagtagagatggggtttcaccattttggccaggctggtctcaaactcctgacctcaggtgatccacctacctcagcctcccaaagtgctgggattacaggcgtgagccacagcgcccagccttttctttttttttttttttttttttttttgagatagggtcttgctctgttgctcagactggagtgcagtggcaagatcatagctcactgcagcctctatcacccacgttcaggtgataccccctagctcagcctctcaagtagctgggactacaggtgtccaccaccatgctcggctaatttctttttattttttagtaaagatgaggtctcattatgttgcccaagctggtctcaaactcctgagctcaagtgatcctctcaccttggtttcccaaagtgctagaattacaggtgtgagctaccacacctgacagagacccatctcttttaaaagaaaaaaagaaaaaaaagacagacaaaagagttcttacctaataagtgtagctggaaccacgggactcttgttactacatcctttaaggctaccacagagagtaacaaaattcagtgtgtttataaataatacctgagttgcctagaaaggaaaaaaaagacaagaaaactattaaaattattttactgtaaccattatttataattctggtgacacagagatctattattatattaataaactatctagggagtatttcctaactggcaaagcaatattgacccctggtagcctttgctcttttatgttccaccttaaaaacattagttaccacaatgctcttctttcctctttttcccttattcttttttcatttctgaaagccaagttttgaaagttatgggatctactttaaagaactttaccaatccacaatgtcaaattggattaaacaccaccaacttaaagaatataaagcaggctgggcacagtggttcacacctgtaatcccagcactttgggaggctgaggtgggagaactgcttgagctcaggaattcaagaccagcctgggcaatatggcaaaaccccatctctaccaaaaaaatacaaaaattagccaggcacggtggtataagcctatggtctcagctacttggggggctgaggtgagaggatcacttgagcccaggaggtcgaggctgcagcaagccatgatcgcaccactgcactccagcctaggcaacagagagagaccctgtcaaaaaaaaaaaaaaaaaaaaccagaaagaaaaaaaaaatggatataaaggagtatttagaaaaagaaaaatctcaaaactggaataaactccttcttttatagattactttctaagacagatatttactgaccttggggtctttctgattaagagttactgccagggtaaggccatctcttgaaaaggcagaaattagagctcctcttgactttactgattcacatttaggaattaaactacagagatgacagtcttgttgagcccaatgaacatggtatggcaatgatctaaaaaagtaatgaaataattgaaaacaaaaggtatagtaacttttaaatttatatgtagttcattacaaaaattaaaggatccatccaaattcctacatgtgcacatgtacttagggaatattttagagactatgttaatccattgtgttgctgtaaaggaatgcctgagactgagtaatttataaagaaaaggggttggctgggcacggtagctcacacctgtaatcccagcactttaggaggcagagacgggtggatcacttgaggccaggagtctgagaccagcctagccaacaggtgaaatcccgtctctgctaaaaatacaaaattacctgggcatggtggagtgcacctgtaatccaagctattcgggaggctgaggcaggagaattgcttgaacccgggaggcggaggtcgcagtgagccaagatcacgccactgcactccagcctgggcgacagagtgagactccatatcaaagaaaaaaaagaaagaaagaaagagaaggggtttattcgggctcacggttctgcaggctgtgcaagcatggcatcagcatctcctcggattcttgtgagggcttcaggaagcttttaaccacggcagaaaggaaatggggagcagcattttcccaagagagggagcaagggagagaaggagattccaggctcttttaaacaaccagatctcccgtgaactcagagcaagaactcattactgtaagcagaacaccaagccattcatgagggatctgccaccttgacccagacatctccaaccaggccccacctccaacattccaacattaaggattattttcaacacgagacttggaggggacgaacatccaaactatatcagagacctttcagaagtctgtgcacaaaagagaacctgcagattagctaaataaattgaatatcagagttctgttagtagagccatgtttttatatgcaaccccaaatatattatacctgcttccactaaaagtttggataaacgtatttctacataatgccaaatatttttaaaggaatttaaaaagtaggtcaggagttcgagaccagcctggccaatatggtgaaaccccatctctactaaaaatacaaaaattagccagccgtgggggtgcgcacctgtagtgtcagctactcgggaggctgaggcagaagaatcgcttgaacccaggaggcagaggttgcagtgagccgagattacgtcactgcactccagcctgggcaacagagtgagactctgtctcaaaaaaaaaataaaataaaaaataaaatgtagagaaggccaggcatggtggctaatgcctgtaatcccagcactttgggaggccaaggcgggcagatcatttgaggtcaggggttcgagaccagtctggccaacatggcgaaaccccatctttactaaaaatacaaaaaattagctgggtttgttggcgcatgcccataatcccagctactcaggaggctgagacaggagaatcgcttgaacctgggaggcagaagttgcagtgagccaagattgcaccaccacactccaacctgggagacagagcaagactctatctcaaaaataaatagatagatagatagatagataggtagatagacagaaagaagagggaaactttggggatagtatcaatgttctataattgatccaagtgatatatacatttcaaacaattgtatatatttttcaaagtctagttgtacacttaagacttgtttatcttattttatttatttatttattttccagacagggtctcactctgtcacccaggctggagtgcagtggcacgatttgaactcactgcaacctggacctcctgggcttcagtgatcctcccacctcagcctcccaagcagctgggactataggcatgcgccaccatgctcagctaattttttttatattttgtgtagagatgggattttgccatgttgtccaggctggtcttgaactcctgggctcaagtgatcctcctgcctcggcctcccagagtgctgggattacaggcatccaccaccacactcagccaagatttgttcatgttacttcatgtaagttatatcttaatataaaatataaaaataaaacaaacagaaaaataaaaataaaaaccacaccacaccattttactcaatcttacttaggcattgtaagaaaataatgcatattttcggctgggtgaggtggctcatgcctgtaattccagcactttgggaggctgaggcaggcagatcacaaggtcagtagttcaagaccacctgactaacatggtgaaaccccgtctctactaaaaatacaaaaagttagccaggcctggtggcgggcacctgtagtcccagctactcgggaggctgaggcaggagaatcacttgaacccaggaggcggaggttacagtgagccaagattgcaccactgcactccagcctgggcgacagagcaagactccatctcaaaaaaaaaaaatgcatattttctattttattaggctttttagaataaaactatttttaaataaaagaacacttaagcatttaaaaggtacaataggaaatcaaaagttatgtcccttttaaatttcaactgaattcttttccagaatagttacttttatagtcttagacaagtaaaaccatagcttgtcttatcttttacaaattctcacttcaaagaagggaaacaagacaaaacaagataaactttctggattaaacatttagaaataagaggggaagaaatgatttgtaaagcctcagaacttgaaactcacaataacatttacaaattttattacatgtatatggatcaaaagataataatgtttaaaaagggatagaaaatatggggccgggtatgatgcctcatgcctgtattcccagcactttgggaggccaaggcaggaggactgcttgagcccaggagtgcaagaacttgtctgttaaaaaaaaaaaaaaaattagccaggcatggtggcacaaacctgtagtcacaggtactcaggaggctgagctatgattgtgccactaccccccagtctgggtgacacagcaagaccctgcctccaaaagaaaaaaaaatcagtaagaaaaggaagaagaaaacatttacctcaccttacagatgtaaatacattctcatgccaccgaattgctagaaatgttaacttcaggcattccccagaataaaaagtaaatgaacacaggcagcagtctccaaataactgtagataaatttaatatactttagtataaaattaatctgaaaataaatcaagatactaaaatacatatatatattcctcatcataaaccagtaaaaaatattgagatcttgcttatactttttatccttaacattaagcttaagactaagtaatttttttctgagccagaggcaggtctcaaatgggtaatcaggttgtagtttatgctcttaagaaaatactgacattgactgtgactataactgaaaatattcttacatatttatttttctctttttatacttttatactatttaaattagcacaccaccctgagagtggggagaggggacaataaaacttcaaagtgaaatttctaacaagagtggtttggataataaaatgctggtccacacatacgaagaataccaagcagatattttaaatacgttttggttttttaagttcatgaatctgttatttcccagttaaatcgcatatttagtatcatcaattctagcttgttaaattaccaaacaagctctctctctatatataatatataaaaaatatatatacatatataatatataacatataaaaatataatatataatatacatgtattatatataatatataatatgcatataatatatataatatatacatgttatatacatatataatataccatataatatataatatatacgatatatattatatacgtgtatatatattatatattatactttttttttttgagacagagtttcactctcgttgcccaggctggagtgtaatggcacgatctcggctcactgcaacctccgcctcccaggttcaatcgattctcctgcctcagcctcctgagtagctgggattacaggcatgtgccaccacgcccagataattttgtagttttagcagagacggggtttctccatgttggtcaggctggtcttgaactctcgacctcaggtgatccacccgcctcagcctcccaaagtgctgggaatacaggcgtgagccaccgcgcccggcataacaagctatatttttaaatcaaggatagagaaaaggagttctaagttaaaactaattttaataaacactttttaaaaatgtgacccaagaaatataaaaatatcttttccatacaagaatttcacaattactatgaaaatttatggtgactaaagatatatagttataccattacacactctgctaatctgcttcacagataagagtctgagactgattttacctcattttttataaaaacagcattcactacagcttctttatcttcggtggaaggcaagagaactgcttcttcaggtatgacctgggaccaccgacccgccaatgaaaggcttttagaagataagatattctttaattccaaatattcccaaagaaatatgcatccagaaggtgttatgagcacaattcttttcccatttccagatacatacaagtacagtctcaaagagcttgctaaaaaagtaacaaaaaaagtaattaagcctctgaagtctgaattccccccaataaagtacataatttatgtattcttacaataaaaaaaaaacaaataatgttaccattcaggatgtcaaaactaaggcactagcaaaaaatacaatccaggcacggcagctcatgcctgtaatcccagcactttgggaggcttaaggagacggatcgctttagcccaaaaggtcaaagctgcagtgagctatgatcatgccactatacttcagcctgagtgacagaacaagatcctgtctctaaaaaagaaaaaaaaaggctgggtggatcacgaggtcaggagatcaagaccatcctggctaacacggtgaaaccccgtctctactaaaaatacaaaaaaattagccgggcatggtggctggcgcctgtagtcccagctactcgggaggctgaggcaggagaatggcgtggaccccggaggcgagtgagctgagatcccaccactgcactccagcctgggcgacagagcgagactccgtctcaaaaaaaagaaaaaaaaaagtacaaaaatagcaacatttatcaagtatatattatgtgatattagaaacctattattatcacagaaatgttaggcatgccagaattttcttcttcaagttgagtctcagtatcacagataaacataaccaaaactatatatatatatatatatatatatatatatatatatatatatatatatatatacacacactcagatatacatatgcacatacacagaaatacattttcaagacagtaacagaaaaatgtttcatcctcttttcctatttttcctagttaaaccaacttaaacaaataaaaaaattcccaccgactgtagctttgatcatttccttaggcttttcagttattggtatagttttcaaacaatcttgatctttgttccaaaggaaaagctctcctgtagttagtaccccagccagccaggcatctgtttccaaaaatgaaatgcaatacttacaatctagtatttcctttaacatcaccctaagttattaaaaaatatagttttagccatttgaaaatatcagtactacttaaccattactggatgttgttaggacaataacatccttcaagaaaggctgcagactaggaattttcttctttatctttcctgatagcaaattaatttcatttatgaatttatcatccaaaagaaaaacggcttctttttcctaagagaagaaacatgtgaaggactcaagaggtgccagaaattaattcaacttactgcctaaataaattatcccagaaatcaaagcgacatttaagaaagattatccatttgtaccacaaatcataaaatgaacattaagcttaatactctatagtagcctgaacattttgaattgttttaaaatacctcgttagaattaataggtaaggctacctagtagttgtatttcaatttctttgaagtttaaaattataggagtgtcctctaattctgctagccaaaactggcttatctactttttaatctttttttttttttttttttaagagctgaggtctcactttgttgcccagccttaagtggagtagatatttacaggcactatcccactactaataagcatgagagttttgacctggcccatttctgacctggaccagttcaccattcttaggcaacctggtggttaccccagccccttgatctcgggaggtcatcatattgataccgaatttagtgcagacacgtaatcggtatagcacactgcagcccagaactcctgggctcaagcgatcctcttgccttagcctcctgagtagctgggaccacaggtgcataccactgaacctgactctcatcaattttaacagtagtatgagcaagtttttaaattatttacttagattaaaatagatatagcttctgaaattcataaatccctgactctgctcattttttattacctagaaaaagtaggctgttttgagttaactttgttttcatatattctaaggcagtgattttcaaggtataactgagccagcagcatcagcaacacctcagaagtgaggagttcaagaccagcctgaccaacatggtgaaacccctagcctctactaaaaatataaaaattagctgggcatggtggcatgcgtctgtaatcccagctattcaggaggctgaggcaagacaatcgcttgaacctgggaggctgaggttgcagtgagccgagaggatgccattgcgtccagcctgggcaacagagcgagactccatctcaaaaaataaaaataaaaaaatacaaaatatccaaccctacagcagacctaattaactgaaaactttgggaacagggcccagcaatctgtgttttaaccacctctccagatagttctgatagtttgagaactcctgttacaggggagttagtggtataatttctcacaggaaatttaacactttatttcaataatcatcacaaataaagtagggttgcctactttccctaagtggggaatctatgccatatattatgaatggcattcctggattactaacgtattgtggcccatttcttccatcctagtttccaagaacacttcatagcacaatcatgaaaaccacaataggaggaaacactccattaactgttccagtaaaggaaagctcaggacattaaatattcccttttgatatatgccatctcaacttaacttaaacttgacttaaacataatatgaaaaaaatagtttaagtaaaaatcttctaaataaaccacttaacattctggaaaagctaacttgctcattataataaaaacgaaacacacacaaaaccctgttcagtgtgcaggtaggtgatcctcctgtagatcctcctccagtagatgatgttttatttatttaagatcatagaacactcctatattacaggcaaaacacacatataacatatataaaactggtattgcgtgaataaagaaaaacctacctttcccaaccaggagacacgtggccatggttttttctgcttaatacctgttgatgtcaagatttctaatcttatctccatgtttgttaagctatcaatgaccaattaagtaaaacagtcccaagattctgtaaacaataatagtaataaaatataaatgatgcataatattcactgggcattttttttttttttttgagacaagagtttcgttctgttgccccagctggagtgcagtgatatgatctcagctcactgcaacctccgcctcccggattcaagtgattctcctgcgttagcctcccgagtagctgggactacaagcgtgtgccaccacgcctggctaattttaagtagagatggggtttcaccatgttggccaggctggtctcaaactcctgacttcaagtgatccatccacttcgtcctcccaaagtgctgggataacaggcacgatccactgcgcatggaccactgaagatcttaactgacaattttcataaagttttgatttatattttatttctgagttgaagttttgctcttgtagcccaggctgcagtgcagtggcgcgatctcggctcactgcaacctccgcctcccgggttcaagcgattctcttgcctcagcctcccgagtagctgggattacaggcatgcaccaccacaccggactaatttttttgtatttttagtagaaaccgggtttcaccatgttggccaggctggtctcgaacccctgaccttgggtgatccgcccgactcagcctcccaaagtgctgggattacaggcgtgatccactgtgcccggccaaattagatgggcttgtttttttgtttttttaataaaatagctttaaaagaaaaactactcagagacagcacacaaagatctatcaagatgctagctatcagtcagcacggaggctgagatgggaagatcgcttgaggacaagagagttcgaggctgcagtgagctgtgattgtgcctgtgagagccactgcactccagcgtgggcaacgcagcgaagactccggctcaaaaataaataaataaaattgcaaataaaataaattctcacaaaagggttaaccaaatgccagagaaacgccggcattagaaaagcatcatttgcagctcctaatgaaataacaaatccagtcaatagtatcagcgctgctaaaattattgagtgaaaaaatactgggaactttatgcactgacataccctaaatccattagtcaatcttaaaattgctaagagcgaggaaaattgacgttctattcctccggatcctgctcgagaagctgggggactcgggtccggtgccgaggtgtggcccgagcctggcaccacccacgccggccgggtgaccccggccccttggggctcccgcgctccgtcagcaggcgacgctgggaggctggggtaggcccagagcgaggacgggcccggactgggtagtggggatgtaccagggccgggtgcggcgggagacggcccgggaggcggaaggtcgcggacctgcccgacagaagagtagatgaggggagaccgaggacgcccgggtccggggagcttacgaggaggccaggatcgcggggtaaggaatccgcgggcagttacctccgccaggggcagggtccggccagtcaggcgcgagaaggctaggcgaggccgactgcgcggggtgaagacgccaggccgacagctgcgggccctaccgccagccctgacgcgagcctgcgtcctggcgacggcggagggcgggcagggggcgcgggcgctgccacggcgcctgctcagaaccggccgggaacgccgcgggcgggtctccccggtcctccgcccctccagccctgctctcaggcctccgcccgggccctctaagctgccagccgcgcccgcctccgggctcctcgcccctcctcccgcgcgctcccctcctcagcggccgccggaccccctcagttcacttctcccagttaacgcgttcctcggacgctgctagtttgagcgcacaggcattgggcggggctcacgggggagccgcttaataaccgaccaacatgaaactcaagggctgccccttcctagcggggaccctgcacagacccgaaaataaggggttttgctctgccctcctcagttcacgtgggcaccttggaacactgaagaaggcattttccgaactcactgtcctacggacttattctccgcactgttttcgcctccttcgccctgttctcgtgactgacaggagcaggggtcacaagcaggcagcccgagagctctgctcacctggaaaagcatttttgtgtagcttaaatgtgaaggcctcaggcagtggcctgttgtcctcctccacatgcgcccatcttcactctttcatgtgactggcctgtttttgaaggcaggaccctgtcacccttggctaggccaggtatgttctgcaccgaaaatggccctgccctctgcattggatggctagctcttaggttggtttattttagcaaataagcgttacagggtaggcgaactggctgcatcagaaccacaattacccctgtgtctctgggtgggataaatggcggatggcattctggcagctcagccccacttatctcagaggttatagatctgaggtggtttagatccacccccaaatcacgaacattttacataagccgtgctagagttagcataaaagtctcacagaaaaatttggaaactgagaaatcctaacctattcccacaatcctgtgttcccatttttaggtcttaagatatgaagacaatgggataactgaggctgattttgctgtgtggccattagacctagaaatattggtgtgattctggagttgattgctccacacgtttatttatttattttcctttttttccctcctcttcctcctcctctattctttaaaaacgtatggaaatgtatccggcaatgtttactgtaaaaaataatgtatggaaatgactacaatttgctaaaataaaaatcattgagcacttatgtgtgtcagacactatgctaggtataaagaggggaagatggtgtccctattcaaaagagagtcacacacacttaagttacagtgcagtcataaataccatgatcgcagtatgcacaggtccattttctctatctgggtgatgggaaggttcaaaactaagctaggttttgaatgaggaatagtttcattttgaagcacatccattttgcgatgcctctggagctatctagtgaacaatttagatgcgtggttcagaagctcgatgggaggcttgggaacacagaatgtgtaaaataagcatcagtctccctttcaccctctctgcactttttaagggtcatctgtctttagtatatattggtaagagattttatggaggataccaattctttttttttttttttgagacagagtctcacattgtcacccagggtggagtgcagttgcacgatctctgctcactgcaacctccgcctcccgggttcaagcgattctcctgcctcagcctcccaagtagctgggattacaggtgcccaccaccaggcccagctaattttcgtatttttagtagagacggggtttcactatgttggccaggctggtcttgaactcctgacctcgtgattcacccacctcggtctcccaaagtgccgggattacaggtgtgagccaccgtggcctgccagcataccaattcttatgagagaatgtcaggggtagaagagatccaaggaaatggttgaccaggtaaaaaactgataaaggtcaaatagaaataagcctgagaattgccccatcagatttggtttagtgtttagtaggtatagttatagtgccagatatataataactgagttccttttgaaagcatatagtaaaatcaaatctgattagcctaagtaacagaggtgatttattgtaatgattctggggtatctgacagattgtagatattctctctagggtgctcctatccaatataaatttctgtaatgatgaaaatgttctatgtctgctgtgtcttaatatggtaaccattagccaaaagtgctactgagcatatgaaatgtagctagtgcaactgagaccctgtaaactaagattccagtcaaagagaagggaaaaaacagtgagctttgcccacagtctttaagacctgtgcccagaaatagtacataatatttctgcttacattccactggaaataacttagtcacatgatcacacctaactgcaaggaagcctgggaaatgtagattagcagtgtacccagaaagactgagaaaatggttttggtgaacaactagcagtggtcagaatacaaaaagtaataatacagatttcctgctttcaagaatatcacaggtttagtgggagacagatgagtattttactagcaatgaataaagaacatgctatacaaacccaaagaaaacagtagatatagcctggatatttgttcctacctaaatctcatgttgaattgtaattcccagtgttggatgtggggcctggtgggaggtgattggatcatgagggtgaatttcttgtgaatggtttagcacaattccttggtgctgtcctcatgatggtgagtgagttctcatgagatccggttgtttaaaagtgtgtggcaccttgggaggctgaggcatgagaatcgtttgaatctgggaggcagaggctgcaatgagctgagatcatgccactgcactccagcctgtgtgacaaagcaagactctcttttaaaaaaaagtggcacctcccccctgcctgtgttcctgcttttgccatgtgacttacgcgctcccactttgccttccgtcgtgagtaaaagcttcctgaggcccccgccagaagcagatatcagtgctatgcttcctatacatcctgtagaaccatgagacacgtaaacttattttcctgtaaattacccagtctctggtatttctttataacaatgtaagaacagcctaatacaatggtatttctcaaatcttaatgtacgtatggatcacctgggaatcttgttaaaatatacattctgggccgggcatggtggctcacacctgtaatcccagcactttgggaggctgaggtggatggatcacttgaggtcaggagttcgagaccagcctggatgacatggtgaaaccccatctctactcaaaatacaaaaattagctgagtgtggtggcacacacctgtaattccaactgatcgtctcattgatgcagaggttcggcaggtttcctacaagtttgattgggcaggacccttgttcaatttttctttaattctcttcactctgccctttgtcttcaggctggcttcctttgtggtaagtgagatgatggcaaatttacacatcttacaaagaaaatatagttttgttttttttttctaaaattgaacatcctttatgagcctctaccccagtatatagaagggaaagtctttatgttgacaaataatggtacttccttttttttttttttttttttggtacctaagtctctttcttatcaatgttctatcttgcagattttctttctctcattctaatcaacctacaaagtggatcaatggtgatagtgggctgggcgcagtggctcacacctgtaatcccagcactttgggaggccgaggtgggcagattacttgaggtcaggagtttgagaccagcctggccaatatgatgaaacccccatctctactaaaaatacaaaaattagccaggcgtggtggcacacacctgtaatcccatctactcaggaggctgagacaggagaatcgcttgaacccaggaggtggaggttgcagtgagccgagatagtgctactacactccagcctgggaaacagagcaagactccgtctcaaagaaaaaaaaaattagccggacataatggtgcgcgcctgtagttccaactacttggaaggctgaggcaggagaatcgcttgaacctgggaggcgcaggatgcagtgagccaagattgcgccattacactccagcctaggtgacagagcaagactccatctccaaaaaaaaaaagatagtgatagtggtaggagggattatatgcccttatggtataggggaagagagtgcttgtaattaacctttggttataaatatataagtatatatttacataattataaatatataatctatattcttatttggtgtgttcaggttactgtaacaaaataccattgtgaaagttgtcatagtctgaccgggcgtggtggctcacacctgtaatcccagcactttgggaggccgaggcgggtagatcacttgaggtcaggagttcaggaccagcgtggccaacatggtgaaaccccatctgtactaaaaatacaaaaattagcctggcatggtggtaggcgcctgtaatcccagatactaaggagggtgagtcaggagaattgcctgaacccagggaacggaggttgcagtgagctgggatcatgccactgcactccagcctgggtgacaaagcaagagtccatctcaaaaaaaaaaaaaggaagaaagttgtcttagtcaaaatagagtcactaatgttaagaaaaccctgacaaacagagctgaggaggaccatgaagagagggttctcacatttacatgctggtaacaagaaaaactctgcaacctcacacaaaggccattgcaatcattaacaaaaaatgcttccgaaaggacatctgcccagcaactgcccgttcaacttcagactggtgtcacccttgttgttgatctttgtagcgaagtataattatttcaaaacaattatgtaattctcatttttttccttcagaaaccatacacacatagtttactgtggcatgcgtatttccattgcagtgctgtattttcaaataaacatcattttcttttggaaagtctctctctgtttgctgtttagattgacatacgtggtgtcagaagtgagacctgaagaaaagttcactattgaaaggaatcagctatgcttggaaccagtttgcagagtactcacttgaactctttgagctctccacttccacagcttgccttttctggcttggtgagtcttctctcaggttgagcctccctccttcaggtagaagcttttttactttatttgggatctggtgtggataaggcaatcttaataaaagatcttgtgtaccttctgggactataaaaggtttttttgtgtgtgtcttttctggtataaagataagcatctttctgaattgaggactcttggtttctacagaatttacattctgtctgtgaggcatgtcttccctggtttgcatgcctagtttaatatttcatttgttctgcacaactgggttaaaatgttggcaaaaactcttatcttgatctatttttatttggtttgactctttcttcttgcttgtttctgaaaatcttccaagagccgaaacaaactttttttttttttttttttttttttttgagatggagtctcactctttcgcccaggctagagtgcagtggccaatctcggctcactgcaagctccgccccctgggttcacaccactctcctgcctcagcctcccgagtagctgggactacaggcacctgccaccgcacctggctaattttttttttgtatttttagtagagacggggtttcaccatattggccaggattgtctcgatctcctgacctcatgatctgcctgcctcggcctcccaaagtgctgggattacaggcgtgagccaccgcgcccggccaaaccaaaacaaacattcttggcggtgggtgcaggacagctaattaaacatcactagagtggttgcctcagctaaaacaatagtctaaactcctgatattccctgaaaggatttgtagagtattctttgctctcaagaaattaataagaaatggaatgatcttttcaaacattaaggcaggcaaggttttctgggactctcaggctggtcttgagcctcaagcaatactcccacctcagcctcccaatgtgctagaattataggcgtaagtcatcatgcctggccccatttcttaaggtaattttgtttgaagcttttcagatttatatctaagaagttcaacttttgctgtacttcactgtatgagatgtgcagagcatacatcatggcctctgttatttctctccttgaaaaggtatatctttttgcttggctggagtgataactctgtccttcaactgtttcatcaactcctataacattttttctctggttccaactctgctgttgtggcctgacgctgacatgtttgtcttgaaggtgtacaaaagcaatgtttttctacagagtaacttgattctctagtcttggcttttcttgatgtgtctgaattgttccatgtaaccaggaaactccccatgctttttctgagatccagctatttttctattcaatgtactagtttttttgtttatattcctttataatgtagcgtacattcaagatgctggtcacattcttcctgtgtctacttaattcaaataccgttttcatcaagtttaacttccaggttatgtaaacaggcttcccctaaggagaagcaattacactgtaggaaatttttcttttcttttttggtaactgggctttaaagagacaaaacaaagatcttagtttagtttagctttttgagatggggtcttgctctgtcgaccaggctggttttgaactcctggccttaaatgatccttccatttcagcaagactttacattttatcaagataattcatatattatctttattgggtttcaattagctggataactgagcttttaaagggttaggtttctacatccatgtaactttctgtattgcttttggtctttttattattattttgctgtgattctgttttaatcgaatgttttgaaccttttgacattattggccaatttccccaggatcagaatcctaagtctttttggcccaaaattaacattgggatttctagttggacccctgggaagcctcaaagaatatgtctctcatcttatagagatagtaaatgattcggcttatttggcaaattgcataggaggcgttgtgaaatgacaaatgatactagatattctttcagttacattatgggtatattattagtataaatgttccaaaaattatataaacataaaaatttaatatgttattagtcataattttgattattgtgttgaaacttttaagttatatttatatggatatgttattaatatgagtattataaagattatataaaatttggtcagatgcggtggctcacacctgtaatctcagcactttgggaggctgaggtgggcagatcacctgaggtcaggagtttgagataagcctggccaacatgatgaaaccccatctctattaaaaatatgaaaattggccgggtgcggtggctcacgcctgtaatcccagcactttgggaggcctaggcgggcagatcacgaggtcaagagatagagaccattctggccaatatggtgaaaccccatctatactaaaaatacaacaaaaaaattagccgggtgtggtggcaggcacctgtagtcccagctactcaggaggctgaggcaggagaatggcgtgaagccgggaggtggagcttgcagtgagccgagatcgcgccactgcactctggcctgggcgatagagcgagactctgcctcaaaaaaaaaataaatgaaaatgaaaattagccgagtgtggtggctggtgcctgtaatcccagctacttgggaggctgagacaggagaatcgcttaaacctaggaggcagaggttgtagtgagcagagatcgtgccattgcactccagcctgggtgacgagagtgaaactccatctcaaaaaataataaaataaaataaaatgtataggctgggagtggtggctcatgcctgtaatcccagcactttgggaggccaaggcgggcagatcacctgaggttgggagtttgagaccagcctggccaacatgaaactccatctctactaaaaatacaaaaattaaccaagcatggtggtgcgtgcctgtaatcccagctactcgggaggctgaggcaagagaatcgcttgaacccaggtggaggaggtggcagtgagccaagatcactccattacactccagcctgggcgacaagaacgaaactgtttcaaaaaaaaaaaaaatttataaaagtctaatggtcctgatatgacactgtcagtcatgatactgggttttcttttcttttcttttcttttcttttcttctttgagatgcagcctcgccctgtcacccaggctggagtgcgatggcgcgatctcggctcactgcaaactctgcctcctgggttcaaacgattctcctgcctcagcctccggagtagctgggattacaggtgtgcgccaacatgcccagctaatttttgtatttttagtagagacagggtttcaccatgttggccaggcaggtctggaacccctgacctcagatgatctgcctgccttgtcctcccaaattgctgggatcacaggcatgagccaccactccctgcctaacaagtactcttgaacacagatttctgataactttaagatcaatgaactaaataaaaatttccagaactctaataaagaaacggatgggtttggccaagtgtgttggctcacgcttgtaatcccaggactttgggaggccaaggcaggcagattgctggagcccaggagcttgagaccagcctgggtaacatggcaaaacctcgtctctcaaaaaaatacaaaaaattagctaggtatgatggtgtgagtttctagtaccagctacttggaaggctgaggtgggagaatcacctgagcctgtgaagttgaggctgcagtgagccatgattccaccactgcactcgagcctgggtgttagagtgaaaacctgtctcaaagaataaaagaagaaaagaaactgatgggttttatgaatcaagcaaaaagcaaaacaagacatcaattacatgaaatttaagtagttgataaatacaatgtttttatggcttttatttaagacgttgttggctctttactaaaatgttttgtttttcagatttaaggaattcttctctcataagctatctatagttgacagcaatttctgttttttttaattatactttaagttatagggtacacatgcacaacgtgcaggtttgttacatatgtatacatgtgccatgttggtgtgctgcacccattaactcgtcatttacattaggtatatctcctaatgctatccctcccccctccccccaccccacgacaagccccagtgtgtgatgttccccaccctgtgtccaagtgttctcactgttcaattcctacctatgagtgagaacatgcagtggttggttttctatccttgcgatagtttgctcagaatgatagtttccagcttcatccatgtccctacaaaggacgtgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatctttgggtgtatacccagtaatgggatggctaggtcaaatggtatttctagtgtggaattgtcacactgtcttccacaatggttgaactagtttacagtcccaccaacagtgtaaaagtgatcctatttctgcacatcctctccagcacctgttatttcctgactttttaatgatcaccattctaactggtatgagatggtatctcattgtggttttgatttgcatttctctgatggcctatgatgatgagcatttttttatgtgtctgttggctgcataaatgtcttcttttgagaagtgtctgttcataccctttgcccactttttgatggggttgtttgattttttcttgtaaatttgtttaagttctttgtagattctggatattagccttttgtcagatgggtagattgtaaaaattttctcccattctgtaggttgccttttcactctgatggtagtttcttttgctatgcagaagctctttagtttaattagatcccatttgtcaattttgccttttgttgccattgcttttggtgttttagtcatgaagtccttgactttgtctgtggcctgaattgtattgcctaggttttcttctagggtttttatggttttaggtctaacatttaagcctttaatccatcttgaattaatttttgtataaggtgtaaggaagggatccagtttcagctttctacatatggctagccagttttcccagcatcatttattaaatagggaatccttaccccatttcttgtttttgtcaggtttgtcaaagatcagatggttgtagatgtgtggtgttatttctgagggctctgttcgttccactggtctatatctctgttttggtaccagtaccatgccgttttggttcctgtagccttgtagtatagtttgaagtcaggtagtgtgatgcctccagctttgttcttttggcttaggattgacttggcaatgcgggctcttttttggttccatatgaactttaaagtaatttttcccacttctgtgaagaaaatcattggtagcttgatggggatggcattgaatctataaattaccttgggcagtatggccattttcatgatattgattcttcctacccatgagcatggaatattcttccatttgtttgtgtcctcttatttttttgagcagtggtttgtagttctccttgaagaggtccttcacatcccttgtaagttggattcctaggtattttattctctttgaagcagttgtgaatgggagttcactcatgatttggctctctgtttgtctgttattgctgtataggaatgcttgtgatttttgcacattggatcctgagactttgctgaagttgtttatcagcttaaggagattttgggctgagacaatggggttttctaaatatacaatcatgtcatctgcaaacagggacaatttgccttcctctttttctaattgaataccctttatttctttctcctgcctgattgccctggccagaacttccgacactatgttgaataggagtggtgagagagggcatccctgtcttgtggcagttttcaaagggaatgcttccagtttttgccccttcagtatgatattggctgtgggtttgtcataaataactcttattattttgagatacgttccatcaatacctagtttattgagagtttttagcatgaagggctattgaattttgttgaaggccttttctgcatctattgagataatcatgtgttttttgtctttggttctgtttatatgatggattacatttattgatttgggtatgttgaaccagccttgcatcccagggatgaagtccacttgatcatggtggataagctttgtgatgtgctgctgaattcgttttgccagtattttattgaggatttttgcatcaatgttcatcagggatattggtctaaaattatctttttttgttgtgtctctgccctgctttggtatcaggatgatgctggcctcataaaatgagttagggaggattccctctttttctattgattggaatagtttcagaaggaatggtaccagctcctctttgtacctctgatagaatttggctgtgaatccatctggtcctggacttattttggttggtgggctattaattattgcctcaatttcagagcctgttattggtctattcagagattcaacttcttcctggtttagtcttgtgagggtgtatgtgtccaggaatttatccatgtcttctagatttcctaatttatttgcatagaggtgtttatagtattctttgatggtagtttgtatttctgtgggatcagtggtggtatcccctttatcattttttattgtgagttgacagcaatttcataaagtgtcctttttgaacaaagatggaagcatttgctttttctccctacttgattccttcaaaagttggaaactatttgtgagtattcttatttttatttttactttattttattattattattattattattttggagatggagtctcactctgttatctaggctggtgtgcagtggcaccatctcggctcactaccatctctgcctcctgggttcaagtgattatcccgactcagcttcctgagtagctgagattacagacacggaccatcatgcccagctaatgtttgtatttttagtagagacggggtttcaccacattcatcaggctagtcttgaactcatgacctcaggtgatccacctgcctcagcctcccaaagtgctgggactgcagacgtgagccaccacacccagtgtttttttttttttttgagatggagtctcggtctgtctctggagtgcagtggtgcgatctcagctcactgcaacctctacctcccaggttcaagtgattctcctgccgcagcctaccaagtagccggtattatatacatgcgccaccatgcctggctaatttttgtatttttagtagagacaggtttcacaatgtaggccaggctgtctcaaactcccaacctcaggcgatctgccctccttggcctcccaaagttctgggattacaggtgtgagccactgcacccagctgtattcttatttttatttaaataagttcaataaaaatctgctctctatataaggaggatacaattggaacactggttttactaccaaggctttgactgaaatgtcttaaaaatgtacatgaaatgcctggcttcaagaattcccagccttatagtgagtgaataaaaacagtcacttcccagcaggcccaagaacattataagtaaaatctaaagtctcctttgtttgccttcctcgccttaagaaatttttaaattggccaggcgccgtggctcacgcctgtaatcccagcacttggggaggccgaggcgggtggatcacgaggtcaggagatcgagaccatccaggctaacacggtgaaatcccgtctctactaaaaatgcaaaagattagccaggcatggtggcaggcgcctgtcatcccagctactcaggaggctgaggcaggagaatggcgtgaacccaggaggcggagcttgcagtaagccaagatcgcaccactgtactccagcctgggtaacacagtgggactccatctcaaaaaaaaaaaaagaaaagaaatttttaaatctgagattcatgtatgctcaatatagagataaaaatttatgtttctaaagagaaactataatacatcttttgttatgtagtagccctgtgccttacttccaagttcttgttatctgcctgtagactggagtaggtcctgaagcctcctactttctccaatatttggctgcagctttcaccctcaaaatgaaagctgctctattcctaaagtcctataagctaacattagattaattttaaggaacaagcctcatgcttggtgtgtgtgccacgcaaaaagttcaccaaactgcccaatgtcatgaccaaagacatccaaattacaaacccagagaagttaatgttttcacactgtaaacagcttttcccaagatgttggaacaaggctccatgtcacaatgagaattttatcctccttaatgctaccttgtttacttcgcaggataatggtgtaacagaaactttgccatcaataccttcttgctggtaacttaacaaactctaacctaaaaaaatcctttaggagccattgattaaatttttaaaaagtctgtgctattgctaatactacatgctgtatctaagtaaattatctgggaaaattgagacccatgtacacaaaataaacaatcaagccacgtagttacaacagatctcacctaattctctctggtctttgatttattcagctgtttgtcttaaaaataattatttctaattgttatgagtaagtaataatgtatatatttgtggggtacttgtgatgttttgatacagacacaaaatgtgtaatgaccaaattagtgtaatcaaggtaaccatcagctcaagcatttgtcatttatttgtgttaagaatagtccaatttggctgggtgtggtggctcacgcctgtaatccgagcactttgagaggctgaggcaggcgtatcacaaggtcaagagatggagaccatcctggccaacatggtgaaaccgtgtctctactaaaaatacaaatattagttgggtgtagtggcacatgcctgtaatcccagctactcgggaggctgaggcaggagaataacttgaacgcgggaggtggaggttgcagtgagctgagatcacatcactgcactccagcctggtgacagagtgagactctgtctcaaaaaagaatagaaaagaatagtccaattccactgttttagttattttgaaatatacaataaattgttgttaactatagtcatccgattttggttccaaatactgatcttattcattacatacaactgtattttagtgccattagccatccccactttatccctgcctcctcactacccttccaagcctctggcaaccaccattccactctttatcaccatgagattgattttttttagcttccacagatgagtgagaacatgtgatatttgtctttctgtgcccagcttatttcacttaacatgatgtcttccagttccatcaatgttgttgcaaatgacaatattttgttcttttttgtggctgaatagtattctactgtatgtatatgcaacacattttctttatccatttgtagtagtcagtcttctctagagggacagaactaataaaatatatatatatatatataaaggggagtttattaagtattaacttacatgatcacagcgttccacaataggctctctgcaagctgaggagcaaggagagccagtccaagtcccaaaactgaagaacttggagtccagtgttcaagggcaggaagcatccagcacgggagaaagatgtaggctgggaggctaggccagtctctccttttcatgtttttcttcctggttcatatttgctggcagctgattagactgtgcccaccagattaagggtgaatctgctttccctagcccactgactcaaatgttaatctcttttggcaacaccctcgcagatacacccaggatcaatattttgtatccttcaatctgaaaagttgatgctcagtattaaccatcacaagtctactcctagtcaacttgaactgatacacatctcctgagatcacacatagtcttcaaataaagacaataataaggtcacaattacgcctaacacaatacaactatccttcgtacaacgggaaacgtaccaatccccaaatactattacataaagttaacaatatttaaatgctgatatgaagtcaataaatcttatgtcacatgataaaggaaaaggaaataaaataaagatattttcttagtacaagtttatacatgcacaaacatgttttcagcaaaagaagaaggaaatactcatgacaattacagtccctatttctgcacctagtcacttcgtcgtagctggtattgatgactaccttcttctactagccattctgtgttccctttgccttcagcaagcacctcagcaggttgtgggttttttcctggtggagtgacccaaaccttcattcctgaggggtctgggccatttgtagtcctgcctggattgggctgttgtagttttccattgaccttaatcacaggacatggtaatactaagagatgtcctaatggatctcctgtattccatgcattctcttccttacctccattgtgaagtagtagactgatttcatcttgatagtctgggtcaatcaccacagccaaaactttaactcccttcttagcctgttgacttaaaggtaggaggagcgcaaagtgtccaggtggcaatcttaacttccagtttaatggaatcgttgttgtgtctcctggtggcagtgtttcttcctctggaactaagacctctaggccagcagaacataatgttccaggagcaggaagcaaaaattttgctagtggatcactaggggtgatggtgaatggtgccacttccactctcaccccttgattcctggacccatgaatcctggctatgggagaaacagtaccatatattggatgctgattcagagcatacatggtcttctggagaactttgccccagccctgcaaagtattgtcacctagttggcattgtaattgtgacttcaaaaggccattccaccgttctatcaatccagctgcttcaggatgatggggaacatggtaaaaccagtgaattccattgagcatgagcccactggttcccttctttagccgtaaagtgagtgccttggtcagaggcaatgttgtgtgaaataccatgacagcggataaggcattccatgagtccacagatggtagtcttggcagaagcattgtgtgcaggataggcaaacccatatccggagaaagtgtctattccagtgaggacaaacctctgccttttccatgatgaaagaagtccagtataatcaacctgccaccaggtagcttgctgatcaccccgaggaatggtgccacatagagggctcagtgttggtctccgctgctggcaaattgggcactcagcagtggccttagctaggtcagccttggtgagtggaagtccatgttgctgagcccaggtgtaacctccatccctgccaccatggccactttgttcatgggcccattgggtgatgacaggggtggctgggaaaagaggctgagtggtgtccacagaacaggttaccctatccacttgattattaaaattctcctctggcctagtgcagtggttcatgcctgaaatcccagcactttgggaggccgaggcgggtggatcacctaaggtcaggagttcgagagcagcctgaccaacaaggtgaaaccccgtcactactaaaaacacaaaaattaaccgggcgtggtggcaggcgcctgtagtcccagctactcgggaggctgagacaggagaattgcttgaacccaggaggcagaggttgcagtgagctgagattgcaccactgcactccagcctgggcgaccgagcgagactctgtctcaaaaaaaaaaaaattatcctctgctgaggtcacctgttggtgagtactcacacaggatacaaatatcttcacgatttttgcccactcagagaggtccatccgcatacctcttccccaagtttctttgtcatcaattttccaatcaacacttcttccaagtccctgaccagccaaaccattggctacagcccatgaatcagtatataattggacatctggcaatttctccttccatgcaaagtgcacaaccaggtgcactgctcgaagttatgcccactgggaagatatgcctttaccgttgtccttcagggatgtcctacaaaggggctggagtgctgcagctgtccactttcaggtggtgcctgcatattgtgcagaaccatctgtgagccaggcactagtcttctcctcctctgtcaactgatcatagggaactcctcatgaggccattggtgcaggctgggggcgagaaggcagggtggcaggagtggagaccataggcatttgagccacttcctcatgtaacttacttgtgccttcaggacctgctcgagccctatctcgtatataccacttctgtttgatgatggaatgctgctggttgcacgacccagtttataactagatgggtcagaaagcacccagttcatgataggcagttcaggtcacagggtgagttgatgacttataatcaaacgttcaatttgcaccaaagcccagtaacaggccaagagctgtctctcaaaaggagagtggttatctgaagaagatggtagggccttgctccaaaatcctagaggccttcactgtgattcacctatgggggcctgcgaaacgctccaaacagcatccctatctgacaccgacccctcaagcaccattggatctgctgggtcatatggcccaagtggcagagcagcttgcacagcagcctggacctgtgtgctgagaaggccttgcagagccttctcctgttctggatcccactcaaactggcagcctttcaggtcactcgataaatgggccagagtaatacacccaaatgagtaatgtgttgcctccaaaatccaaatagacccactagccgttgtgcctctttcttggttgtaggaggggccaaatgcagcaacttgtccgtcaccttagaaggaatatcttgacaggccccacaccactgtacccctagaaattttactgaggtagaagttccctgaattttacttggatttatttcccatcctctggtatgcaaatgtctcactaataagtccagtgtgtttgctacttcttgctcactggatccaatcagcatactgtcatcaatgtaatggactagggtgatattttgcaaaagcaaaaagtgatcaagatctctttgaatcaaagctggagcattgatgtacccctgaggtaggacagtaaaggtatattgctggccttgccagctaaaggcaaattgcttctggtgggccttttggacagggattaagaaaaaggcatttgccaagtcaatgcctgcataccaggtactaggaggtgtgttaatttgctcaagcaatgaaaccacatctggtacagcagctgcaattggagtcaccacttggttaaacttatgataattcactgtcattctccaagatccatctgtcttctgcacaggccagatgggagagttgaacagggatgtggtggaaatcaccacccctccatctttcaagtccttgatggtggcactaatctccgcaatccctccaggggaaagatactgtttttgatttactatttctgtaggtagaggcagctctaatggcttccatttggccttcccgcttaatagccctcaccctaccagtgaggcagccaatgtgggagttctgccagctcctaagtatatctatgccaatgatgcattctggcactggggaaatgaccacaggatgagtccaggggcccactggacccactgtaagtcagacctgagctaaaactccattaattacctgacctccataagcccctgctttaactggaggaccacaatgatgttttgggtcccctggaatcaacgtcagctcagagccagtgtccagtattcccccaaatgtctgatcatttccctttccctgatgcacagttaccctggtaaaaggccaaaggtctctttgtggaaggatgggagaaagattcactgcataaattgttggtaatgggctggacacagtggctcacatctgtaatcccagcaatttgggaggcagaggcgggcggatcacctgatgtcaggagttcaagaccagcctggccaacatggtgaaaccccgcttctactaaaaatacaaaaattaaccaggcctagtggcacacgcctgtaatcccagctactcaggaggctgaggcagaagaatcgcttgaacctgggaggcggagtttgcagtgagccgagatcatgccattgcactccagcctgggtgacagagcaaaactctatcgcaaaaaaaaaaaaaaaaacattgttggtaaagtagtggagaccttcctcaaagggacctggcctcccctttattcaaggagctctgggttgtgaattggctcaagtctggaaattgattgaggagccgtgattctctgtttttataattcaaatcagtgttttgtccattcaacctagacatttcctgctagtgtaaatttagtaggaatggagtaggcttcctatcaatttcacttctaggagcaccgtgattaattagccaatgccagagctctacacaagtcaaactattctgattgctgttttgcctctgctgtccattatggtagctatgcccaccttgtctttgacagttgagtgccaccacttggcccctgtgacctcagaattcagttatttccattgtatttattttttatttttatttttatttctgagacagagtcttggtttatcgcccaggctggagtgcagtggctcaatcctggctcactacaacctccacctcccaggttcaagcaattctcctgtctcagcttcccagtagctaggattacaggcacccgccaccacgcctggctaatttttgtgtttttagtagagatggggtttcaccatgttagccaggctggtcttgaactcttgacctcaggtgatccacccaccttggcctcccaaagtgctgggattacaggcatgagccaaactgcctgacctatttccattgtatttaaattttgtagttgagtgactgtggttgccactcttagatctgacatacagagaagaggaatgacagggctcttcaaagatacaggtgctgccctcagaaatctatttagcaaggcattggtcaaggctatatcttctggatcctcccagctgggatgagtaggtctaaagtcactaatgcactccaccatcccaatctccctaagccatttgatcccttcctctacattaaaccaagggaaatcaggcattttagcacactcacagtggaccatattttaatacatatttctgctaaccaagcaagtaaacaattagaaccttttttaactccccaagctgcaacattaaaagcagagtccttacttagtgggccaaatcaataaattcagcctgatccaattctatgtttcttccacaattatcccatatccttagtatccattccactgcctgttctccgggtttctgtttctataaattagagaactcaaacagctcctttcgagtgtagtgcacctcctcatgggtcacactctcaacctcacatctaggggcccactaggactttagtctcattataggtcttgaagcaaacagaggtgttgggggtagctcctgaagagaatcaacattatcttgcctggcagctgcctcaggggaggccatcgctattgcctcaggcagtgcagggtttatctccttagacaaaggtggaaaggctgatggcagcatgggtcgaggagaggatgctgctactactggggatggggaagctgttccttctggcaaaaaacgttcatcagagtttacaaactcagtgtccccgacttcatcagggtcctcccacaaatccacattccaagtttcagggtcccagtcttttcccatgaatgccctcactttaacagtagacacctggcaaagctgtacatgtatctttcattgggggtcagccactcacatgttaagagcttgtatctgtttttccacaatttcagttttctctacaggagatacgactctcactcagggcaatcttagcagatttgaggctcagtatctgtttctgaagccaggagacagaatccctgagtttatcattttctttcatcactttgtccattgaacttagaagcaaccaaccagcttcattatgttccttggttctccacatatggtcaaagatattatgtatagagtcactaaactctttgcctctcatgagtggtgaatcaggtgtgccaaatgcatttattttgtataactctctaaacagttcacaccaaggactatcagtgttctccatactattagaagtagagtccttagcatttttgggtctaatcatattaagcagccaaatccagaaaccccaaaaatgaaagaactccatccttaacattctgttcctctagaaccactcctggtaccaaaatctgtattagtcagggttctctagagggacagaatagaagatacacacacacacacacacacacacacacacacacacacacacacacacgggagtttattaagtattaactcacacgattacaaggaatcacaataggctgtctgcaagcagaggagcaaggagagacagtccgagcccccacaaatgaagaacttggagtccaatgttcgtgggcaggaagcaaccagcatggaagaaagatgtaggctgggaggctatccttttcacgtttttctgcctgctttacattcgttggcagctgattatattgggcccaccaggttaagggtgaatctgccttcctcagtccactgactcaaatgttagtatcttttgacaacaccctcacagccacacccaagatcaatactttgtatccttcgatccaatcaagttaacactcagtactaaccattataccattcatccattgatggaaaagcagttgatttcaacctgatttggggtatctaattattagggtacttgatataataaatttttaaatgtatcaggaagctaaagaacgagtcatgaataaacaaaaaatattcattataccatatggataccatagcatatttcatccattctaaaatgtggatgaaatatggggaaaaagtaggggaacctctacttctcaacttaacatctgaaactgggatcagttgtataacacttgttagtaattgcctctgcatgtgcatcataacttgcagaatggccgtcgcccacttggcagaaatttcttgagtccataacagaatgcccttaagaaatacctcatcaccaacattcttgatggtcagatgttgatatttgttaaggtctttaaagagtctgagattttaccctcctcgcaagctaacaagctacctgttaaattgtgtggatctaagcatggggtggatgctggcagaaaacatgagactccaggggttagagaaaaaaggctgcatttttcaagtcaaaagcaataggcagaatgttcaggtgatgttcatgaggtttcccaagcctcccaattcccacagggacaacacaggtggcctagatggacaaattgggttgtgttacaggagaaaaaagttgagctgggagatttatcatttttacagtgagtggcaaataggctggctcactgttgggacattacctcagcaaacaccaccctaagaaatagctaaggaaggagtggtcagggccttgcattcttggcataccctgcaagggcgtggggcactcaaggtcatggtgtagtctttcccatcaatattgtgttagaaaacagacatcagtatctgaattcaaaaatggtttagaagaattagtctatcaatataaaattatttttaatataccttaactaatttatttagtttctgttttctttttatgaatgtacaacaataatatgataaaaatctatcttaataatctaaagaactctttcaataaatgtaaaataaaaattctttttttttttttttttttgagatggagtctcactctgttgccaggctggagtgcagtggcacgattttggctcactgcaacctctgcctctcaggttcaagcgattctcccgactcagcctcctgagtagctgggactataggcacttgccaccacgcccagctaattttttgtattttttgtagagacggggtttcaccaggttggccaggatggtctccatctcttgacttcgtgatccacccgcctcggcctcccaaagtgctgggattacaggcgtgagccaccgcgcccggccaaaataaaaattctaaatgacgagaatgagaattcattgtcagtttaagtttaattggcaacattttttctttcttttcttttcttttcttttctttttttttttttttgagatggagtctcactctgtcacccagggtggagtgcagtggcacaatcttgactcactgcaacctctgcctcccacgttcaagcgattctcctgtctcagcctccggagtagctgggactacaggcgcccactaccacgcccggctaatttttgtatttttagtaaaggcggggtttcaccatgttggtccgactggtctcaaactcctgaactcatgatccgtctgcctcagcctcccaaggttctgggattacaggcgtgagccaccgtgcccggcctacattttttctttcttggtaattcataaactgatggtgtcttaaactgatgatgtcttgcaattgatgacatttgagactagattaaatatttaatgtttctcattattatgtatgcgatttatctcactgtaatttctaatttttattgttggaatgtggcaatacagtttagtcaatttaccttgcagttttgctagttctcttattctattattttatcaaattgtttttggtagttcacttggtttttcaaaatatgcaatcatgttgccttcatatggaaatattgtttacatttttacttgaccagcctgggtaacgtggtgaaaccccatcttaaatacaaaaaaaaaaaaaaaaaaattaaccagacatggtggcatgtgcctgtagtgccagctactcaggaagctgaggtgagaggatcacttgagcctgggaggttgaggctacaataagccctgattgcaccactgcactccagcctgggtgacagagtgagacactgtctcaaaacaaacaaacaaacaaacaaacaaacaaacaaataccagcatctgcattattgtgttcactggaaatggtgtggttgtatagactctagccctttctcttcagtatatgaattaacagaacaaatacactggcaaaaatagtaactgtgataaaatgtgaaaacaatgtataatttgatttgcaaaattctataacttgtaaaagatggtgttgccatagtctggatattaaatcttgtttttaaacacatggaatttaggaattaatgtgaatttaaatcactccctataagtgatataatcatataattatgtccttttgtctccatttaggtgacctagtacattaataattttaaaattatatcaaattatctttcattatacaatatgtatcttaatctgctcagcaaacaattggtaagtctccaattacttgtagactacttgttagactgggaaactgatacaaaggtaaacaagacacagtgtttcccctttaaaaaaaaagtcataggccaggtgtggtgggtcccctctgtaatcccaacactttgggaggccgaggcaggtggatcaggaggtcagtggccggttcctgccttaactgatgacattaccttgtgacattccttctcctggacaatgaatatcagaagctccccaccgagcaccttgtaacccccgcccctgccagcaagagaacaaccccctttaactgtaattttccactacctacccaaatcctataaaactgcctcacccttgtctatctccctttgctgactccttttttggactcagtccgcctgcacccaggcgattaaaaagctttattgctcacacaaagcctgtttgatggtctctctccacatggacgtgtgtgacaggagttcaaaaccagcctagccaacatgttgaaatcccattgctactaaaaatacaaaaattagccaggcatggtggtgggcacctgtaatcccagctactcaggaggctgagacaggagaattgcttgaacctgggaggcagaggttgcagtgagccaagatcatgccactgcactccaggctgggcaacaaagagtgaaactcagtctcaaaaaaaaaaaaaaagttgtatgtttaaatgcttgagcatttaaatattagacattaagtgattcataataattcagtcaaatagtgtttagttttttatttctacattttaatagtaaaatgtatatgtacagaagtatatataaaatatgtatgtaaagttaataaaatatggagtaaacatcatgaaaataccaccgaggtcaagaaagagaagattgctagctttctctttctcagagaagattgctagcttgtcgtgctccttggaggtaagcatttagacttttttttttttttttgacacaatctcactctgtcaccaaggctggaatgcagtggtgtcatcatagctcattgcagccttgacctccctggctcaagtgatcctcccacctcagcctcccaagttgctgggataccaccaggtggctaattttttttttttttaaataaaggtagggcccaggctatgttgcccaggctagtctcaaactgctaggctcaagtgagcctcctgctgtggcctcccaaattgctgggattacagacatgagccactgtacctggcccattagaccaaattttatgatatcttttgtttctctatggtttttgccaattatgtatacatatctaaacaatatggggcagggttattattattatttttgctctgtttgaaatgtgagtaaatggagtcgtagtgcagatactctttttgttacttaattatttcacttaacatattgttgcttatcatgccatggttgtccattgcatgaatacaccacagtttattatttattcatctaattatggaaatttttattgtttccagtttggggctagtatgagtgaagctgctctgaacgttattgtgcaagtttttctgtggacgtaggtttttatttctcttgagtaactatcgaggagcaaatcactagggatttctgagttacatgaatacatggttaactttaaaagaaactgccaaaccgttttttttcctttttttttttttttgagatggagttccactcttgttgcccaagctggagtgcaatggcgtgatctcagctcactgcaatttccaccttcctggttcaagcgattctcctgcctcagcctcccaagtagctgggattacaggcacacaccaccactcctggctaattttttttatattattagtaaagacagggtttcatcatgttgaccaggctggtcttgaactcctgaccacaggtgatccgcccacttcgacctcctgaagtgctgggattacaggcgtgagccactgtgtcagacctaaaccgttttccaaattggctgtactattattttgtattcaaactaacaacatatgagttccagttactccacatccttgccaatgctagaaatggccaatctttttaatttgagtaacttgtggatgtgtagtcacacatcttattatactttcaatttgcctttctctactgagtaacaatgttgaccattttctcagtgcttattgccatccatgtatcttcttggacaaagtagccaaatcttttgcccatttttttttggaagggtaggggctgtctccttattgaattgtgagattattataaatatattatgtattattattatttttgagactgagtctagctcttttgcccaggctggagtgcagtggagtgatctccactcactgcagcgattctcctgcctcagcctcctgagtagctgggactacaggcgcccaccaccgcgcccagccaatttttgtattcttagtagagacagggtttcaccatgttggccgggctgtgcttggactcctgacctcaagtgatctgcccacctcagccttccaaagtgctgaaattatagatgtgaaccacagtgcccggccagtattatatatattttagatacaactactttatatctatagtttgtaaatattttattccagtttgtagtttgccttttcagtttctttcgaagagcggatgtttttcattttgacaaaatccaatttagcaactttttcctgattaaagtttttgtgttctgagaaatctgcctggctgggtgcagtggctcatgcctgtaatcccagcactttgggaggccgaggtgggtggatcatctgaggtcaggggttcgagaccagcctggtcaacatggtgaaaccctgtctctactaataatacaaaaaaattagccgtgcatggtggcgcatgcctgtaatcccagctactcgggaggctgaagcaggagaatcgcttgaacccagaaggtggaggttgcagtgagctgagaccacgccactgctctccattctgggtgatagatcgagactctgtctccaaaaaaaaaaaaaagaaagaaagaaagaaggctaggctccgtgcctcacacctgtaatcccagcactttggaaggccgaggcagatgatcacctgaggtcaggagtttgagaccagcttgatgaatgtggtgaaaccctgtctctactaaaaaatacaaaattagctgggtgtggtggcgcatgcctgtaatcccagctacttgggaggctaaggctggagaatcgcttgaacccaggaggcggaggttgtggtgagccaagattgtgccattgcactccagcctgggcaagaagagcaaaattccgtctcaaaaaaaaaaaagaaagaaagaaagaaatctgctccaacctgaggtcaaaaggatttttctccaccattttcccattttctttcagacattttgtagcataagctcttatatttaggtctatgatgcatatcaaattaattttcacatatggtgtgaggtaagtgttgaggctaatttttttccatttggatactcaattgttccagcaccatttgttgataagactattctctcccacagtgaattagcttcgcatctttgctgaaaattgattgtccgtatatgtatatatctaatctgtatttattctattccatttatatttatatccttacatcaatacattatcattattactgtagctttataataaaatattgaaattcacggtatatgttcttcaattttattctttttctaaaattttttttggctattctagtacttctcatttccatttaaatttttaaatctgcttgtaaattctaattttaggacatttgttggaaatttgattgggcttgcattgaatcagaacatcaatttgatgagaatcaatgttaataaactcagtgtttcaactcataaacacagtatatatatatattttgagatggagtcttgctctgtctccaggctggagtgcagtggcacaatctcagctcactacaatctccacctcctaggttcaagcaattcccctgcctcgcactcctgagctcaaacaatccttcaccttagcctcccaaagtgctggggttacaggcataaacaactgtacctggccttcatgctactttattttttacgaatatatatatatatatacatttcttgagacagagttttgctcctgttgcccaggctggagtgcaatggcatgatctcggctcactgcaacctctgcctcccgggttcaagtgattctcctgcctcagcctcctgaatagttgggattacaggcacgtgccaccatgcctggctaattttgtatttttagtagagatggggtttcaccatgttggccagcctggtctcaaactcctgacctcaggtgttctgcccacctcagcctcccaatgtgctgggattacaggagggagccatcatgcctagcccttgatgccactttaaatcattattttataaatttttattaattgttggtggtacatggaattataattgatttttgtacattgaccttatatcctgcaacgttgctaaactttgtcctagtagttctgcttactggttatagtattttctgtatattctataggattttctacatagacaatcatgtctgtcaatgaagacacatttactggccgggcgcagtggctcacgcctgtaatcccagcactttgggaggccgaggcagccagatcatgaggtcaggagttcgagaccatcctggctaacatggtgaaatgctgtctctactcaaaatacaaaaagctagcagggcatggtggcacacgcctgtagtcccagctactcgggaggctgagtcaggagaatcgcttgaacccagaaggcaaaggttgcagtgagctgagatcatgccgctgcactccatcctgggtgacagagcgatactctgtctcaaaaaaaaaaaaaaaaaaaagacatttacttaagcttttctaaaccatatgtcttacatttcttgtttgccatattgtactggtcaggaccttcaataccgtattgaatagaagtggtgaacagagacattcctttttagcatatttgagacatttactctttcaccatgtgctgagaccagcttgatcggggagaccctaacccagcggcgctagaggaattaaagacacacacacacagaaatatagaggtgtgaagtgggaaatcaggggtctcacagccttcagagctgagagccttgaacagagatttacccacatattttttaacagcaagccagtcattagcattgtttctatagatattaaattaactaaaagtatcccttatgggaaacgaaggaatgggccagattaaaggaataggttgggctagttaactgcagcaggagcatgtccttaaggcacagatcgctcatgctatagtttgtggcttaagaatgcctttaagtggttttccgccctgggcaggccaggtgttccttgccttcattctggtaaacccacaaccttccagggtgggtgttatggccatcatgaacatgtcacagtgctgcagagattttgtttatggccagttttggggccagtttatggccagattttgggggccttgttcccaacaaccatgaagtttgattttagctgaatgttttccataggtgtcatttatcaggctaagttcccttttattcctaggttgccgagagcttgattatgatgtgtccatggtggttttgtctattctgctctgggttcattgagtttcctggatctgtaagcttatagttttcatcaaagcacagtaagtgaatggtatgcaatgcaggtggactgaggtgcctactatatctgatgtgcatagctgagatcacatgtatgcccagcatccaattctttaggaaagcatttctttcctattccatatggtttgcatgaccactatgccccaagactagtccatgactcaagctggactcgttgatcagagcccttcctaggacttctctgttaactgtatctccaggttagagctaacaggatgtaacactgcccatactctcccaggagtcacaggtagacaaattgcaagagcagagtgacatgaaaagagaggaactgagctagagaaggccctgaaaatattgaggctggggatgtagtcaggtggaagttgcctatacatggacattttagttttgagggccaataaattattcttttgctaaaactaacatgagacttttgttatttttatttttgctcaactaaaatgcagtgcttataatgccacactaggaatctgtaatttcttgaggaaaaaggtaggagtatatttagagttacattttttttttttgagacagagtcttgctctgtcacccaagctggagtgcagtggtgtgatcttggctcagtgcaacctctgcctcccaggttcaagcaattcttctgactcagcctcccgagtagctgggattacaggtgcccaccaccatgcctggctaatttttgtgttttttagtacagatggggtttcaccattttggtcaggctggtctcgaactcctgacctaacgattcacccccccttggcctcccaaagtgctgggattacaggcatgagccaccatacctggctacattttttaaaggaatataaaactacttcttgaccactgttcaccagtattcacaataaacaatatacaattggaataacactctgactactacaaaattatttttcctggcttctggtgaaccagtaaaatgaatatagaaaagagtgtaagggatgagcagggataaagaaaaaacatccagatcaatagtttaagataaagctttgttcttccaggtcctaaactgcaaccatctctaaccatctgattaggtttccatgaaccaagcctcagatcgtccatgaatcatgaccattgagtcaacatagcacagggatttcaactttttgtaaagaaaatgttcacgaggtgaatctttacatgttcattttagtcttgtttaaaacacaccaggctttgtctagtttcctcttctgggtggggaggttgttggcagtgataaaatttttcctttcaggaattctgtaaataaaccgttatgtttatgactacatgtatagattctgattaggtgctgtattagtccatactcacactgctgataaagacatacctgagatggggcaatttacaaaagaaagaggtttaatggacttgcagttccaagtggctggggaggcctcacaatcgtggtggaaggcaaggaggagcaagtcacatcatacgacgatggcagcaggcaaagagagagcttgttcaggggagctcctctttataaaatcatcacctctcatgagacttattcactatcacaagaacagtacaggaaagacttgcccctatgattcaattacctcacgctgggtccctctcacaacacatgggaattcaagacaagatttgggtggggaaacagccaaatcatatcattccacccctggctcctcctaaatcttatgtcctcacatttcaaaaccaatcttgccttcccaacagtcccccaaagtcttgactcatttcagcattaactcaaaagtccacagtccaaagtcttgtctgagacaaggtaagtcccttccagctatgagcctgtaaaatcaaaagcaagttagttacttcctagatacaatgggggtacaagcattgggtaaatacagattccaaatgggagaaattggccaaaacaaagggactacaggccccatccaagtcaaaatccagcagggcaatcaaatctttttttttttttttttttttgagacagagtctcactctgcctagaatgcaatgggcgatctcggctcagtgcaacctccacctgccaggttcaagcaattctactgcctcagcctcacaagcagctgggattagaggcacatgccaccagacccagctaattttttgtatttttagtagggacggggtttcaccatgctggccaggctggtctcaaactcctgacctcaagtgatccacccacctctgcctcccaaagtgctgggattacaggcatgagccactgcgccaggctgggcagtcaaatcttaaagctccaaaatgatctcctttgacttcatgtctcacatctgggtaacactgatgcaagaggtgagttcccatggtcttggacagcttcacctgtggttctgcagggtagagcttccctcccggctgccttcatgagctggcattgagtgtctgcggctttaccaggtgcacggtgcaagctgtcagtggatctaccattctgaggtctggaggacagtggccctcttctcacagctccactaggcagtgctccagtagggactctatgtgggggctgcagctccacatttcccttctgcactgccctagcagaggttctccatgacagccccgcccctgcagcaaacttctgcctgggcatccaggcatttccatacaacttctgaaatctagccgaaggtttccaaacctcaattattgacttctgtgcacccgcaggctcaacaccatgtggaagctaccaaggcttggggattgtaccctctgaagccacagcccaagctgtactttggccccttttcatcatgagtggagcggccaggacacagggcaccaagtccctagactacatacagcatgagaaccctgggctgggaccatgaaaccattttttcctcctaggcctctgggcctgtgatgggtggggctgccgtgaagacctctaacatgccctggagacatgtgattaacattcatctcctggttacttatccaaatttctgcagccagcttgaatttctcctcagaaaatgtgggaaagttaaaagctacttagagacttgttgaatggctttgcccaaaatgctgatagcgatatggacaataaggtccaggctgacctagtctcagatgtaaatgaggaacttgttgggaattggagcaaagatgacaaagataactcttgttatgttttagtgaggagactggtggcattttgcccctgctctagaaatttgtggaaccttgaacttgagagagatgatttagggtatctgtcttcttctaagccctccaaactgtcccaaactctgtgtgttacccagttccaaaggtgcttccacattttcagatatattttcagcaatgccccactctactggtaccaatttactatattagtcaattttcatgttgctgatagacataccctggctcacacctgtaatcccagcactttgggaggcaaaggtgggtggatcacaaggtcaggagttcgagaccagccaggctaatatggtgaaactgccccccgcccccgtctctgctacaaaaattagcctggcatgctggtgaggacttgtagtcccaactactcaggaggctgaggcaggataattgcttgaacccaggaggcggagggtgcagtgagccaagatcatgctctgggcgacagaatacccgagactgggtaatttatacaggaaagagggtttaatggacttacagttacacgtggctggggaggcctcttaatcatggtggaaagcaaggaagaacaagtcatgccttacctgaatggcagcaggcatagaaagagtttgtgcaggggaactcctctttataaaaccatcggatctcaggagattaatttactatcttaacagcacaggaaagacttgcccccatgattcaattacctcccactgggtccctcccacaacacatgagaattcaagatgagatttgggtggggacatagccaaaccatatcaggtgcttttaaaatatccaatttggctgggcatgctggctcatgcctgtaatcccagcactttgggaggccaaggcaggaggatcacttgaggtcaacagttcaacaccagcctggccaacatggtgaaaccccgtctctactaaaaatacaaaaatcggccaggtgtggtggtgcatgcctgtagtccccgctactcaggaggctgaggcaggagaatcgcttgaacctaggaggtggagattacagtgagccaggatcatgccactgcactccagcctgggtgagagtgagattccatctcaaaataaatacataaataaattaaaatatccaatttaaattatgcaattaattaaagaatcatctatttaatgtcatgacttcaggaaaattttcaatttaacatgaagtgatttattttgtaggatcctctgaatgatggcatctcagaaatatgggcttactcatgattttttgttttggtgaatggttaaaaacaacaaaagacggccaggcacggtggctcaagcctgtaatcccagcactttgggatgccgaggtcaggagttcaagaccagcctggccaacaaggtgaaaccccatctctactaaaaatacaaaaattagccaggtgtggtggtggacgcctgtaatcccagctacagggagctgaggcggaggtcgcagtgagccgagatcgcgccattccaccccagcctgggggacaggagcaagacttcatctcaaaaacaacaacaaaagaaaaatgtttatatatccatattacgtatacacacacacacacaaaccacaatggtccctaagtatatgataacaaattctaattgagtaatgactacggaaattaccctcgacatctagaaaagctgttctctaatgccaaggaaataatatgccatcgtatcaaacattcttttccgataagggaagcaaccacagaaagctttcatttgttgaaagtaaccagtgctattgatgcaaacaaaacaaaatcccaatgactctccccaaactacttttatttatttttgtttgagtcagggtctcaatctgtcacccggactggagtgcagtggcatgatctcggctcacggcaaccactgcctctcggtttcaagctatcctcttgccccagcctcccaagtgactggattacaggcatgtactaccacacctggctaatttttttttttcttcccgagatggagtctcgctgtgtcacctgggctggagtgcagtggcatgatctcggctcactgcaaattccacttcctgggttcaagcgattctcctgcctcagcctcctgagtagctgggattacaggtgcccaccaccacacctggctaattttcatatttgtcggtagagacggggtttcactatgttggccaggctagtcttgaactcctgacctcaggtgatctgcctgcctcggtctcctaaagtgctgggattacaggtgtgagccgttgtgcctggcctaatttttgtacttttagtagagagagtttcaccatgttgatgaggcaggtcatgaacccaaattactttttttttttttttgagatggactttcgctcttgttgcccaggctggagtgcaatggcacgatctcggctcactgcaacttctgcctcctgggttcaagtgattctcctgcctcagcctcccaagtagctgggattacaggcatgcaccaccacacctggctaattttgtatttttagtagagatggggtttctccatattggtcagattggtctcgaactcccgacctcaggtgatccaccttggcctctcaaagtgctgggattacagatgtgagccaccgtgcccagccataacccgaactactttcaaaatgaacatatcaaacttgatttttattagaatgcagctatttcttcacattagtaaagcaaaaagcaagagcccggttttatatacacttcatgttttgttcttttgctaacaccaagtctgctttatctgaattttccatttcatgagtatcatcaattctccactgctgtctgcatagccaattatttttttcaggatcaaggtctcttggtttgtctgcagtatctctttccttgattttatgttatccaactgtcaggtaaatattttcttcttgtatcatctttttctttaacagcttttttgagaattaaatgttccaagtaactcttgacaagcttaagtttcttcaggttcccaagtactttcagcatctataaatcccttccacatcaggaaatgcactaccttaccattcatcacacattgatccagtactttttccactacaaattcttcaggctctgcatcaattttttttttggagatggagtttcgctcttgttgcccaggctggaatgtagtggcgcgatcttggctaaccacaacctccgactcccaggttcaagcaaatctcctgcctcagcctcctgagtagctgggattataggcatgcaccaccacactcagctcattttcgtatttttagtagaaacagggtttctccatgttgatcagactggtctcgatctcccaacctcaggtgatctgcctgcctcggcctcccaaagtgctgggattacaggcgtaagccactgtgcccggccccaacttttttattctattgtttcctttccatttttttgctcaccacctcatattgctctgggttgaaggtctgccgtgtctccagccctgcatgcctcaagctcaagctgcgtctcaagggctaaatttagattttaaaaagaccactctgtccttggtgtggaaacagagatggagaggtcaaagtagaggcaggaagaccactttgacactgttttaagcatccaagtgaaacagagtaactttaatccaccctgaaagcctaaagtaatgagacaattgggcagatatgggggatatcaagtagacttgcttaaaaactggttttgaagggaggacaatgtaatgattttcatattttctatttgagacaataaagaggtagaaaacaaggaagaacagcaagagtgggcagagggcagagagggatgagttcaggtttggttgttttgacagaggtgctttagggggtcatttctaatgtgggttgaaaacatacatggggatcccggatcccacatggtaaattgattttgttttgtttttgagaccaagtcttcctctgtcgcccaggctggagtgcagtggtgtgggatttcagctcactgcacctctgtctccaaggttcaagtgattctcatgcctcagcctcccaagtagctgggactacaggcacccaccaccacacccggctaacttttttgtatttttggtagagacggggtttcaccatgttggtcaggctggtctcaaactcctgacctcaggtgatctacctgccttggcctcccaaagttctgggattacaggtgtaagacactgcacctggcccttgattgatttttaaagttttattatttggcttcaatctcatttatatatgaggaaaacgaagctcagaagagtttcaatgatttaatggaagacttaaaatattagaaaaaagttttattcttaagagaatttaaaagaagacattaatagaaaatgaaaagaaattgtgaaccctttcaaaacctttcaattcaatgttctagttcttcatttccttgatacaactctgtaccatggtcataatttttccgtctcatgaataggaggaaaaatgacaggaatggagactaccctgaggaatacttttgagatcagtggataggtgttcaatgaataagtcaggtatacctaaagaaacactaaatgtacatgtacatcagtcagtatctcatagcataaacagttagtcaagatagctttctctttcctaaccgttttgccatactacaatgatctagttaaaatacaaatttcacaacttcaatgattcttcactgcccacaattaacgcactgtttcatagactatgttctaccaattatacattgcctacatataatagtcactataaagaaataatggacaggcatggtggctcatgcctataatcccagcactttgggagactgaggcaggggaatcacttaaggccaggagttttgagagcagtctgggcaacagagtgagatcttttggctacacaaaaaattaaaaaaaaaaaaaaaaaaaaagtagggggggtggggctaggcgcagtggctcatgcctgtaatcccagctctttgggaggccaaggggggtggatcacctgaggtcaggagttcaagaccagcctgaccaacacggtgaaaccccatctctactaaaaatacaaaaaaaaaaaattagccaggcatggtggcgcatgcctgtaatctcagctactcgggaggctgaggcagaagaattgcttgaacccaggaagtggaggttgtggtgagccaagatcgtgccattgcactccagcctgggcaacaagagcaaaactcagtctcataaaaaaggctgtggtgagccaagattgtgccattgcactccagcctgggcaacaagagcaaaactcagtctcaaacaaacaaacagacaatagcagggtgtagcagcacgtgcctgtagtcccagctatttaagaggatgaggtgggaagactgagttgagcccaggagctcgaggctgcagtgagccaagatcatgccactgcactccagggcaagcccttgtcttcaaaaaacaaaaaaattcaaaaaagtaatgcgttgaacaaacaccaagtacaaagtatactaatacagtggataaatgctactccaactctgatccactgactgccaggatcagcatgacactacagatggaactcaagaatctgtcataacaggctatccggctgattgttctgaatgtgaaagttttagaaacactgttccaagggtaaaaatgaggggacctaatttcttctctcttaggaatcttaccccccaaaaggtattgcaagcatctgttgtggggctggaattcctaaaacctctcaaagcatgctgtgtgaataaaaggacagtgttcagatttctgactctaacagaccatctaaccatggaagcctacagcccttttaaaacatgtactttcaatgttgtgagctgagtatatataacaacatattgctagtatgtaaatgtgcttaaaacaaaaatgaagttcttatctctagcagaactggagtcacacctaaattacaacattcagacaaggccttccttttaagtagacatgacagaattttaaatttataaaacgaattaatgtatcgcatacattcactttacatattcaaaaaacgctaaacttaagaaactgaaaagttgaaaaataagaggtagtagtacccactgagtgacgttctggcattctattaaatattctacattagaagattatagggaaaagggagctgaattctaagagaacaaatgtagagaaggcaaccctatggtcttgggaaaagacaataatggaaggaaaaatatattcaaaatgtattgtacaaattgttagacatgcatcacttacaataaacagaaggtaattatttgtggtagcataaagagagaagggaataggccaggcacattggctcacgtctgtaatctcaacactttgggaggtggaggcgggcagatcacttgaggtcaggagttcaagaccagcctggccaacatggtgaaacccatctctactaaaaatacaaaaattagctgggtatggtggcgcacacctgcaatcccagctactcgagaggctgaggcaggcaaattgcttcaaacctgtgaggcagaggttgcagtgagccgggatcgcaccactgcactccaggctgggctacagggtgagattctgtctccaaaaaaaaaaaaaagagagaaaggaatagagtgttttgttagctctggtcattcccactcttcttctctcttgttgctattactttgaagcatttggtttggttattctattttgttaaggaataattaaaaagtacattactaacagttttgctttatatattgtgtgccttgggcaaaatttgtgtgtgtggttattcacagaggaggagccagataggtagctcagtccataaactatggaaggtagcagtatcctttactgcagtggctttcaaatttgacatgcaccaaaatctcctggagagcttgttaaaacatagaaagcagggcctcatcccccacgtttttgattcagtaggtctgggttggggctcgagaatttgcatttctaacaaattcctaggtgatgctgatgctgatgctgatgcttctggtttggagcacatactttgagaaccactgctctaatggaatcagtagtcacaaggccaagcagccaggtagacactaagggaaaacagtacctccctgtgtaggttttcaggacacaacattagttacaagttttatcacctgctcaaccaggtatatagctatgtcaattctcaagggctttaactgacaaaaccagttgttagaggacagttctttcaagggtgaacccaacacctaaaaaaagttttgaaaaagtcagttatttgcctatttaaggacggttttagaatccactattatgggaatggatctgcttagcctatttgaggtttttttgttttttgagacagagtctcgccctgttgcctgggctggagtgcaatggtgcgattttgactcactgaaacctctgcctcccgggttcaagtgattcgcctccctcagcctcccgagtagctgggattacaggcgcccgccaccacgcctggctatttttttttgtatttttagtagagatggggtttcaccatgttggccaggttggtctcaaactcttggcctcgtgattcgcccaccttggcctcccaaagtgctgggattacaggtgtaagtcactgtgcctggccgcctagtggagttttaatgccaatatccttggactaacttgaaaatgaataatataaattcgaaatttctgcctgcagtacaattcaaaataagagtttctaaatttttttaatccttatgttaaaataataaataatctcatttcagttgttttttcacccaattactaaaaaacaaaatagtcataaaaaagaattcatttagcaaaggtactatttgtagatattagccacttattaaaaacatatttctattaagattgttcttacattcttagatttagaacacctgatatctggacccagctgagtttttattttacagatcataaaacggatgaaagtatatcacagtaattaatgaagccgttctaatttagcttgaagagatttaaaattcccagtgatggcttgtactgctactgacgagctcatagactggagctcaacaaggtaaccacaaacagcatccaggcagagatttgtaaatcttctcctacaacgaaaaagacacatgattaattatacatttacaaacatttcctcctgcaggacttcttccccaccaacttctggcaactttaattctcacaggagaggaaagaccatgtgattaagtaaataagaaataaagtaaaaaagaaaacttgggtgtaggtgggttccatttgaagattttttttttttttttgagacggagtctcgctctgtcactcaggctgcagtgcagtggcgccatctcggctcactgcaacctctgcctcctgggttcacgccattctcctgcctcagcctcccgtgtagctgggactacaggtgcccgccaccacgcccagctaatttttttgtatttttagtagagatggggtttcacgtgttagccaggatggtctcgatctcttgacctcatgatccgcccatctcagcctcccaaagtgctgggattacaggtgtgagccaccacgcctggcctgaagatttttacaatgagaagaaagcagtaagagatgattcctgctaatattctttttcaaaagaatatcccttaaatggccaataatatcacaaagacataattgaaatgttttggtcctagatcactaatctaaagtagaagaaatgaatacattatgtatgttcagctgtagaaaggatttaggacaagggttgaaaatggaaaaaactcctatttttcatacatggtgatcaatatcattcaaatagttattgctaatatacacaagaatcttcccatcttctcttcaaattttttacccaggtatttattagaagcatttaaaagcttttgctgatccaatatttaattcataagtacctttcacaatttaaaacttggctgggattctcaacatatcttatcaataatacatgtatacaatccaaaaggtgcagtggcttcttcattctgttccagaatggatcctatgaagaaatatacataatgaaatgtgaggcaaattgtgtcaattgattatttaaatcatttatactaaagtagacatcaggatccatgcaaaacttatcgctattaaaaagcatttaatatcacatggctactaaattatatatctgattatagttaatatttcaaacaacattaaaaacttattaattaacaacactatgatattacttaggaggcatatttgatataccaatctactttgcagagcatgtaaatgtcccgcttaggaatctgagataagagaaaaatctttctttctatgggttgtgacaccacttttactttgaacctatgcagatttagtctgacatcataaagagactaaactagcagtaacagaaacttaattctaggtctggcttcaccagttactagccatgtgacttaagcaggttatttaacatctctgctcttgttttttgcaatataagatggagatactacagttacctgctcatttccatcacaggctaatgttgtaaagcactgtgtgatgctgctataaaagacacaatctactttgacaagtttttatttggatcttttatccttagcataaaaattacaaaacatatagtctgataaggttcagcagggtgagaaggatctttaagcactgatattttagatgaggttatagtaaataaatacaatgtaatcttgttcttttaaagcaaatgatgattcttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcaacagagcgagacgccgtctcaaaaaaaaaaaaaaaaaaaaaaataaagcaaatgatgattcttaatgtaatgagtttagcccacaccttggtttagcctctttcaccaagagtaaagcatatttattaatattcaaaaataatatttcattttaatcatgatatacaggaaagcaactctcattatcagtttaaaaagtcaaaagcataatttccaagactcaaccaagtgtaattagactaagtgataggatacaaaaatgcaatcaaaataccccactctatatctacaaagttactttaattaaagaaaataattttatgttatttaatattttccttacccgtgatttgaacaactgatcataaacttctagtagtctaggtaatggtactccaatttcattcattgtctgtattacgaagcccacatcccagttcaaagtacaaacctgctgttctaaaaactgtacaataaaatctgggaagaaaaaaaaagatcggaaatttggatttttagctcttgatactaaaaggtaggtcttattcataactgaatagtttctagggggatatcttctgaaatccaattgcaattttttggggcggggggttttttttgctatgttgcccagactagaaatagtggctattcataggagcaactacagtgcacgacagccttgaaatcctgagctcaatcctcccacctcaacctcccaagtaagctggggctacaagtgtgcaccatcactctcagcttaaaagaaaaaaaaagttttttttaaataaaagtaagatatataccagaacaggcaaatctaaagtagattagtggctgcctagggctggagggtgtgaaggaatgggaagtgacaactaatgagcacagagtttctttttgggatgatgaaaatgtcctaaaattaaaattacagaacctagaaaactcagaaagatataagaagaaaacagagacgattcacgatcccaatattgaagaggacttcactgataattttttttagtaacagtatttaaaaaaaataggtttcctgtccctgtccctctccctgtccctctcccctctttccaaggtctccctctgatgccgagccgaagctggactgtactgctatctcggctcactgcaacctccctgcctgattctcctgcctcagcctgccgagtgcctgcgattgcaggtgcgcgccgccacgcctgactggttttcgtattttttgggtggagacggggttttgctgtgttggccgggctggtctccagctcctaaccgcgagtgatccgccagcctcggcctccagaggtgccgggattgcagacggagtctccttcactcagtgctcaatggtgcccaggctggagtgcagtggcgtgatctcggctccctacaacatccacctcccagcagcctgccttggcctcccaaagtgccgagattgcagcctctgcccggccgccaccctgtctgggaagtgaggagcgtctctgcctggccgcccatcgtctgggatgtgaggagcccctctgcctggctgcccagtctggaaagtgaggagcatctctgcccagccgccatcccatctaggaagtgaggagcgcctcttcccggccgccatcccatctaggaagtgaggagcgtctctgcccggccacccatcatctgagatgtggggagcgcctctgccctgtcgccccgtccgggatgtgaggagcgtctctgcccggccaccccgtctgagaagtgaggagaccctctgcctggcaaccgccctgtctgagaagtgaggagcccctccgcccagcagccgccccgtctgagaagtgaggagcccctccgcccggcagccaccccgtccgggagggaggttggggggtcagccccccgcctggccagccgccccgtccgggaggtgaggggcgcctctgcccggccgcccctactgggaagtgaggagcccctctgcccggccagccgccccatccgggagggaggaggggggggtcagccccccgcccggccagccgccctgtccgggagggaggtgggggggtcagccccccgcccggccagccgccccgtccgggaggtgaggggcacctctgcccggccgcccctactgggaagtgaggagcccctctgcccggccaccaccccatctgggaggtgtgcccaacagctcattgagaacgggccatgatgacaatggcagttttgtggaatagaaaggggggaaaggtggggaaaagattgagaaatcggatggttgccgtgtctgtatagaaagaggtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgcggcagcatgcttgttaagagtcatcaccactccctaatctcaagtacccagggacacaaacgctgcggaaggcagccgcagggtcctctgcctaggaaaaccagagacctttgttcacttgtttatctgctgaccttccctccactattgtcctgtgaccctgccaaatccccctctgcgagaaacacccaagaatgatcaataaaaataaataaataaataaataaataaataggtttcctcactttaacagcttttcagaaaagggcaactgcatcctgatttcagaaatattaaatgtgttttttaatgccccacccctagatttatttgacagttctaactgtggcctcattcttacttttaactgcctatcttatcataaacagtaacagccaaatttatagttatggccaggcgtggtggttcgcacctataatcccagcactatgggaggccaaggtgagcagatcacctgaggtcaggagttcgagaccagcctggccaacatggtgaaaccctgtctctattaaaaatacaaaaaaattagctaggtgtggctaattcaagactagcttgggcaacaccatgagatcccttctctatcaaaagaaaaaaatatatatatataagtaaaacatagaaatcctcctaactcagcctgattagctaggactataggcacgtgctaccatgcctagctaatcttaattttttttgtagagacggggcttgctatgcccaggctggtctcaaactcctggcttcaagcaatcttcctgcctttgcctctccaaagtgttgagattacaggtgtgagccaccacacaaagcccacatgattatttctaaattaaaatgaaaattccttaaaaagaactatgtacaatacagtgttatttatttatttattgaaatggggtctcactgtgtcactgaggttggagtgcagtggttcgatctcagctcactgcagttttcacctcccaggctcaagtgatcctcccaccatagcctcccgagtagctggaaccacaggcgcatgccactatgcctggataattttcctatttttttgtagagacagggttttgccatgttgcccaggctggtctcgaactcctgggctcaagcgatccatccgcctcggcctcccaaagtgctgggattacacctgtgagccaccatgcccagccatggtgcagtgttttttaaaacaactatcaaaagtaccagtttcacacacttataaacatttatataaagtatgtatttgctcttttatttctctttatttttaggatcaataaaatggtatggaaagggaaccgtttccatattatacctacaaaagtaagggtatgaataaaatggttttatttctgactatgtccagagggaatagaccctaagtcagagatggtctgtaaacaagtttgaatgctcatttgaaaaaaaaaaaaaaaaaattaggctgggcacagtggcgaacgcctttaatcccagcaccttgggaggccaaggcaagcggatcacctgaggccaggagtttgagaccagcctagacaacatggggaaacctcatttctaataaaaatacagaaaattagccaggcgtggttgcaggcacctgtaatcccacctacttgggaggctaggcaggagaactgcttgaacctggaaggcagaagttgcagtgagccgagatggcatcattccactccagcctgggcgacagagaaagcctctgtctcaaaaaaaaaaaaaaaagttatattgtgaggattttcatgtctctcaatatttttaaataacacaaaagtagttgatattctaatttatggatgtatttatgttgcttctattgttttaccactgaggaaaacacttgtaggttggcaaatagctcataattagctaccttatttaaaaattatagccaccatatctcattaagaaagggattcaaacactaagttttaacataattatttgctattttaaagaaaaacatgccctcaacataaaaaaagaacagttgaatcaatcacagattacctatgcacaaaaacatcaaccgtttttcttttctcttcagaaacttgtatagggttaccaacaatataatcatagtttgtcagtcagcacaatcctaagacaggtaatataaacttggaaagttagtcacagaaagtttcatactcaactcttcattaacaaattctgccattctttggaagtctttccggagaggcagaattaaagtgctgaactaaatagcaaagaaactctttattttactcgaaagatcgttatttgtccatatcaacggagaaaaccatcagaacagaaaatacgtgactgcacctaagatcacagcttacctaaaggaaagaagcgtggtgtgccagcataaattttgccaaggagaacaatcttgagactaagagcatgcattctatccgaggagctcaatgtcacactgtcactcaattctgtaacaaaaagacatgtcatttgaaacccaaattacttttaatgtgaaatgtttacattggttatttaattctgtttcaaggttcaaaatactttagaacagatagtcacattaatatgattaacagatttggtgtttctgttattgtctgagatactctcatgtcttaccaggttatactggttattagattctgaggtgagtgtctcagtatcttttataaggcagcacaaataatataaattaaataaccttttcactgagtattctcccgaatattcacttgggtcattctgtgtatgatcatcctccaccatacccaggtgacttccacttactctcttcttaggtatacacaattttcatgagccactagcagcttgcattatattagttactagcagcttgcattcctccaccaagtcactacataacgtatgctaacatacctataactgaacacttacctttctctatgatatcttgccaaagtgtctgcaccaatatagggtctgaataaccggcacaatgaattattgcaagtttgcactctgcaagtttaaatgggtcagcaaattccccataaagctgtgagagaaaatcccaaaattaacatccaactagagatcaacattcagagattaatagtgaagcactccttgaaaattaaaaaataaccaaagattttacataaagtttctgaaatatgatataaagatgtgatgatgtatgtagctggttataactccatatttaaaaagttaagggtatgggccgggtacggtgactcaggcctgtaatcccagcactttaagaggccaaggtgggcggatcacgagatcgggagatggagaccatcctggccaatatggtgaaaccccgtctctactaaaatttaaaaaaaaaaaaaattagctgggcatggtggtgcatggctgtagtcccagctactcaggaggctgaggaaggtggaggttgcagtcagctgagatcacgccattgcactctagcctggtgacagagaaagactctgtctccccccgccaaaaaaaaaaaaaaagggtaagggtatggtaaatacattcaaacacattttagcatgtagagcttttttcttggctgggaagaagatgttgcaacgacattctatttattaattttaaaattcattttttcaaatttctgtgggtacacagtaggtgtatgtatttatggggtacatgagatgttctgatacagtcatgcaatgagaaataagcatgtcatggagaatgtctattcctcaagcagttatccttttgagttacaaataatccaattacattctctattttaaaatatacagttattattgactatagtcaccctattgtgctatcagataggtcttattcattttgtttttgtacccattaaccatccccaccttccctacaaacctcctgcaatggtattttagaactagtgttgtataaacaatgggttgaagaatcacaggaatactgacaaatctcaaagtgtttcagggtacctggaactatgtctaagaataaatgaagaggaaggaactgctcagaaaattacagagagagaaagaggtttagagagttaagcaaagataagttagtttttccaaggcaagaagcgaggccataaataagatggttttggttttttagtttttttttctttttgagacagggtctcactctgtcactcaggctggaatgcagtagcaccatcgaggctcaccacaacctgggcctcctgggctaaatcaatcctcccacctcagactcctgagtagatgaactacaaccacacaccaccacacctggctaattttttttttttttttttgatggagtcttgctctgtcgcccaggctcctagactgcagtgccatgatctcggctcactgaaacccccacctcctgggttcaagcaattctcctgcctcagcctcccaggtagctgggattacaggcgcatgccaccacgcctggctaatttttgtatttttagtagagacagagtttccccatgttgaccaggctggtctcaaactcctgacctcaggtgatctgcccgcctcagcctcccaaagtgttggattacaggcgtgagccacagtgcctggccttttttgctatttttttgtaaagatgaggttttgccatgttgcccaggctggaaataagctggttttaacacagctctcatgcgaggatgataggttctttgtagctactggcctggaaagagtagcttagcctttttctaggagtcagatgaagcagtggtgatctgtcagcccagtgacaagctgccaaagatgccttatcttatttgtggagataaggtaattttccccatgaaacaaaaagcaaaataaaaaacaaaaatttctcattattaggtaactactataaaaatttcacttgcttttttattaccttagttatgtccatcagctcagaatccagctgagaaactgcatcctgtacagaagaatgatgggaatactgcctttgtagtgtctcctgtatctgaagttggatcctagcaacctagtttgggcagaaaacaggatgtcttaatttatttatgataaatcaacatacgtttgaaagaacggatcctactatctgactttaagtttgctaaaataatgtataaatgaagatttctatcataataggctaatattatcataacagacatcaactaaacataatagatttcacaggaagtatactgtggcagactccttgctgcccaatacttataccttccaagactgtagccaaatggttagactatacagctcagcctcctctgtaggggaggtatggccatacaaccaagttctcttcaaaggaatgtgagtagaagtagtgtgtcatgtcagggctatagtttttaagacagtgaatgtgttctttcttttccttccaccctctgctgaagataaagcagaggccctagggaatggtagtgccagaaaatagaacttgggttcctaaatcaaccacacggaggaaagccagctgccaatcaggaagactcaccttggatttttgtgaataagaaacaaacttttgtatttggacgatggtatgtttttgattctcttagttagggaattttagcctactctacttcatacatctacttatttgcttccaaaataaatggtgaatgtgatgtaatccacttgctgttgaaacagttgggaaaaacatttattttttattattattattttttgagacagagtctcagtctgtctcccaggctggaatgcagtggtgcaatctcagctcactgcaacctccgcttcctgggttcaagcaattctcctgcctcagtctcccaagtagctgggactacaggtgtgtgccaccacccccggctaattcttgtatttttttaagtagagacaaggtttcgccatattggccaggctggtctcgaacttctgacctcatgatctggctgcctcggcctcccaaagtgctgggattacaggcgtgagccactgcacccagctgggaaaaacctttcgaagtgccaaagagaaaacttctaaattatagcaatgtttttatgacccaagtgcatccttaaaaatctttaagatttatatctaaacataaaaataaatataaacagacaaaagcaactagaataataatgacttctcagacctattacttaccaagggaagaatggaatgtggaataactatgtggctagtactcaatgtggacacagcttaagatctttagcacttacctccattttttcttctaattcatgaagaaattcaccatcggcagctattgatgaaatggcagtggaacttttggcactaagaatggctcgagcaatgtactctagtcgctgctgaagtgaaatttctgtgctagaagggaaaacgcttatttttagttacacaatttcttaaggattgatgatacaaatacgtcaattagtatgtactgtttcataccaaacacacataaaaagccatctgaaacttgaaaaaaaatcattagatttaaaaaaaaatctattttagatttctcataagagagatccacaattttagacaacacataaagaaatacatttatgactaaaaagtaacatcctatttaaaaaatttaggtcagtatattaaaacttagattcttctaaaattaaagaaaactgaatgtaagtacatatagctcagttttgaatcattcttcacaataagaatattatgccatacctatgcatgtcagccagtctggacagtacacgagcagcattactgaaacttctgttcttctcgtaataccgccagagtaaatccatataacgaactctgttttgatcaactttggccattcggactagatgtggctccagaaatggagaagcaacctagaaattatatagttattcagaaaaattttctaaccacctacagataatgttcctgataaggaaaatatagtatttttaagtcaactacaactttgccttgttttatgaaaacaagcaaaattataatccaatactaacagataaaagagagggcaaattttcttattataaacaatttttgttttaccacagttagcataagagtttccaaaacaattctattaggttgataacaataatttagtaggctgggcatggcgactcatgtctgtaatcctcgcactttgggaggccgaggtgggcagatcatgtgagctcaggagtttgagaccagcctgggcaatatatggcaaaacctcgtctctacaaaaaaattagctgggtgtggtggtgcgggcctatagttctagttactcaggagggttaggtgtgaggatcacctgagcctagggaggtcaaggctacagtgagccattatcgtgccattgcactgcacttcagcctaagctacagattgagaccctgcctcaaaaaagaaaaggaaatttggccgggcacagtggttcatgcctgtaatcccagcacttcgggaagctgaggtgggcagatcacctgagctcaggagtttgagaccagcctggccaacatggtaaaaccccgtctctactaaaaagatataaaaattagctgtgcgtggtggcgggtgcctgtaatcccagctacttgggaggctgaagcaggaggattgctggaacccgggaggcggaggttgcagtgagctgagatcatgccactgcactccagcctgggcaacagagccagactccatctcaaaaaaaaaaaaaaaaaaaaaaaagggaaatttactataaaattacaaatttttaaataaactttgataacacagctattgattcctagacattgagctcaaaggcattattgaaattatcaaatgctatgtattcattaaacagattgaggaacactgaaacttagggtaggtaaaaggacatatctgaagtcacagtgacttaacagcagagttaagataagatgacctacaggactcatattcataatccagtgatttctaccccgcaatacaaactatcccaatcagcttcgaattaacaagaaaattggagcagtagcctactttgccccttaggaaaagatactgcattactcagctttatactaacatctaatagcaggcatgggatgagaaactgaattttttacatctatatatgtgcttaaatcattgagttatgctccttaagaataattaacacaactgcaataaaaaaagatttacctgtagcagcttatctgcaaggtcgacttgtattagccaattataaagggcaatactaaagagctcatccttggatcgctgtgacaatttaagcatttgttcaaactaaaataaagaaaatagtaaaaattagcagttaaaggctctgtttctgggcatcacaaccctttagccctataaactccagtaagaaatcaagaatccttacatgataacttctaagaactaccacctttccccaagatgactgtgctaccattaccatggagaacttctaaacagtgtattctcagaatgaaaatatactatgtcccttacatgatgtcctgcttcttcattactcagcatatttggatcagatgacaacactggaggaccaggttttttgggtacactgggagactgaggagcggccttactttgatttaccagttcttgaagtgtgtctgtaatgcatttgtaactgtttaatctgaaagaaaatggaaaaggaacaattacattatttaactagaaagcaaatgatggtaagtgtggtgactcacgcctgtaatgccagccatagggaagtcaaggtaggaggacggcttgaggctgggagttcaagactagccagggcaacagagcgggaccacgtctctacaaaaaatacaaaaaaattggctgggcacagtgcctcacacctgtaatcccagcactctgggagacgaaggcagggggactgccagaggtcacgaatttgagaccagcctggccaacctggtgaaaccccgtatctgacaaaaatacaaaaattagccgggcttggtggtgcatgcctgtagtgccagctattcaggtgagtgaggcacaagaattgcttgaacctgggaggcagaggttgaggtgagctgagatcatgccactgcactccatcctgggtgacagcaagaccctgtctcaaaaaacaaacgaacaaaaaacaaaacaaaacgaaacaaaaaattaaccaggcgtggcggtgtgcacctgtaatcccagctacttgggaggcagaggcaggaggatcgcttgagcctaggaattcaaggctgcaagtgagctattatcatgccactgcactccagctcaggcaacagaatgaggccctgtctcaaaaacaaaaaacaaaaccccccaaaaacaaaacaaaacaaataacaaaaaagaaagccattgatttaccttacctaagtatatacaaggatttcaagactatttggcagaatagatgtacatatttggcatttaaaataatacaaaccatatactttttcaataagtttgagaagtgtttggttaaacattaaaagggtaaagtcattaaatatagtaataaaaaaatatgttttcgccagatgtggtggctgacacctctaatctcagcactttgggaggctgagaagaaaggattgcttgagcccaggagttaaagaccagcctgggcaatatagtgaggccctgtctctacagaaattaaagagaaaaaaaaaattagccgagtgtggtgacatgtgcctgtagtcccagctactcaggaggctgaggtaggaggatcactggatcacttgagcccaaaaggtcaagagtacagtgagctatgatggtgccactgactccagcccaggagacagagtgaagctttgtctcaaaaacaaaaacaaaaacaaaacaaaacaccctccatatatatatgttatagaaaggttatatatttcttctttgttccgagacggagccctgctctgacgcccaggctggagttctgtggtgcaatctcagctcactgcagcctctgcctcccgggttaaagcaattctcctgcctcagcctcccaagttgctgggattacgggtgtgcaccaccacgcctggctaatttttgtattttagtagagacagggtttcactatgatggccaggctggtctcgaactcctgacctcatgatctgcccacctcagcctcccaaagtgctgggattacaggcgtgagccactgtgcctggcctatatttcttttaaggacacacatttcctttttaacagtctcaacaaatttgggaatacttaaaaattatcctttaaaatgaaatcctactggacatggtggctcatgcctgtaatcccagcactttgggtggtcgacctttacacaaagaggccagacacggtggctgatggctataatcctagcactttgcaagactgaggtgggtggatcacttgaggttaggaattcaagaccagcctggccaaaatggtgaaaccctgtctctactaaaaatacaaaaattagccaggcgtggtggtgtgcacctgtaatcccagctacatgggaggctgaggcacgagaatagcttgaacctgggaggcagagattgcagtgagccaagatcacacgactgcactccagcccaggtgacagagcaagactctgtctcaaaaaaaaaaaaaaaacataaaacaaaaaacaaaaaacattatgcaaagaaaagtctgtatccataaagatgacaatctgctaacgtaatggaatgcacctttcttggaaggcctgaagtccaactatgtcttcttctggttctccatgtttatagaaatgaagcccaagaccttgaggatcttttttctctgcagccgtaagagaaagttccaccacaccctcataaaatctcactgatgggaaagaaaagaatgaagacctatgacttactactaagttggatacatttttccttagctggcacatgaaaataatgatcaaggttatgtctctactgtacaatagtcaccctgctaacataaaatatttctgataggtcttcagaaggaaaaggtcttaatatgcctaaaaggcaactgttaaatatatttcttcattgggggccaggtgtggtggctcacgcctgtaatcccagcactttgggaggctgagagggggcagatcacaaggtcaggggttcgagaccagcctgaccaacatggtgaaaccccacctctactaaaaatacaaaaattagctgggcctggtggcatgcgcctgtaatcccagctactcaaaaggctgaggcaggagaatcacttgaactagcgaggcagaggttgtagtgagctgagattgcaccattgcactccagcctgggtgacagaacaagactctgtctcacaaaaaaaaaaagaaaaaggaaaaaaaaaaatatatatatatatatatttcttcattggaaaaaaaagatcctatttcaaataacaaaaaggaaagttttagttccctactggggggaaaaaaataccttgggattcaaaataatacctgtgcaaatagttatggcctttacattatgttagatttgatttaaagtaattttttaaaaagtaagcagattataccttaaaactcaataaaaaattttaaatatctgaaaaataaatgtaatccagaaagcaatgtaaaacatacagtaattgaactggacaagaactgaaactctaatgctaaaaagttatacatttcggctgggcgcagtggctcatgtctgtaatcctagcactttgagaggctgagatgggtggatcacctgaggtcaggagatcgagaccaccctggctaacatggtaaaaccccacctctactaaaaatacaaaaattagctgggcaatggccgggcgcggtggctcacacctgtaatcccagcgctttgggaggctgaggtgggtggatcatgaggtcaggagattgagaccatcctggctaacatggtgaaacccatctctactaaaaatacaaaaaaattagccgggcatggtggcaggcgcctgtagtcccagctacttgggaggctgaggcagaatggcgtgaacctgggaggcagagcttgcagtgagctgagatcgcaccactgcacttcagcctgggtgacagagcaagactctgtctcaaaataaaaaaaataaaaaaataaaaaaataaaaaattagctgggcgtggtggcgtgcgcctgtaataccagctacccgggaggctgaggcaggagaattgctggaacctgggaggcagaggatgcagtgagctgagatcgtgccactgcactccagcctggctgacagagcgagactctcaaaaaaaaaaaaaaaaaaaaaaaaaagtacatttcaaaaaatagaaagaacattacagcttctgcaggtcagtgtagtcatcaaatattgcaacacaatgataccacattcctacgtcctttcactcggcctctgatgctgaaagaagatttgcatctggaaagtggcttttcatcattagcttgcttcattcatacactattgtttgtcttttgagttgagtaaaagatacaagaaacattttatttctcaccttgtctatactgagcacaaacattggaaaggtccacttgattgctaattttttgatattcctttaatgattcccttaacattctttctttttcagtcttattttgaacttgtcgggaacgctggagaagctcatttgcctagaagaggagataacaagaacttaaaaatatataaaatcaagcagacagatgatgctgtcaactaagttttagtctatgtctaaatttatatatggttattaccattaaaatgaaaacaactctacaaacttacttcttaattttaggcagaaaagtttttgaccaaagattcctagctattcttaattcctctcccaaatatgttaagcaagagaacttttgtctggtaattctcttgcctagtcaatacattattgggcagcaggcagtccatgtgacactgatttatttattttttccacctgtaggaaaggatcaataaaaatgcccccattaactctaattcactaaaagatttacttgaagttttagtacttttccttaagctaaggagataaattatcccctaaatttccttaatttctaaatttagtgatttttcttaatttctcacctttggttttttaatatggcctagaaacactatcaaagattctttatgggccaggcgcagaggctcatgtctataatcccaacactttgcaaggctgaggcaggcggaggtcaggagttcaaaaccagcctagacaacatggtgaaatcctgtctctaccaaaaatataaaaaattagccaggtgtgatggtgcacacctgtaatcccagctatttgggaggccgaggcaggagaatcacttgaacctgggaggtggaggttgcagtgagctgagatcgtactcagtcttaaaaaaaaagagagaatattctttatgaaaaacttaaaggagggctgggcatggtggctcacacttataatcccagcactatgggaggctgaggcaggaggatcacttgaagccaagagttcaagaccagcctgtgcaacaaatcagaacttgtctctataaaaaacaaaaaaattggctgggtgtagtggtgcacacccgtagcccctagctacatgagaggcctgcttgagtctaggacttagaagctgctgtgagctatgatcacagcactgcactacagcctaagcaacagagtgaaaccctgtgtcaaataaataaataaaaatatttttaaaaagaaaagctaagcttaaaagagtatacactggttttaagaagccacatattccaacccctttcttagatgaggattctgaggctaggagaggttaagagatctaactgactgaggtcctatattaagtgaaacaagatggttcatcatacatgatacctcttataacaaacaatgaaataggtaataaagtatcataccttagaacaaattgcatcatcagtgctatatagaagtgggcagatatcctgtaaatgtaaactaatgccatcaacagcggcattatctctgatgtagcagttgataagagaagcaattaatgcccctgtgagttctttgtccctgattacaagatctttaaaggtggtgatcttcagctgctcttgaagttcctaggagcataaaacttttctatcacaattatagaaataccatatttctaaacataatgaaattattttaataaattaaaataacctaaatattaatagactctataattgaaaagcgaaaatatactaattagtagaaacaaatttttgcgaacttacataaaatcatagagagttggaaaagaacctacagtagatctagtccaaaactctcactttccaaatgagaaaagtaaagcttaagtagagccaaaactagagtcagatctcctggctttggttataaaatggaaaaaacaatcacttggctatatttgaaaatcttgggcttacatattactccttcctaaacactgttagaattccattattctaggccttataataatattggagtttaatctgtattgtgaacaaatctgcttgtccaaatgaagctctaaagtattgatttatactatagtaaaagattctgttagtgatgtgactgctatctcttttttctaaattcaaggaaatacccaaactgtgttaaaattcttgaacaaatctttaatttgcattcattgagcatgccattggtgatgtaaggaagagagctttgaagatggatcacaaaaacatacccaggataaaaacctacctacaatatatttatcactctataaaactcaaaattattattctacttggtatgaaaaagataagtttcataattaaatatattagcttgaatttttaaaaataaaaaacagtatgtatttaaaagaaacaaaaccaccaacaaaagccacactattcattggacactagtggaaagaatgaggagactgccttccaacgttgaaaaatggtatacgagagtcaaaaagtaagtgtttcagagtaatgaaatatccatacaggacaaggaaaaagaatttttttttttttttttacagaattgcagctagtaactggggaaggaatcacagatttaaaatattatccttttggccgggcatggtggctcatgcctgtaatcccagcactttgggaggccaaggcaggtagatcacctgacgtcaggagttcaacaccagcctggccaacatggcgaaacccggtctcttactaaaactacaaaaatcagccaggcgttgtggcacatgcctgtagtcccagctactcgggaagctgaggcaggagaactgcttgtacccgggaggtggaggttacagtgatctcagattgctccacagcactccagcctgggtgacagaatgagacactgtctcaaaaaaaataaaaaacaaacaaacaaataaataaatattacccttttgtaatcctaaatgaaataataaattccagcaatgattatcaatggatgattaaaatctgatggagaattccacaatggcagtattaggcttactacttgaatccagcaatttatcttagtataactaaaagaaggacaacgaaaccttttgtatcttctaacagtctgatgaataaaccactacctatgaagtattctattcttcctcaaaaaaggacctgaactgaatcaagcctatataataaactttcattttatagaaaatgcaggagatagaggaagaagctcgctacaaagaggattaaaaaaaaaaaagccttagaatgtccttagaatgctggacattctactggatggatgactggatttctacaaggcaacagcaaggaaaagaaaaagaaggaaagactgctttagactgaaacagatgaaagagaaaaacaaattccatgagcaaaccccttaaactgtttagatcctgatttgaatgaaccaatctgtaaaaagacatttttaagacagattttgctatcaaatattgacagttaatattggtaactatccagcctaggagatacggtgaaaccccatctccacaaaaaaatacaaaaattagctaggcgtagtggtgcgtgcctatagtaccagctactcgggaggctaaagtaggagaatcactggagtccagagaggtcaagggtgcagtgagccgtgatcatgccactgcactccagcctgggtgacagagcgagacactgtctcaagaaaaactggtaactgatcatgacattgttgttgttcaaggaactgtctattttttttagaaacacagtatcttgaaaatgctgaatgagtcaaatgtatatgggagttacagtttttgctctacttttgtatacgtttagaaatgctcacaattaaataaaaggtaggaataaatttcctctatatattctatctaacatttagattaatgttgattatccttatccttagaaaggattcaaatgtgaacatcaaaagaaatatgaaccatttatttcctacagtgataaatatcttcctttaaagtaggagcagttgccgggcatggtgggtcacgtctgtaatcctagcattttgggtggctgaggcgggtggattacctgagctcaggagttcgagatcaccctgggcaacacggtgaaaccccgtctctactaaaatacaaaaaattagctgggcgtggtggcatgcacctgtaatcccagctactcaggaggctgaggcaggagaattgctagaacccgggaggtggaggttgcagcgagccgagattgcacaactgcagcctgggcgacagagtgagactccatctcttaaaaaaaaaaaaaagaaaacataaaatgaagtaggagtggtgtatatgtgtgtgtgtgtgtgtgtgtgtgtgtgtgtgagagagacagagagagacagggtctcactctgtcacccaggctggggtgcagtggcaccatcatggctaagtggcgcctcaacctcccaggctcaagtgctcctcccacttcagcctcccaagtagctgggactacaggcatgtgccaccacacttgactaatttattttttatttttagtagagatgggtcctgacatcttgcccaggatagtcttgaattcctaggctcaagtgatcctcctgcctcagcctaccaaagtgttgggatcacaggcgtgaggcatggtgcccagtcaagagtatttaatttaggttgttgggccctttgaaattataagcaaaagtctgtgtgtccatgtcgatatgcatttctttaagggtagtgagagatagcttttatcagattctcagaagaacctgtagctcaaataaagggtaaagtccactgttttaaaaaatatgttttgtaaagtatgacttcattcacatacccacaagtaaaaacttgcggctttgaaaaaataggtcccccaagttggtacgctttttttgtgccatcttcccataacatactaacttcatcataacttaaatgcttcccaaaataatcccctccaaagccaaaatactcatccaaaaaatccaaacatagtattaatggtataatcataaaaaaataaaaaaaattaccttctgaagttctgccacaatgatagtgaattgatgttcacaaagaagtttccataaagccagagcctgatatgattttcgaaccaactgctgaattgcctgaagtgaaatcttttcacttagttgagcctctaatgagaaaacaaaataaattattataaaataacataggttaagttgctttatttcaaataaaaactgtagttaaggttgaaatccctgttgttttcttcctagcccccattacaggcaaccatgataatcagtagtatttatgttattatcttctccgtgtgtgtatatatatatgcttctgtgtttgtgtaggtacacataaaccatgaaaatattgctgtgtggctgggcgcggtggctcacgcctgtaatcccagcactttgggaggccgaggcaggtggatcatgaggtcaggagatcgagaccgtcctggctaacacggtaaaactcggtctctactaaaaacataaaaaattagctggtgggggggatggcgggtgcctgtagtcccagctacttgggaggctgaggcaggagaatggcgtgaacccaggaggcggagcctgggcgacagagcaagactccatctccaaaaaaataaaagagagacaaaaaatttaaaagatagtaaaaaagaatttacaaaatgatgaatagaaacctagggtcctcagtagggaagaaagtaacttgggacaaaagtaaatggttgagtgttaactgagaaagttctactggccaggcgtggtggctcacgcaagtaatcccagcactttgggaggccgagttgggcggatcacctgaggtcatgagttcaagaccggcctggccaaagtggcaaaacctcatctctactgaaaacacaaaaactagatgggtgtggtggcacacgcctgtgatcccagctacttgagaggctgaggcaggagaatcgcttggacctgggaggtagaggttgcagtaagccaagattgtgccaatgcactccagcctcggcgaaaaagcgagactccatctcaaaacaaacaaaccagaaagttctatcacggccagaaaaagtaactctaaccctaacaatggaaggcaaaagaacttagaaaaaattaaatggcacaaaaagttcatgcaataacttattattgttctaacttgtatctggaataactgaagattatgagaacttttcagttgccttgctctttccttacttgttactacttataattgataaaaagcacaatgaaatatttgattcatatttttagctctataaaaaggcatattactaatcattagggaaatgcaaatcaaaatcccaatgagatgccattccatgttcattaggatggctatatataaaaggacagaaaaatgacaaatgttggcaaagatgtgaagaaattggaacccttgtgcattgctactagaagtataaaatgctgtggctggccaggcgcagtggctcacgcctgtaatcctaccactttgggaggccgaagtgggtggatcacctgaggtcaggagttcaagaccagcctggccaacatggtgaaaccccaactatactaaaaataaaaaaattagctgggtgtggtgacacatgcctgtaaccacagctactcgggaggctgaggcagaattgcttgaacctgggaggtggaggctgcagtgagctgagatcgcaccattgcactccagcctgggagacaagagtgaaactccgtctcaaaaagaaataaagataaacataaacataaaatgcagtagctgctatgaaacagtatggcagttcatcaaaaaaattagtaatagaattaccatatgatatagcaattccacttctgggtatatacccaaaagaactgaaagcagaggctttaatttgtatttgttcacccatgttaatagcagcattattcacgatagccaaaaaacggaagtaactcagtgtccatcaacagatgaatggataaaggaaatgtggtatatgtgcacatatgcacatatacacaatagaaattactcagtcttaaaaaggaaggaaattctgacacgttacaacatggatgaacctcgaggacagtatgctaagtgacataagcctgccacaaaatgtaaaatttgatttcatcctaatagggtacccagagttgtaaaattcaagagacagaaagtagaatggtggttgccagggacctaggataggggaaaaaaatggggggttattatttcatgggtacagagtgacttttggtgtttattttttttaagacagagtcttgctcttgttgcccaggctagggtgcaatggcacaaattcggctcactgcaacctccgcctgctgggttcaagtgattctcttgcctcggcctcccgagcagctgggattacaggtgcccgccaccacgcctggctaatttttgtatttttggtagagatggggtttcaacatgttggccaggctggtcttgaactcctgacctcaggtgatccacctgccatggcctcccaaagtgctgggattacaggtgagagccactgcgcccagcccagagtgacatttttggggaagatgacaaaagttctggagatagatgctggtaatgggtacataaaatgaatatactgaatgccactgaactgtacacttaaaaacagtaaaaacgggccaggcgcagtggctcttgcctgtaatcccagcactttgggaggctgaggtgggcggatcatgaggtcaggagattgagatcatcctgcttaaacacggtgaaaccctgtctctactaaaaatacaaaaaaaaaaaattagccaggtgtggtggcgggcgcctgtagtcccagctactcagaaggctgaggcaggagaatggagtgaacccgggaggtggagcttgcagtgagccgagatcatgccactgcactccagcctgggcgacagagtgagactctgtctcaaaaaaataaataaataaataaaataaagtaaaaatggggctgggcacggtggctcacatctgtaatcccagcactttgggaggccgaggcggacgggatcacctgaggttggaagttcgagaccagcctgaccaacataaagaaccccgtctcttctgaaaatacaaaattagccgggcgtggtggcacatgcctctaatcccagctactcgggaggctgaggcagaagaatttcttgaacccaggaggcagaggttgcagtgagccaagatcacgccattgcactccagcctgggaaacaagagtgaaactctgtctcagaaacataaacaaataaaaagtaaaaatggtaaattttatggtatatatatatttcaccacaataaaaaaaacataatgaaataggtgtgtatcatgttttctggtggaggaaggaacaaaaatgtatatgctaaaagagatagggaaatatacaatatccatattaatatccatattatcctactttcccaatcacactttttttttttttttttgaggcaggttctcactctgtcacccaggctggagtgcagtggcatgatctcagctcactgcaacctctgcctcccaggaagaggtgatcctcccaactcagccttccaaagtgctggtattacaggtgtgagccaccaccccggacccaattacactgatattttaattacaaatatttgtgtacaaagtacatcttactaagaaagtccattgttttctattcaagtaataaaattttactgaggtcatgtacgcttaactgatgagaagcaataatttaccatgaaacttcctctgcagttcctgttgcatttgctggggatttccgttttcaggacgcatgaatcctatcagcctctgctgcactttagcagtagtactgaaacagaaattgcagaatgtgtgtgtttataacagctttattgagatataacacatacagtacaattcaaacatttaatatgtttactttttttaaataattcagaaggttgggcaaccaacaccagaagggctgatggccagaaaaaatttatgacacagactaaacagatgctacttaaaatgactgagattaaatcaattaaatgactgagaacatcagctataaattttcctaacctgtagaaaaaaaaagatcaagtaaaaagagggggtaaaggagagaaaggaaggaaggaaattacggaagagaagaaacaagctagatacaaaagagttaatatgattctccaaagagaatgggacagaagaaacatagattgagtatccctaataaaaaaaaaaactaacatctgaaatgtccccaaatctgaaacgttttgcacatcagcatgatgctcaaaggaaatgcgcactggagcaatttcgatttcaaattttcggaatggggtgctcaacctaagtataatgcaaatatttaaaaatcaaaaaaaacgtgaaagccaaaacacttctggttccaaacagttcggataagggatattcaatgtgtatcacaatacataaaaaacgagagaagaaaactgatcaaagccaagacgttcattcttaaggctcactgagagctgtaaagaagatatacctaaagacatcatgtgacttttgaatttcggtaacaaaaagaaaaaaacacaaaaaaatttcaaagtaaacactaagtcacttacaaaggaaggagaatcatacagataatgtactttttcatctacaacattaaactttgggaagaaaatggtgcaaaatgtatacgaagatctgagaaatggtctatgatcttaaaatcccacattcattgggcaataaaaacgaacaaagcatgaatacatcctaccacataaatctcaaacatgagcccccaaaacacactaagtgaaagaagccagactcaaagaccacacagtatgattctgtttatatgacatgtcaagaataggcacatctacagagatagagcagatcagtaagtgtctggggctaagaagtgggaatggaaagtgactgctaatggacatgaggtatgtctcctagataatggaagtgtgctaaaactggactgtggtgatggttgcacaattctatgaatttactaaaagtcactgaactgaacattcaaaatgagtaaatttagtggtatgtaaagtagatctcaaaaatctgtttaaaaaatttccatagtcaatgaaactaatgttataggaatccaagggttggtcgaaattaggacatgtattaactctattgttaaaggtaagggggaaaatgatatgatcatctctgtaaaatgcagtaaatacatttgacaaactcacttattgaatatggtaagcatattcaatatgttaaatatatgaatatgttaaacatattcaataagggctgagtgcggatggctcatgcctaaaatcccagcattttttgaggccaagacaggaggatcacctaagcccaggagtgcaagatcaacgtgggcaaaacagtgagaacttgtctctacaaaatgtgaaataaaaaaattagctgagcatggtagcatgtgcctgtagtcccaactactcaggaggctgaggtgggaggatcacttgaagctgggaggtcaaagttgcggtgagccgtgatcatgccactgcactccggcctgggcaacagagtgagaccagtctcaaaaaagaaaaccaaaaaacacctcaagtaagggtggatgcagtgggtcatgcctgtaatcccagcactttgggaagctaaggagggagcataacttgaggccaagagttttagaccagcctgggcaacacagtgagaccctatctctgagaaaaataagaaaaaatcagccaggtgtggcagcacatgcctgtagccccagctactcaggcggctgagtctgagattgcagggaataatgatcacatcactgcactccagcctcaatgacagagcaagattgcctaaaaaagaaaaaaaaagagaaaagacagacagagataagtggcagggcgcagcggctcatgcctgtaatcccagcactttgggaggctgaggcgggtggataacctgaggttgggagattgagaccagcctgaccaacaaggagaaaccccgtctctactaaaaatacaaaattagctgggcgtggtggctcatgcctgtaatcccagctactcaggaggctgaggcaggagcatcgcttgaacccgggaggcggaggttgcggtgagccgaggatcatgccatcgcactccagcctaggtaataagagtgaaactctgtctcaattaaaaagaaaaagagagagagagagattaccttgtgcagagaggagaaagcaagtagagctagacaagaaaagatggaaaagatgaaactatctctgtttgcagatgacagaactgcttctgtgacaattcaagaaacatcaatgaaaaaaacatcctgctaaaaactgtaaagataaatgagtaattaagagaaattagaagtagattagaaaatttacatataattgcagatgtaatggtaaaattcaattaacaaaagaccataatgttagaaaaaaaaccaaacaaactaaaaacatctgacaagtaaaattccagataatttggagggagagggatggcagtagaaggcaaggaaacaaaatgtaatagagtttgttaaattattaatgctgactgagatgcatgtctgtcagaatttaagactaacagaggaagaaaaatcatatgtagaacttcttaattggtgtttaaggtagagagaggcctgatcaatccaatacaataaggaaatgggaaagggaagaaaataaacaaaaagcacaaattcaggatggggagaaaaaaatcaaacatttaactagaccagatgcagtggctcactcctgtaatcccagaactttgggaggctgaaggtggattatctgaggtcaagagttcaagatcagccttgccaacatggcaaaaccctgtctctgctacaaatagaaaaattagccaggcatggtggtgtggggctgtagtctcagctacttggaagggtgaggcaggagaatcgcttgagccagggagttggaggttgcagtgagctgagattgcaccactgcattgcagcctgggcgacaaagcaagactctgtctccaaaaaaaccaaaccaaaacaataaaccacatttaactaattccaataaaatgggaaggaggtaaattctcctgcttaaaagataaagacaggccaggcgcggtggctcacccctgtaatcccagcactttgggaggctgaggcgggcggagcacgaagtcaagagatcgagaccatcctgggcaacatggtgaaaccccatctctactaaaaatacaaaaattagccaggcttggtggcacatgcatgtaatcccagctactcgggaggctgaggcagaagaactgcttgagcccaggaggcagaggttgcagtgagctgagattgcaccactgcactccagcctgggcaacagagcaagactctgcctcggcaggggcaggggaatatatatatatatgtatacacacacacacacaaagtatgaataatgttatataaaagtgtacttacttagactctgtttttgcttttaaagaagtgtatatttatgtatgctttattatttatttatgatatttttttttgagacagagtttcactcttgttgcccaggctggagtgcaatggcacgatctgggctcaccgcaacctccgcctcccaggtttaagtgattcgcctgcctcagcctagctagtagctgggattacaggcatgtgccaccacacctggctagttttgtatttttagtagagacgggtttttccatgttggtcaggctggtcttgaaatcccgacctcaggtgatccgcctgcctcagcctcccaaagtactgggattacaggcatcagccatcacgcccggcctatttatgtgtttttgtagtgacaaggtctcctatattgcccaggctggtctcgaactcctggcttcaagcaatcctcctgccttggctttccaaagtgttgggattataggtgtgagccactctgcctggcctacatatgctttaaaaagattatactgtaatacctcgttaacaattctaaggagtgatgtgactcccccaatgccatgtgattattatttttcaacaaaaagtccgtattatattagaggcttaaaaatatccattcttggctgggcgcggtggctcacgcctgtaatctcagcactttgggaggccgaggcgggcggatcacgaggtcaggagatcgagaccatcctggctaacacggtgaaacccagtctctactaaaaatacaaagaattagctgggtgtggtggcaagcgcctgtagtcccagctactcgggaggctgaggcaggagaatggcatgaacccgggaggcggaggttgcagtgagctgagaccgcaccactgcactccaggctgggcgacagagcgagactctgtctcaaaaaaaaaaaaaaaatccattattgctgggcatggtggatcacctgaaggtggtcaggagtttgagaccagcctggccaacatagtgaaactccatttctactacaaatagaaaaattagctgggcatggtggcaggcgcctgtaaccccagctactcaggaggctgaggcaggagaatcgcttgaacctaggaggtggaggttgcagtgagccgagattgcaccattgcactccagcctgggcgacaagagcgaaactccgtctcaaaaaaaaaacccaaatgtccactcttggtcgggcatggtggctcacgcctgtaatcccagaactttgggaggctgaggccagtggatgatgaggtcaggagttcaagaccagcctggtcaacatggtgaaaccccgtctccgctgaaaatacaaagaagaattagctgggcatggtggtgcacatctgtaatctaagctacttgggaggctgaggcaggagaattgcttgaacctgggaggcggaggttgctgtgagccaagttggagccttcgtactccagcacgggtgacagagcaagagtccgtctaaacacatgtccacacaaaaacttgtacaggaatgctcatatcagcattcttattagccaaaaagctgaaacaacccaaatatctatcaactgataaactgagaaatgagacaagtagtaatacatgctacaacaatcaaaccttgaaaacatgcttggggaaagaaacagacaccaaaggttatctgttgcatacttccatttatataaatatttctataaagattccatgtatataaatatgtctataaatattccattcatataaatatttctatattccatttatataactatatttctataaatattccatttatataactatatttctataaacattccatttacatatattcatataatatatttatatattgtgtatcttatgtaatatataaaatataatatttatataaatagtcagaaaaggcagatctgtggagacagaaagtagattagtggttgccagggactgggggaaggtccatgaataataatggctggtcatgggcacaagagtttcttattgctgtgatgaaaatgttctaaaattagatagtggtgatggttgcataaccttgtagatacactaaaaaatactaaactgcacactttaaaaggaccaactttgtagtatgtaaatcatctcaacaaaaaatacaacgaaaagaaaaagatgaattaataaaccctatttattcttactttggatttcctaatggtcctcctgcaaactgggagtttctgtctagaaattcctgcaaaccctttagttcttgtagcactgactctagcagttggcagggaacactactttcaatctgtaaaaatgaaagatttttcaaaagtttaaaaacacaccctctgtatagctataatataaacaattttaattttgaaatgagtatctctatagttatttcttgtatcaattcacacctgttgatccgaataaagtatacctacacacttcctctcctgccagtaacactgatgcataactaacatacaataaaatacaaatactaagaaaacatcttgattacttttatatatttttgtatagtcatcacccagaccacaatacagaaatttccaacaccaaagaaagtttcctatgttcctttgtagccattagtcatcccacctctgaggtaactacttttcttactcctatcaacatagattaattttacaagtttttagacttccatatatatatatggaatcatatactgtgttaggcaaatacactcttattcttagaaacttgaacttttttttttttgagagacagcgtcttgttgttgcctgggagtgtagtggcgcggatcatatcttactgcagccttgacttcctaagttcaagtgaccctccttcccaattagctggaagtaccagcacatgccaccacatatctgactaattttaatcttattttattttatagaaaaggcatctggccgcgttgccctggctggtcctgaactcctgggctcaagccttccaaagcattgtggttacaggcacgggccactgtgcccaactcatgaactttaagagcctcacaattaaaaatatatttggactgggcgtggtggctcacgcctgtattctcagtggaggccgaggtgggcggatcatttgaggtcaggagttcgagaccagcctggctaacatagtaaaacactgtttctactaaaaatacaaaaaatcagctgggcatggtggcgcgcacctgtaatcccagctactcgtgaggctgtggcagaagaatcgcttgaacccaggaggcaggggttacgatgggccgagataatgccattgcacaccagcttgggcaacaagagtgaaactgtgccactgcactccagcttgggcaacaagagcaaaaagcagtctgtaaagtatgccaattcatagaaattagtgctgggtccatggagttttcgttcatatatatgtcaaagtattacatagtaaaatttgagcaatattaagttgcttgagttatccctcatgacaaccttatgagggagatatactacgccccttcttttaccatgaggtatcaggctctgaaatgttaagtaatttactcatattcagacagttaatcaatgttagagatgagatttaaacctgaaggtaagcagtttgttgtccaagaatgcaaacatatacataaaagaataacccgccaggcgctgaggccccctgcctgtaatcttagcactttgggaagccaaggcaggtggtttgcttgagtctaggagtttgagactggcctgggcaacatggtgaaaccctatctctacaaaaactacaaaaattagccaggcatggtggcgcacacctgtaatcccaggtactcaggaggctgaggtgggaggatcgcttgaccccagagggcagaggttgcagtaagctgagactgggccactgcactccagcctgggagacagagcaggactctgtctcaaaaaaaaaaaaaaaaaaaaaaataacctttgccatcttatttgtgtaatatcaggaaatgtgaaacaatctaaccatttataccatcaactggctacacaaaaataacaaaataatattatacacacttactgcagtgatctctctgttgccactcttgaatattctctccacaactaagcttgcatcccaaatgtttctggaaaaaaaaaagttttaatgattgtgctgtaaatgaataaaaacaattacaataaatttctttctctaggaacttaatggctttattcagtttttaaaacttgcagtggtttcatttaacattttactaagctatctagaagagtggaatactagaaaattttcatacctgatgtacctaagtttttcagataatgaaatattactgaagaaaaatcaaaaggctctgtataataaattgtaaacaggaaatttataaaggggctctgtactgtttcatacttttaagcaaatgagatgaatgaaatcatacatctcaaatctaagagaaatatatattaggcatgatagctaactaagataacatgatagactgattgcaaaaacaaccacatttctttatccctccctatatctatcccctctgcagtatgatttgatgtctctcccctaaaaggtggtctatttcccaccttttaaatctgagttggccctgtgacttccctctggccaagtgaataaggcggaaaagtgcatggtaagccagttctgagtttagaataaaggttttgcaagtgtctactctttctcaaggaactctgccaccaccaactaaataatctttggctggcctgctgggggatgagaaaccatgtagagaacaaccaagctgtttcatcttgggccattctagaccagctggaaaatataaccttgaacatgtgagagtctagccaagataagcatagctctctttaacttcacaactgattgcctattcttgagttagcccagcaagacaagaactgccctgttgaactgtagacacatgtcactgagttatggggaagtttgtaacactgtacattcatatgtaagtagatatacagttgacctttgaacaatatgggcttgaattgtgtgggtccacttatacacagatttttttcccacctatgctaccccagcacatcaaaaccaacccttcctcttcctactcctcagcctactcagcgtgaagacaaggatgaagacttttatgatgatccattgccacttaatgaatagtaaatatattttctcttccttatgattttcttaattttttttctctagcttactttatggtaagaatatagtgtataacacatataacacaaaatatcagtgttacggctgttttagaatttgtctagcaggttttctggtttttacgagactcccccatactcctacaccatgcaaaagttaaaaaaagaaaacacaaaaaacatacaaaacgtgttaattgattacttatcagtgaggcttctagacagtaggctattagtaattaagaaagtcaaaagttgtacatgaatttttgactacatgaaggttgaggaatggtggttggcatcccctaacccctgtgttaaggaacaactgtattttgatgctacaaaaatagattatgagagagtaagagaaataaaacacagcaatgaatatagttagataacaaaaactggaataatagaaaagttttattgatcaacaagtgagctaaaactaaaatttaataggaataaatgatgtcccaaattcagagttaaaaatatttaactactcaagatgggacaaggtgagcaataattcattatttcatgacaaacttaccccatgatccgagaaaagtaaatgcaaataccattgtgttttccagagtacacaatctctggtccagtcacacaactcatatttgtggcctgagttgctgggtttcccagagcacacactggagttgacatggcaggaggctgtataccttgtacacacataagaaaaacaaatctcttaatcttaatcttagaacccataaatctcttaatcttaatcttagaacccataaatctcttaatcttagaacccataaaattcagaattctcataacccaagtttgtgtatctagacacaaaggtatttacaaaaacaatgaaatacatagatatttaacttggttttccttaataagaagagagatttaaatgtggatgggtactcccagatagacttgcaagtgttcacaatgcagaatgaaaaggaaacaaacttgccagtactgcttgtaatgctgacagtgaaatagaactgattacacagattttagggttcaatttaatcctggtagccaaataatgggctttccaggcttattataagaggagttcctcctaaataaaggcattcacatccaaatgccaaaacttgcttggacagcgcttctaaaattatatttattttcaagggaataaggcaagttcatctttttcacactaagcattaaggttaactcataatgttagcacttcaaaatgaatccaatccaaaacaaagaaaagaggtaccatgagacggtgttcccaaaaaggatggatttggatagggactaccactaggaacaggagaacctaaaaagggaaagaagaatataaagatttagaaaagaacatctcaatcttttgaatgtgatcaaaattaggtaaagaaggtatttcctttttctttttttgaggcagggtctctttctgtggcccaggctggagtgcagtggcatgatctcggctcactgcaacctctgtctcccgggttcaagcgattctcccgtctcagcctcctgagtagctgggattacaggctcacaccaccacaggccggctactttttgtacttttagtagagacatggtttcaccatattggtcaggctagtctcaaactcccaacctcaggtgatctgcccgcctcggcctcccaaagtcctgggattacaggtgtgagccattgtgcctggccacagaagctatttctaagcataaggagttacattgtccacgatatatgcaagaattagggactgatctcctagtaagtttctaacaactcccaccttggaaaacactgatgtgcgagttaattattaaatcattcatctgtttccctctgaatatataccaaatgagttatgtaaatatgattggttacatcttattttgcttccttacattaaggattcaatattaatagatcacttttaagaatcagaatctatagatgtattcatcaattatacaatagcagtaaataaaacataatgaaaaggcttattgataaaaattgctataaaggttctaagattcaaacgattagaaacaatttcatttcaatgttccatactcactagaatagacaggagaccccaagatgggaccaacattacttggaggcggaagagtggttggaaatctcatctgtgcttcaccaccatacctatttttatgacaagaggttgagtttattcagtaaaacaaaccatccatcttaaaaactggaattgttccttttcctgtttagcttccaagtaaatgctttaaacattagagacttcaatgtattgtgctgacagtaaagtatatgcataagacttataataaatatttattcagtaaatgtggacttgaaactgctaccaggaagaattataagggactctgataacttctaagaaaaagatatgcaatgcatagaatttactttgtgagtaaatggcattgtaattttcatactaggttatggttagatagtacttcaaaaaacgtttctaacaaaatcacatttcaaattcttaaatattttctaaatagaaatatctctttggtaccaagtttccttaaagtaattcagaagccttcaatactaatgatacatattaagcagaattggcatagtgtttggggaagtaaaaaagatagatgagacagtaactgaggtagaacaaagtgtagaaagtagacaagaagttacagaacagaatccagagttaaagtaataatgcataaactatgctaatttacttgcttctattaccattataatctctccagatttcacccttttgcaaatgaattttggtaatttgcctacatagtcactcaactgtttggcaaggctttatcacattgataaaatcattttaaaaagtggcccagtaaaaaaacaaataaataaacaagaaaaactttcacatacctaaagaaagcccgagtagcccaggcagatacttctctatcacaggcagcagtggagcaagcaagaataaggcaagttgcacaagcctggtcttcctgtgtaaaaagaggaatattggccttatattaaatacaaattttaaaatgatttgtgtactgctagatgcagtattaaagtctgtatctagcacagagcaggcattcaataaatacttgctgactgaatgaaatcagttagtgttaaaaagacaagtaaacactactggttttaagttcatcataagcactaggattacaggatgttctcttttccttttaacctagattctgacttagtttccggcttatgtctccaattttcttcctgtggtctttctgctttctagaaaataacaattaagtggtaacactgaatacctaccatgtgtcaggtactattttaagagtttagcatatattaatcctcataccacatcctattataatgtataaggaaactgaagcccagagaagtcaagtaatttacctcagtggtggagctgggatttttaacacaggtgctttgaatccagagtctgtatacttaactttgaactactcccaattttaaccgtatcaattccagttgtggctctgaaatactaagatctctacactgttgcctcaggtttcttcctcaggtcattaagccaaaacaaacaaacaaacaaacaaacaaaccaaaaacaacttgtccctaaatgtcttgtgcttttaatgaaaaggcatttatcatataacctgaacaagaaactcttactagcagacttcaataagaatttatcaacaacaggccaggcatggtggctcacgcctgtaatcccagcactttggcaggccgaggcgggtggatcatgaggtcaggagatcgagaccatcctggctaacatgatgaaaccccatctctactaaaaatacaaaaaattagccaggcgtggtgggggggtcctgtagtcccagctacttgggaggctgaggcaggagaatggaatgaacctgggaggtggagcttagagtgagccgagatcacgccactgcactctagcctgggcgacagagcgagactctgtctcaaaaaaaaaaaagaatttatcaacaacagagaataaaaatctgaaagctcactacaagactcatattaatcctgctttcaaatgtcagttcacatacagtgacttaggcaaagaaaggaatattgttaagattatctatttatggctgggcttggtggctcacggcctgtaatcccagcactttaggaggccgaggtgggcggatcacctgaggtcgggagttcgagaccagcctgaccaacatggagaaactctgtctctactaaaaatacaaaattagttgggagtgctggcacatgcctgtaatcccagctactggggaggctgaggcagaacaatcatttgaacctgagaggcagaggttgcagtgagccaagattgcgccattgcactcctgcctgggcaacaagagcgaaactccatctcaaaatatatatatatatttattacagtattccagtcccaatttacataaactatgactcccactgtttgtttaaaatagcatcacattttttaaaagtatatataattacctgatgtaatttaaagaatctttcaatctcttctccatctcctcccacattactcacaagtagatgcctcagttgatctacaggtctaagtttatgaaacataaggctcccctaagaaatttgaagaaagaacatgaacaagagatttaccaagattggctgatagcaactgactctaccttatttgataaaataaatgaaacaaacaaaaaaaaccattcaacaatacaaagtaggctgggtatggtggcccacatttgtatttccagcacatcacggggctgaggcaggaggaatggctgaggtgatataaaaagtacaactggtcaaaaagatcatctacttctctactcaacctccagtagatctatatatctataaagaaaacttaatgcaattgccccggcaaagctgccccttaaaccagagaattaaagttagattattaattaatcatgttgctactatttatatcaatttaggcaaaaaaaaaaaaaaaaaaagctagaaacatagtcataccttataccagagtaaattccaaatagatcaaaagacttaaaggacaaaataaaactatcataatattacgttggtacaaaagcaattgaggtttctgccattacagctttttttttttttttttttttttttttagacggagtctcgtactgtctcccaggctggagtgcagtggcgcaatctcggctcactgcaagctccgcctcccgggttcatgccattctcctgtctcagcctcccgagtagctgtgactacaggcgcccaccaccatgcccggctaaatttttttatatttttagtaaagacggggtttcactgtgttagccaggatggtgtttttgccattacaatcaatggcaaaaacctcaattgtttttgcaccaatcaataaacaaaagcaactaagagtggattcttttataaaccttagtgagtggaagcttttcaactatgacatatttcaaatgatggctgggcagattggctctcgcctgtaatctcagcactgtgggaggatgaggtgggtggatagcttgagctcaagagtttgagacgagcctgggctttagtgagatcctgtctctacagaaaatacaaaaattaactgggtgtggtggcaaacgcctgtattcccagctactcaggaggctgatgtgggaggatcccttgagcctgggaggcagaggttgccgtaagccaagactgtgcaccacactccagcctgggtgacagattaagaccttgtctaaaataaaataaaataaataaaataaaatatcaactgataactgataattttgactaattataagcttgtgtgcctgggaaaaatctcaataaacaaagtcaaataagaaaccaggaaggctgggtgcaatggctcacacctgtaatcccagaactttgggaggccgaggcaggcggaccacctgagatcaggagttcaagaccagcctggccaacatggtgaaaccccatctctactaaaaatacaaaaattagccaggtgtggtggtgtgcgcctgtaatcccagctactcaggaggctgtggcaggagaattgcttgatctggggaggcagaggttgcagtgagctgagatcacaccactgcactccagcctgggtgatgagcgagactccgtctcaaaaaaaaaagaaagaaaattattcaattaagccactacttcagagaacttgacaaaaatattatacatcgcttatttttgtcactaccataacagaatacgtacacacctgtgctgagaggagaacaaatttcttcggaggtaacatgtgctgctgtacaacaactggtgaatcagttattggaatatgatccttgtttaaaggtgtaattattttatctactttcaattcatctatcgcagaaagagcccaggaatgaccatcaacaccagctgtcatctatgtaaaagaaataaatgttttatacatcatattgaagttacataatgcaaaagaaaaaactacagacttaataaagaagtaaatttaataaatagtacattaacatgaatatttttgaaagtattatgtaattttctactatcttttttttaaatcaggtattttctgggtttttgttttttgttttttttttgagacgaagttgtctaggctggagtgtagtggagtgatcttggctcactgtaacctttgcctcccgggttcaagtgattctcctgcctcagcctccctagtagctgggattacagccatatgtcaccacgcccagctaattttttatttttagtggggacggggtttctccatgttggtcaggctggtcttgaactctcgacctcaggtgatccgcccacctcggcctcccaaagcgctgggattacaggcatgagccaccacacctggcctctggggttttttttttttgagacagcatcttactctgtcacctaagctggagtgcgctggcacgatcacaactcactgcaacctcgacctccctgggttcagttgattctcccacctcaacctcccaagtagctgggactacaggagaatgctaccacggccgcctaatttttctatgttttgtatgaacagggttttaccatgttgcccaggatgttctcgaactcctgggctcatgcagtctgcccatcttggcctctcaaagtgctaatcaggcattaccttttttttttttctgaggcagagtctcaccctgttgccaaggctggagtgcagtggcctaatcagagcccactgtaacgtctgcttcccaggttcatgcaattctcctgcctcagccttccgagtatctgggattagagacgcacaccaccatacccggctaatttttgtattgttattagagactggcttttgccatgttggccaggctggtctcaaactcctgacctcaggtgatctgcctgccttggcctctttccaaagtgctaggattacaggcgtgagccaccatgcccagccataagcaggcattttctatactaatacataaatctttttgtactagaggacaagggcaaacttttctcaagataaactataaatactctttaataaaattataattctcttaaccaagtaactaccttctaccatctttccaggatcaactaaatctgctaagatactatctttcctttaaaaagtattttactggctcggcgaggtggctcacgcctataatcccagcactttgggaggtggaggcgggcggtacccgaggtcaggagttcgagaccagccaggccaatgtggtgaaaccctgtctctactaaaaatagaaaaattagccgggtgtggtggcacacgcctgtaatcccagctactctggatgctgaggcaggagaactgcttgagcccgggagatggaggttgcagtgagccgagattgtgccactgcactccagcctggacgacagaacaagactctgtcacaaaaaaaaaaaaaaaaaagtattttaccagcctaggcaatataatgaagtcccatctctacaaaaaataaaaaaccacctcggtgtggtggcgtgtgcctgtattcccagcaactcagaaggctgaggtaggaggattgcttgaacccaggagtttgaggctatagtgagctatctatgccactgcactccactccaggcaacagagcaaaaccctgtctcagaaaaaaaaaaaaaaaaagtattttaatcttctaaaatactttataataaaaaaattcaagcagccaaaaatgttgaatatacagtaaaagtccacatgcccaatacctagactcaacaattgttagcagttcgccatatctgcattctctctctttctgtatatttgttttattgtactatttgaaagtatagacatcatttatcactcttaaatacttttgcacatatctcctaaaaataagaatgttttcttacaaaccatataataacatttaaaaatgttattggctggacgacacggcttacacctgtaatcccaacacattgggagaccaaggcaggtggatcccttaagcttaggaattcgagaccagcaggggctacatggcaaaaccctgtctctactaaaaatacaaaaaaattagacaagagtggtggcatgtgcctgtagtcccagctacatggcggggagggggtggcgggtgctgaggtaggaggatcccctgagcctgggaggcagttgcagtgagctctgattgtgccactgtactccagcctgggcaacagagtgaaaccttgtctcaaaaaaaaaagttatcaattccctaatataatttaacacctaaccaatataaaatttacccagctgttctaatgtcttttatgactatttttgataactaggatttgatcaaagctcatacactatacttgatgagtttttttgttaaaaacaaaagtccacctttgtttgagaaaaactcaaatattaaatcaaattatatgacatgcagcatttgttctaaaaaaaaagttaggtggaggacagtgtctcacacctgtaatcccagcagtttgggaagccaaggtgggaggatcgcttgagcccaggagttcaagactagtctgggcaatatagtcagaccctgtcgctacaaaaaatttaaaaatcggctgtacgtggtaatgcacacctgtagtcccagccacttgggaggctgaggtgggaggactgcttgggcctgggcaacagggtgagatgctgtcttttaaaagagtaaagaaaaaaaaaaagttaacatttatggaatggtgcttcctatgagtgccaggcattgttctgagtgctttacacacatgagctcatttagtctcacaactccatcgtagtaggtacgattataactattatagaggaagaaacagagagccaaaagcatgtcctccactcccccaacacagcatcccaaccaggacagggtttatatcttattaagttctgaatcctcatagtttatcacagcactaggctggtagtacaaagaataaaggaaagaaggcactccttacctccttatcttcctcctgctcctaccccagctctttgaaccttgtcagaaatttggtagagctcaggcagacaatactcccatccctgggagttcagtttttactcctcccacttacacacacctttttccagtcccatctggaagggttcaaatttaagaaccaccaaagaaccactagttttcagtgaaaactagaagcaaaatgcctgtgaagaggtagctctaaagacagagtaccagacattcacaccccactaggggctggtttatctggtttgatcagcagcctctgtgggctatgcaggactattcaggaggacaggcaggagtgagcagaggacaccaaggggatggagacaggtagcctcccctcacctccttatacactggggactaggatgggcagctgggggcaggggcagttcgtgggttcatagcagcctcggtcctcacccaggaagaccatatccacttcatgatgtatgtggtgatttttgtgtttaaatcaaaactgtgtgtttgtgggtgtctctttgtttatgtgggaaagaaaaatgaaatacaataagaaagatgttggcaactcaattctcttacgtgaggttcaattgactcttcaaactttatgtttgaaagtttccataattaaaaaaaaaacagacaaaattacaaagagattgttagaataaaatctaagtcacaactgtaatagatggcctcatatttaaataactaaacgagcaacatatttaaatgaggtaaagatcatttcatatgaacctgacatgttttcagaaaaaaaaagacaacttcaaaaaagatgtatgtattttctagtacattatggaaaatattccgtaagggtccaatgttttctttaaagattttttttgtgattaccacagtaacttctaccctgacagaggaaaacaaataattgacaggataatttctttactttataatttctaataatacgttattagaagcaaacagcaatacatcagaagataaaagtttcttccatattatccttcacttaaaattatataatagttttttcagaattgtcaggataacttacctgggtttccatcattggcttttggaaaggaaaagtatcatggttgacacaccataaaatatcattatcctcattttctgaggctgccatcaatagaatacctaaaagtttaatatacaaaatattattacatcatgtcaaatatgcatcctcaataaccttaataattattaggttagtgcaaaagcaattgcggttttgcaattaaaattataaaaccgggctgggcacggtggctcatgcctgtaatcccagcacttttggaggatgaggtgggtggatcacgaggtcaggagtccaagaccagcctaatcaacatggtgaaaccctgtttctactaaaatacaaaaattagctgggcatggcggcaggcacctgtaatcccagctactcaggaggctgaggcaggagaatggcgtgaacgcaggaggtggaggttgcagtaagctgagattgtgccactgcactccagcctgggcgccagagcaagattccgtctcaaaaaaaaaaaaaaaaaaaattttacaaaaccacacgtacttttatgccaacttaaaactagcatatataaatatacacacacaacatcaatcttttttttttttttttgagacggagtctcgctgtcacccaggctggagtgcagtggcgcgatctcggctcactgcaagctccgcctcctgggttcacgtcattctcctgcctcagcctcccgagtagctgggactacggcacctgccaccacgcccgactaattttttgtatttttagtagagacgaggtttcaccgtgttagccaggatggtctcgatctcctgacctcgtgatccgcccaacttggcctcccaaagtactggaattacaggcgtgagccactgcgcccaaccgaacatcaatctttataaacaaacaagttacaaaataaaataattccctgaaagactatataattatttttaaggtagactccttaagtgttctcaattttaaactgtatttctctcagataaacatttttttttcacattttagcatttctgaacttagggcatatcttgcagtcaatgggtttatcaatttaattattaattttataaaaatatacttagtatataaaaatgccatgactgacaaattcacaatgtaatacaagctaatattcaatgaaatacagtttatatactggttaattcaaacacaccatgaataaaaatgatgaaggtgctagaggaatggcagagataagtgtactatagaagcaattatctgggccaggtgctgtggcttatgcatgtaatcccagcagtttcggaggctgaggcaggctgatcacttgagcccaggagttcgagaccagcctgggcaataaagtaagaccttgtttcaacaaaacatgaggcaggaggattgcttgagccggggaggtagaggctgtaatgagtcatgactgcatattgcactcctgcttgggtgacagtagacactgtctcaaaaaaaaaaaaaaaaaaggcaattatctcaacaaaacttgccaacacggtggctcacgcctataatcctagcgctttgggaggcagaggtggtaggactgcttgagcccaggagtttaagaccagcctgggaaacatggtgaaaccccgtctctacaaaaaatacaaaaattagccaggagtggtggcacatgcctgtagtcccaactcctcaggaggttgagcaaggaggatcacctgagcctggaaggttgaagctatggtgacccaagatcctgccactgcactccagcctgggcaacagagtgagaaccttcctccccaccctcaaatgacttggaaaaatattctgtattcatggatttgaagacttaacatagttaagatggcaacatgccccaaattgatatactgattcagctatcacaatccaacctcacttttttgtgtgttttttgtttttgtttttgttttgagatggagtcttgctctgtcccccatgctagagtgcagcggtaggatcttggttcactgtaaccttcacttccccagttcaagcgattctcttgcctcagcccacaagaagctgtgactacagacatgccccctacacccggctaatttttgtatttttagtagagacagggtttcgccatgttggccaggctggtcttgaactgatctcaagtgatccacctgcctttgcctcccgaagtgttgggcttacaggcgtgagccactgcacccggccccacctcactttttttgcagaaattaacaaggtgattctaaaattcatatgaaaattcaagaaactgagaagagccaaaatcatcttttaaaaaatcaggccaggtgcacggtggctcatgcctgtaatcccagcactttaggaggccaatgcagacggatcacttgagctcaggagtttgagacgagcctaggcaacatggcaaaagcctatctctacaaaaagtacaaaaattagccgggtgtggtggcacacacctgtagtctctctcagctactcaggaggctgaagtgggaggacagcatgagcctgggaagcggaggttgcagtgagcagagattgtgctactgcactccagcctcggcaacagagccagaccacctcaaaaaaaaaaaaagatcaaagttggaatagtcacacttatcaatttcaaaacttattacaaagcaacggtaatcaagactgtgctactgacataaggatggataatatagaccaacagaatagaactgagaatccagattccatacattaacgggtaattcacttcagacagtaagatgaagacaattcaatgggggatataatagtcttttcaacaaatggtgctcagacagctagataaccacatgcagaaggatgaagtcagattcctacttcacacaacatacaaaaattatcacaaaacagatcaaaaacctaaatgtagcagtgaaaactacactttcaacttttgaatttcactacaatttcaaattttattttagattcaggaggtatatgtgcaaatctgttacttgcgtatattgcgtggtgctaaggtttagggtacaactgattccatcactcaggtactgagcataagacccaatagtccgtttttcaacccttgctcccctacttccctgacccttctagtagttcccagtttctactgttgccatagggtattttcaaatacttcacaacaccatataattttaacaattttaagaatataatcttaaatctgatagtatttcagaacttacctttactataaagagctctatgtacttttgaaggcttttccacggttgaagatgctgagaatccaggaggtaagcggacatgaaccagcgtcagtgtattaggccgtgctaatggctgtctgaatggacaagtgctaaaatataacctaacacctgaagatggggtaaaattatgcatcagtaatagaaaacaaggacctgaggtaaatgtgttattgaagcaattacatacagcaatgcaacactctgctaaaaccatacataactttcctgactaatttttatttttggagatggagtctagctctgtcgcccaggctggagtgcagtggcgccatctcggcttactgcaacctccgcctcccgggttcaagcgattctcctgccttagcctcccaggtagctgagactacaggcatgtgccaccacacccgtctaatttgttttatttttatttttatttttttttgagacagaatcttgctctgtctcccaggctggagtgtagtggcgcgatcttggctcactgtaagctccacctaccaggttcacaccattctcctgcctcagcctcccgagtagctgggactacaggtgcctgccaccatgtctggctaattttttgtgtttttagtagagatggggtttcaccgtgttagccaggatggtcttgatctcctgacctcaggatccacccgccttggcctcccaaagtgctgggatcacaggtgtgagccaccgcacccggctcccctgactgatcttaaattaccatatagactatctgctaaaatatatatctaagaaaatgtcactcgaaattgagaggtgaatcaatacatttcattagaaagaacttgcaaagacaaaccaagaaatcttgtgttccaattcaggctttgttacaaaatgtcagccactgcgccttttaggcttggcttttgttttgcttttttactggttttttgagaaaagatcttgccctattgcccagggtgaagtgtagtagcataatctcagctcactgtagcctcaaactcctgggctcaagtgatctttccatgacagcctcccaagcagctggtactacaaggccgtgccatcacacctagctaatttttgtatttttagtagagacggggttacagggtttcaccatgttgctcaggttagtcttgaactcctgggctcaggcaatctgcctgccttgatctcccaaagcgctaggattacaaatgtgagctaccatgcctggcctaggtttggttttatatctataaaatgaagaaacagaattagaaaaatctcccagttttcaaaatcctttattttacaaactatttatatggctttacggcagatatagaaggaaaaatatatttctaataataaatttccaaatctaagaattttcagaagttgtaacagtaatagcagatatgtaaataaaacaacatacctgcatgtgtgacagccaataactgacagtccagtgattcagaattttcaatcactgctatttggacaattggtttaaaaacagaacgatcgatggtcctaaaagaaaggagaaaataaagtgtatttttaaaatgtgtctgctaaattataagaaatatttcccatcagaatgtttacatatttccatattttccttttttttttgagatgtagtctcactctgtcacccaggctggaggagagtggcgtgatctcggctcactgcaatctccgcctcccaggttcaagcaattctcctgcctcagcctcctgagtagctgggattacgggctcgcgccagcacgcccaggtaatttttgtgttgttagtagagacagggtttcatcgtgttggccaggctggtcttgaactcctgacctcgcgtgagcgtgatccgcccgcctcggccttccaaagtgctgggattgggattacaggcgtgagccactgtgcccgaccacatatttccatattttcttttttttttcttttttcttttttttgagacggagtcttgctctgttgcccaggctggagtgcagtggcgccatctccactcactgcaagctccacctgccaggttcacgccattctcctgcctcagcctcccaagtagctgggactacaggcacccgccaccacacctggctaattttttgtatttttagtagagacggggtttcactatgttagccaggatggtctcgatctcctgacctcatgatccgcctgccttggcctcccaaagtgctggcattacaggtgtgagccactgctcccagccttatattttctaaatatgctaaataatttaagactagcttcttaggaaagtaatacaagagcagcaagaactggaaaaactctggaatgtgtattttttacatttatattattaagagtaaccctattttcaaacaaagatcacaaaaaaagactaaaaccattgggtgaatggttggtggggagcagtgttctcagtgtcaaagtatcattactgctaattaaaaaaggagaaaggccaggtgcagtgactcacgcctgtaattccagcactttgggaagccgagacgggcagataacctgaggtcaagagttcaagactggcctggtcaacatggtgaacccccgtctctactaaaaatacaaaaaaattagccaggggtggtagcgcatgcctgtaatcccagctacttgggaggctgaagcagaagaatcacttgaacccaaggtggaggttgcagtgagctgagatcacgtcactgcagtccagcctgggcaacagactgagactctatctcaagggggaaaaaaaagggagaaaatggatctttataatgtagacatttggttaaaatcacctcaatgaagctttcaacagtgagaaaactgctattatgtgtctcttgatataatgtagtaagacatttcacactgcctatgtaatactggctaaaagatatattactgcttggtgaggtggctcatgcctcaaatcctagcattttgagaggctgaggcagtcagatcacttgaggccaggagttcgagaccagcctgctcaacatggtgaaaccccatctctactaaaaaatatataaaaattagccaagaatagtggcgcacatctagagtcccagctacttgggtggctgaggcacgagaatcactggaactcggaggcagaggttgctgtgagccaagatagcaccatggcactccagactgggtgacagagcaaaactctgtctcaaagaaaaaaaaaaaaaaaagaaagaaaatatacatatataaaatacatataaacatcatatataaaatatattactcagaatctaattataaaaaaagatatattcagaaatttgtataattatcctgcccttccttccaaacgtcaatattataaaaaaaaaaaaaggtggccagggggctgttttatattaaagagactaacaaccaatccaattcataaattctgatataactggagaaaaatggaaagaaaaacaactataaaagatttcgaagccaggcgcagtggctcacgcctgtaatcccagcactttgggaggctgaggcataaaagctggccaacatggtaaaaccccgtctctactaaaaatacaaaaattacccaggtgtggtggtgtgcatctgtagtcccagctacccgggaggccgaggcaggagaactgcttgaacccgggaggtggaggttgcagtgagccaagatcgtgccactgcattccagcctgggtgacagagcaagactccatctcaaaaaaaaaaaaaaaaagattttgggggcacggtggttcacatctgtaatcccagaatcccaggactgtgagaggctgaggcagacacgtcatttgagcccaggagttcaagaccagccagggcaacatggtgagatcccctctctacaaaaaatacaaaaattagccaggtggaggtgtccgtgcctgtggtcccagctgcttgggaggctaaagttggtggatcacctgagcctagggaggtcaagcaccactgcactcaatcctgggcagcagagttaaaaaaaaaaagattttggggactactgggcaattttaatatggactaagtatattgttatgtaacagactaaaggcatgtcggtggctcatgcctgtaatcccagcactttgagaggctgagacatgcggattgcttgacctcaggagttcaagaccagcctgggcaacaatggtgaaaccccgtctgtaccaaaaatacaaaaaattagccagatgtggtggcgcacgtctgtggtctcagctactcaagaggctgagatgtgaggatgccttgagcctgggaggaggaggaggctgcagtaagccacgatcgcaccactgtactccagcctgggtatcagagtgtgactccatttcaaaaaaaaaaaaaaaaaaaagtcatgatgtctacaatgtactttcaaatggctcataagacaggcaacaaagaggcaaaatgttaaaattgagataaagagtgtattagttttgccgggtgcagtggctcatgcctgtaatcacaacactttgggaggccaaggcgcgcagataacaaggtcaggagttcgtaaccatcctggccagcatggtgaaaccctgtctctactgaaaatacaaaaaattagccaggcacagtggtgcgcgcctatagtcccagctgcttgggagggtgaggcaggagcattgcttgaacccggcaggcagagggtgcagtgagctgagactgcaacactgcactccagcctgggtgacgtgacagagtgagattccatctcaaaaaaaaaaaaaaaaaaagtgtattagtttttgtcacattgttcttttaatttttttgtggatttgaaaaaaattccagaaaaaaattagagggaaaaacagaaaattatgtgttttcaattgtgtctgccttcagaatttttttcttgtcactgaagaataaaacaaaacaaaaaggctgagcaagatagcaagaccccaggtctactaaaaataaaattaggtgggcatggtggcacacatctatagtcatagctactcaggaagcttaggcatgaggatcacgtcagcccaggaaattgaggctatagcagactacaattgcaacactgcactccagtctgggcaacagagtgaaaccctgtctgaaaaaaaaaacaaaaagttgatttatttcactctgattgtagcaataatctaggcacaatgacaatagaagttgaaaaatttgaggccttcattataaaaagagtgtttgcaggtggggtgcagtggctcacgcctgtaatcccagcacttcgggaggccaaggcaggcagatcacctcaggtcaggaggtcgagaccagcctggccaacatggtgaagccccatctctactgaaaatacaaaaattagccaggcgtggtgacaggcgcctgtaattccagctactcaggaggctaaggcaggagaatcgcttgaacccgggaggtggaggttgtagggagccaagtcgcgccattgcactccagcctgggggacaagagtgagactttgtctcggaaacaaaaaaaaaagagagagagagcgtttgcagcttgaccaaggtagttgggatatgtgcaaatggtaatgcagattgtctgaagacttggcttccgcgttaggttcttgtacttatttaggagttagatctcaggcaaatcatcccttagtttcagtttcctcatgaataaaatgggtactacaactttgaaatattgtgttctgtacttgtgtcaataatcagaccaactaagcttgaaccacacatgtctgttaaaagagtgagtagtggccgggtgcagtggctcatgcctgtaaccccagcactttgggaggccagagcgggtgtattgcttgagtccaggagttcaagaccagtctgggcaacacggtgaagccctgtctctataaaaaatagaaaaattcgccaggtgtggtggcatgtgcctgtagtcctagccgctcgggaggcttaggtgggagaatcgcttaagcccaggaggtggtgattgcagcaagctgagatggagccactgcactccagcctgggcaacagagcgagactccatctcaaaaagaagcaaacaaaaaaccgaaagagtgaatagttaaaagtggggaaactttgagacatgcagtttcctagtcatgatccctatgtaaagttgccaggaaaaacacgtcaagctgtactttacgtagtaaaaccagtctaccttatatttccaactatcaaacataagaataaaagagtctcaagctgggcacggtggctcacgcctgtaatcccagcactttgggaggccaaggcaggtggatcacctgaggtcgggagttcgagaccagcctgaccaacatggagaaaaccccatctctactaaaaatacaaaattagctgggtgtgatggcgcatgcctgtagtcccagctactcaggaggctacggcaggagaatcacttgaacccgggagacagaggttgcagtgagccgagactgcaccattgcactccagcctggacaacaagagtgaaactccatctcaaaaaaaaaaaaaaaaaagtcttggccaggcacggtggctcacgcctataatctccacattttgggaggcgtggtgggtagattacctgaggtcaggagttagagaccagcctggccaacatggcgaaacccaatctctactaaaaatacaaaaattaggctgggcatggtggctcatgcctgtaatcccagcactttgggaggttgaggcgggcggatcacgaggtcaagagatcgagaccatcctggccaacatggtgaaaccctgtctctactaaaaatacaaaattagctgggcatggtggtgcatgtccgtaatcccaactactcgggaggctgaggcaggagaatcgcttgaacgcgcgaggcagaagttgcggtgagcagagatagcaccactgcactcccgcctgggcaacaagagcgaaactccatctcaaaaaaaatatatataaaaattagccaggcatggtggcaggcacctgtaatctcagctactagggagcctgtggcaggagaatcagttgaacccaggaggtggaggttgcagtgagccaagattgtgtcactgcactccagcctgggtgacagagtgagaccctgtctcaaaaaaataaataaataaataaataaataaaggagtctctaacagctccatttcaaacataatgtagagtgtcatctcttcaacattccttgtcttttagagacattttgatgagggaataatatatacttttagaaggctacacacaaatagtataattatgcctgcaaatgaaatgcttaataataaattacatgttacctagcaatgttaccagcagcagagacaatggcattctgtgacacagaggcaactctgctcattccttgtccatcttgtcccaaatcatacacctgtgaatacaaaatcattctcacttaaacatgattatatactatacacatattattaaactctttcttttaagggatcctttaatattggtatttaatacaaacatgaaaacattcagattcgaaatttcatagaaaggggacccttctgagaagtgagttgggctttttttttttgagacgaagtcttgctctactgcccaggctggagggcaaaggcatgatctcggctcactgcaacctccgccgcccaggttcaaatgattctcctgcctcagcctcccaagtagctgggattaaaggcacataccaccacacctggctaatttttgtatttttagtagaggcagggtttcatcatgttggctagactggtctcaaactccagacctcaggtgatccgcccaccttggcctcccaaagtgctgggattacaggcttgagccaccatgcccagcaggctttttttttttttagttacacagttcataggaaaaatttaagaggtgggaattgtcttccttaaaaataaggatttatttgactcttaatggtataataatattaatactaacctgtattactcctttctcagatcgtgtatataaaatatttctagaattatcaattgcaatttgaagaataggatctaaaagtaagacaaaaaaaaaaaagagaaaaaagtaaacccaaggattaacaaagcaaatacattagctagttacaacaaactgttgaatcagaactttgtattcaggggctttctactctcttgctttgtagttaaatcctaggatgtttgcataagatccagtccaaaaagcattttggtcagacaacacatgaaaaaaacacatgctaaatactgtgactgggttatgagcatagaaagtaagttattttgtcctctaaatgaattttaagccaaactgaaaacaaattctaagttattttttcatgaaataacttagaaaataaattctaagttatttaaacattaatgaatgtttactacatcctagaaacacagaataagtatacctggtcctttatgttaagaaacttccagtttggcctaattgattgtgtgaaagaaaataattttaaaattcagtcatattaatctttgggtatacagatcttattttgccaaagcattttaaaaattatttcacctgttgaaatctctcagttcattaaaagctaagatatattctttttatactggaaatttgttctagaccaagcaaacaatgtattagctgtctgaatgtctgtctctctcacatacatacacatattttggtttaattatgtacagctgttttagacgcaagttctttgatgctacatttataggaaataagtaaacttgagaacaaaatccacactttctctaggttatgatctccttaccctttaaaagaccttatgaatatataagaaatgctacttaacataacaaattgtttcaattaagaatgataatttctgaagaaaacgttgagggaacaatgtgttagaaattagttgtacttgccaaatttattgttttctacttaccatcttctgagaacgtgaattgtagcaaggaaggaacaaggaaagaaagtgagctctttgagtggtttattttcctacatctttggctaaaccaccctgcttcagccttaaagaaaaaagtagaaagacgacttataaaagtatgtaactcccttacaataactactgtatatccatatttataaaaaccttcaaatcttcatgaaataccagttataatcactaataccagttataatcaacaaaacgagacatattattcaaaattaactactgagtttagcccataatttaaaatatcaaccaaatactgacaaggaaagaatttcaagacatactgttagatgaaaagccagttatgggctgggcacagtggctcgcacctgtaaatcctagcactttgggaggccaaggcaggtggatcatttgaggtcaggagttcgagaccagcctagccaacatgatgaaactctgcctctaataaaaacacaaaaattagctggatgtggtggtgcacacctgtaatcccagctattgggaggctgaggcaggagaactgcttaaacccaggggatggaggttgcagtgagctaagattcagccactgcattccagcctgggtgatagacctgggtgatacagtgagactccatcacatttaaaaaaaaaaaaaaaaaaaaagcaattacgaattaaatcaataatccaagtgaaaacacatatttgcaaaagtgcattttgtatttgtatatgtgtatatacacacaaacacatatgcatagatatctatagagacattgatgtgtgccttatgttccacgaggacatacatagaataatgacttttacctctgagggctgagttttgtaggcatggtgtagtcatggggactacagcttcaactgtatgcttgaatatttaccataaaaatatattaatgtccttatataattagaaaacaaaataaaggcttatctttccctactccatcaagagagaaaaaaaaacgtttacaaatgtcagacttacctggtaggctacttcatataaacagccatcctttccagccaagaaaattctgccattatcagtggaagttattgttaaaaggtaagtattatcagtaggaagagaatataaaggatctggaagcaactgcattccaccagacaaactatcattaagaactccagaacctatttaagaaagaatacataaatcagtttattagctactccacagtttttaaaaatctttgcattatcatcagaatctatatgtttactcaattcttttttttttttcttgagacagtcttactctgtcacccaggctgggtgcagtggcccgatctcagctcactgcaagctctacctcccgggttcatgccattctcctgcctcagcctcccgagtagctgggactacaggcgcccgccaccatgcccagctaatttttttttgtatttttagtagaggcaaggtttcaccgtgttagccaggatggtctcgatctcctgatctcgtgatccgcctgcctcggcctcccagagtgctaagattacaggcaagagccaccatacccagccttactcaattcttactgacaattaacatagtcaacagcttctataatatacattttaaaattactaaaagaagtctgatacaatttgataattcaagttaaacagaacctgcagagtgtgtgagtgtgtgtgtgtgtgtgtgtgtgcctgtgtgtttattatatagtaagataataaacaagaaactaacccggccgggtgccgtggctcatgcctgtaatcccagcactttgggaggcccaggtgggcagatcacctgaggtcggcagttcaagaccagcctgaccaacatgaagacaccccgtctcttctaaaaatacaaaattaggccgggcacagtggctcacgcctgtaatcccagcactttgggaggccaaggcaggtggatcacgaggtcaggagttcaagaacagcctggccaacacagtaaaaccctgtctctactaaaaatacaaaaaaattagctgggtgtggtagtgggtgcctgtaatcccagctacttgggaggctgaggcaggagaatcgcttgaacctgggaggcagaggttgcactgagccaagattgcaccactacactccagcccgggcgacagtgcaagactcccttatcaaaaacaaacaaacaaacaaaaaaacaaaattagccgggtatggtggtgcatgcctgtaatcccagcaactcaagagactgaagcaggagaatcacttgagcctgggaggcagaggatgcggtaagccaagatcacgccattgcactgcagcctgggcaacaagagcgaaaatccgtctcaaaaaacaaaacaaaacaaaacaaaacaaaaaactaacccaatgttaacttgtggaaaagagcctgaggatttggcagtaataatcattaatgtgagtcaatggaattcaacatttcacccagattagcttttaactgtaatatcaattggccaaaatactattattttaaaaaacgttaacatgtgggttgccatacctgtttgcaaattagcatagctgagtccaagaattactatgtctacaggggtcgccaaaaccaggaggtgtcgcacatgaggttgaaagatgcctaagataaagtagacacagggcaggaatactttcagcatttaagcactaacagagtaagcttttattaccattaaagtgagctactaattaaatggtatatgaaaagtctggatgcagtttagtcaattctgttgttaaaaatattattatgtatgatcatttaaataagtaaattttgaatgtcatcaagataatgaagaggaaaaaaagttaatagcagtggaaaagaaccaccttagaaaacaatcacttcagtatttaatgctattttaaaagtgttatattacaaaatagtttaaatatattaaaatatagagatgtatatttgtatacccatgttcatagcagtgtttttcacaataactaaaaggtgaaaacaaaatccaagtgtccatcgatagatgcattaaaaaaaatgacatatatatatatacacacacacacacaaaatggaatactactgaactttaaaaagtaagaaagttggccgggcacgcctgtaatcccatgggaggctgaggcaggcaaatcacctgaggtcaggagtttgagaccagcctggccaacatggtgaaaccccatctctactaaaaacaaaaaattagccgagtgtggtggcacgtgcctgtagtaccagctacttgagaggctgaggcaggagaattgcttgaacccgggaggcaggggttgcagtgagccgagatcacgccattacaccccagtctggacgacagagtgagactccatctcaaaaaaaataaaaaaataaaaacataaaaggaaaaatgttctgatgcatgctgtaacacagatgaaccttgaggacataggttaaataaaatgagccagtcacaaaatgaccaatatagtaccatatgattccatttatatgaggaaacctagaatagtcaaattcttacagacaaaaagtggaatggttactaccaactgctgagggaaggaggaacaggagtttttagttaataggtacagtttccattttacaaaatacagagttctagatatagatggtggtgaagtttacacaataacgtgaatggacttaataccactgaagtataggcttaaaaacagttaagatggcaaagtttgtattatgtgtattttaccacaattaaaatatatataatagatttcattttgaaatgcaaataaaagctagacaattttagaaaataaaacttacacctatagttatctacacaagaaaagattacaaccttgataatagtatatagcaatatttatacacttaatgcatctcttttagattctatgtaaaggacatacatttgctttgcttttctttttgagacagagtttcactcttgttgcccaggctggagtgcagtggctcgatctcggctcactataacctctgcctcccgggttcaagtgatcctcctgcctcagcctcccgagtaggtgagattacaggcatatggcaccatgcccagcttattttgtatttttagtagagacacggtttcaccatgtggtcaggcttgtctcgaattcctgacgtcagttgatccacccgccccagcctcccaaagtgctgggattacaggcgtgaaccaacgcacccagtgtctttatttcttctttttttttttttttttttgagacagggtcttgctctgctgcccaggctggagtgcagtggcagaatcaaggcttactgcagccttgtcctcctatgctcaagcgatcctcccgcttcagcctcatgaatagctgggactacaggcatgcaccaccatgcctggcttatgtttctgttttttgcagacagggtatcaccatgttgcccaggctggtcttgaagtctcagactcaggtgatctgctcgcctcagcctcacaaagtgctgggattacaggtgtgagccaccacacccagcctgaaaatatattttcaatgcaagtaaataaatagtgtataaaatgtcggtttgggctgggcgtggtggctcacgcctgtaatctcagcactttgagaggcagagacgggcggatcacttgaggtcaggagttcgagaccagcctgaccaacatggtgaaaccctgtctctactaaaaatacaaaaattagccgggcctgctggcgggcgcctgtaatcccagctactcgggaggctgaggcagaagaatcgcttgaacccgggaggcggaggttgcagtgagccgagatcgtgccattgcactccagcctgggcgacagaatgagactccatctcaaaaaaaaaaagaagtctgtttttacttaactgagtatctataattgcaaaatggccataatcttaaaaaatttcacttaggccttgcaaaaaagtaatttttgtctattatttcctcctataaaaaggtacatttggctgcacagtggctcacatctgtaataccaggactttgagaggccaaggtgggcggatcgcttgaggccaggtgttaaaagactagcctggacaacatggccaaaccacatgctactaaaaatacaaaaattagccgggaatggtggcacatgcctgaaattccagctactcaggagcctgaggcaggagaatcgcttaaacccaggaggcggaggttgtagtgagcaccaaggtgactccactgtactccagcctgggtgacagtgagacactgtttcaaaaaaaaaaaagtacggttaaagaatgtgtgtgtgtgtgtatatatatatatatttatttatttgtttgtttgtttgtttgtttttcagaggcgatgtctcactctgttgcccaggctggagtgcagtggcgtgatcttggctcactgcacgctccacctcccaggttcacacaattctcctgcctcagcctcccaagtagctgggactacaggcgaccaccaccaagcccagctaattttttgtatttttagtacagatggggtttcactgtgttagtcaggatggtctcgatctcctgacctcatgatccacccaccttggcctcccaaagtgctgggattacaggctcaagccaccatgtccagccaagaatatattttaaatttaaatcaatcaattctccttcctagtaactctgataagagatttggcattatgctgggcatggtggctcacgtctgtaatcccaaacactttgggaggccgaggtgggcggatcacctgaggtcgggagttcaagaccagcccgaccaacatggagaattcccatctctactaaaaatataaaattagccaagcgtggtggtgcatgcctgtaatcccagctacttgggaggctgaggcaggagaatcgcttgaacccaggaggcggagggtgcggtgagccgagatcacgccattacactccagcctgggcaacaagagcaaaattccatctcaaaaaaaaaaaaaaaaaatagagatttggcattatgagggtgaaagagtaagtcaaacaatgcttgtgatatctacaagatttaatttactctgaactctgttctcacttccatgggctatcaggattatggccagggcatggcagctcatgcctataataccagcactttgggagaccgatgtgggaggatcacctgaggtcaggagttcgaaaccagcatggccaacatggcgaaaccctgtctctactaaaaatataaaaattaggcgtggtgacatgcgtttataatcccagctacttgagaggctgaggcaggagaatcgcttgaactcaggaggcgagactgcagtgagcaccaaggtggctaaactgcactctagcctgggcaacagagtgagactctgtaacagaaaaaaaaagaaaggtacatttaaaggatatattttaaatttaaatcaatcaattctccttctcagtaaccctgataagagatttggcattatgagggtgaaacaataagttaaacaatgcttgtgacgtttctaagatttactctaaactctgttctcacttccacgggccatcaagaatatggccagggcacggcggctcacgcctgtaatcccagcacattgggaggccaaggtaggcaaatcacctgaggtcaacagttcaaaaccagcctggccaacatggcaaaaccctgctctactaaaaatataaaaattagctgggcatggtggcacatgcctgtaatcccagctacttggaaggctgaggcaagagaatcgctcaatcctgggaggcggaggctgctgtgagcggagatcacgccactgcactccagcctgggcaacagagcgagactctgtctcaaaaaagaaaaagactaaaaaaatggccaggtgcagtggctcacaagtgttaacccagcatccctgaggtgggtggattgcttgagcacaggagttcaagaccagcctgggcaacatggcaaaaccccatctctacaaaaattagcctggtgtggtagcacaaaactgtagtcccagctacttgggaggctgaggtgggagggtctcctgagcctgggaggttgaggctgtagtgagccatgatcatgccactgcactccagcccgggtgatagagtataagaccttaatctcaaaaaaaaaaaaaaaaaaaaaaaaaaagagaaagacagactaataaaatgcagacactaaaatttttcttaacattaaattcagcaattaatgaaaaatctatagtgcaaaaccttcaggtatatcaagaaagagcagtaaaaagcaaataaaataaaattcaaaaaattacagtttaacatttttaaaggcagtgtcacttataccattaaagtaaacagttaaacattaataatcactttacatatttctaattagaattcaaaataaaacttcaatggagaatacaattgtttaaaaaagggtgttgtcagccaggcgcggtggcttacatctgtaatcccagcactttgggaggctgaggcgggcggatcacctgaggtcaggagttgagaccagcctggccaacatggcggagccccgtctctactaaaaatacaaaaattagctgggtgtggtggcgcacgcccgtaatcccagctattcgggaggctgaggcaggagaactgcttgaacccaggaggcggagattgcagtgagccaagattgcgccactgcactccagcctactcgatggaacgagactccatctcgaaaaaaatgtgtgttgttgttcaggtctataccatttggagtttacatatacaaacataatctcttccttatagttttatttcttacctgcttttggcttcacaagccccacagcaagaatagtctcactaagtccatcaaaataggcaaggtctcctctgtgaataaatgaagaaaaacatgttacacatataaagcaaataggccagatgtggtggctcatgtctttaatcccagtactttgggagtctgaggcaggaggactgcctgagcccagaagttcaagaccagcctgggcaacatagtgagactgtctctacaaaaaagaaacaaaaaattagccaggcatgggggtgtgaggccactgagttggcaggatcgcaaaggcctgggaggttgaggctgcagtgagtagtgatcatgccactgcactccagcctgggtgacaaagtgagagcctgtctcaaaaaagaaaagaaaagaaaaacagaaaaccaagtattatcttacaatgatctttattattattattactattatttttgagacaaggtccagctctgtcacccaggctgaagtgcagtggcacaatcttggctcactgcaatctccacttcacacctggctaatttttgtattttttgtagagacaaggtttggccatattgcccaggctagtgttgaactcctgaatgctctttattagttaaataaatttagacacagaatataatgaaaagactgggtgggcacagtggctcacacctgtaaacccagcactttgggaggccggggtgggcgaatcacaaggtcaggagattgaggccatcctggccaatgtggtgaaaccccgtctctactaaaatacaaaaaattagcccggcatggtggcgcacgcctgtggtcccagctactcgggagggtgaggcaggagaatcacttgaacccgggaggcagagttgcagtgagccgagatcacaccactgcactccagcctggctagagaacgagactccgtctcaaaaaaaaaaaagactgggagaggtggctcatgcctgtaatctcagcactttgggagggtgaggcaggagcccaggagagttcaagaccctgggaaacacagtgagacttggtctttatgaaaaatttatatatatatataactttttcattttatatatattgaatatataaaaatatttttcattatatatataatgaaaaaataaacaagcaaagaaaactgtttcagttccaagacccagggatccagacctgcttatggctaaggatgaactagaaaaatagggaaatacaaaaatagaaaatgctgctccccattccaaacatctccacaacagggctgcacatcaagtaatagcaatctactgctggggcagggataagggtaagaagagggccatcttacaaggatggaatcacaggaagagcctaagactgaggatgtaagaggaacactgagaaaaaatctccagtaaaccaacttgcaccctaagtacaacaacagaacccaaatccagctcaagtcctgacctggaaaaaggcaattccccatataataaagatctgctataccttagccaaggaaaagacatgcccatttctaagaataaataccacttgctacttacttacagtatctactgtcttaacatgatttctggctttcaataagaaatcatgagacacaaaataacaagaaaaaaaaccccagtgtcaagaaacaaagtaatcaatagaaccagactcagctatgaatccaaactatcagacaagaaatgtaaagtaactatgaactatacatataggctttatataggaaaaattacctaattgactatatgtacaaataggtaaagttgggaggttgagacgtgtggatcacttgaggccatgagttcaagaccagcctggccaacacaatgatacctgtttctactaaaaatagaaaaaattagccaggcatggtgtcccaggcctgtaatcccagctactccggaggctgaggcatgaaaatcacttgaacctgggaggtggaggttgcagtgaggcaagatgataccactgcactcaagcctgggcaacagagcgagactctgtctcaaaaaaaagggagaaataaaacagacaaaaaaaaataggtaaagaatttcgacaaaaagataaaaattataagaagtcagcgaggctgggtgtggtggctcacgcctgtaatccccagcattttgggaggctgaggcgggtggatcacgaggtcaggagatcgagaccgtcctggccaacatggtgaaaccccgtctctactaaaatacaaaaaaaaattagctggccatggtggcacacgcttgtattcccagctactcaggaggctgaggcaggggaattacttgaaccagggaggagaaggttgcagtcagccaagatcttgccactgcactccagcctgggcaacagaatgagactcagtctcaaaaaaaaaagccaatgaaggccaagtgcggtggcttacgcttgtaatcccagcactttgggaggctgaggtgggcaggtcacctgaggtcaggaattcgagaccagcttgcccaacccggtgaaactccgtctccactaaaaatacaaaaattagccgggtgtggtggtgcatgcctataatcccagttactcgggaggctgaggcaggagaatcacttgaacccaggaggttgaggctgcagtgagccgagatcatgccactgcactccagcctcagcaacggaatgagataaaaaaaaaggggggggggtccaggcgcagtggcttacacctgtaatcccagcactttgagactccgtctcccaaaaaacagggagatagagacagaaagtggaaaaacaaaaaacagaatggagcatccaaaatgaggtatataacaaaagtatagctgaaatttctgaagaaagagaatgtatcagaatatttcaagataatggctgggctgggtgcggtggctcatgcttgtaatcccagcactttgggaggcccaggagggcaaatcactggaggccaggagttcaagaccagcctagtcaatatagtgaaaccccatctctaataacaatacaaaaattagccaggtgtggtggcccatacctgtagtcccagctactccagaggctgaggcaagaagtgcttgaacccaggaggtggaggttgcagtgaaccaagatagtccactgcactccagcctgggcgacagagcgagactctgtctcaaaaaaaaaaaaaaaaaaaagacaatggctgaacagaaaaggagagagagagagagaaataaagataacagctgaaaaaaattctaaaaataatagaagacatcaaactaaagatctaagaagctcagagaacaagaagcagaaaaaataccacgaaaaaatatgatctagactttcaagaaagcttccagtcatcctgaaaaggccatccacacaggaacaaaatagctaaatggcaacttatgcggactaggattccccatcctcttacatcatgccattccacagggccctttgataactggcacagcctcttggaactacgatccaatgctgagatatttgggggttagagaacaatgaaatgaccaagattacatttttatcatccaggtggaattaggatttataatagaaagccaattgaatatttaaactaagtataaattttacaaaattgaatttgtggaccttgtgccttgattttttaaaataagtacattcttcaaataatttttctttaaatgaacacacactgctatggatcaaatatctgtgtcctcctaaaattcatattaaatcctaactcttaatgtgatagtatttgtaggtggggtctttgaaaggttattaggtcatgagggtatatctcatgaatgggattagtgcccttataaaagaggacccaaagaactcccctacccctctgccatgtgaggacagagtgaaaagatagccatctatgaacattgaagtgggctttcaccagaccttgatcttggacttccagcttccagaaccatgagaaagaaattcatgttgatcacaggctatggtattctgttttagcagctcggactaagacacacagtaaggtaggactgtttgttccatgagggcagaactacattcatctcattcagtactgttcctaccacaacaacagtgtcagatacataagatcaatatgtatgtgttaaataaatatgttggatgttaatggaaatgtaaaaaatttcattagtgtttttttttttttgagatggagttttccctcttgttgcccaggctggagtgcaatggcgcgatctcggctcaccacaacctccgcctcccaggttcaagtgattctcctgcctcagcctcccgagtagctgcgattacaggcatgtgccaccatgccaggctaattttgtatttttagtagagatgggctttctccatgttggtcaggctggtctcgaactcccgactgcaggtgatctgcctgccttggcctcctaaagtgctgggattacaggcatgagccaccatgcccagccgaaaacatattttaaagaaaacaattattctcacatttatctgttctgtaatatttttgcaatgacttctcttgaaaagatacatacctaaacaaaaaaggtttcattatttagtataaaaatgaatatgttatggtaacataacaaagtggggaacattcagggtacatgaaaaataatcacaatcatacatcactgctattacaactattacatttcaacatgaaaaattgctacgaaacttctagtagaaaaaaatggtttcgtttaagctataggtgttaagctgtcatttagtttcaattttgtttcaataatacagtgttttgttgttgttgtttctgagatggagtctcgctctgtcactcaggctggagtgcagtggcactatctcagctcactgcaacctccatctcccaggttcaagcaattctcctgcctcagctcccgagtggctgggactacaggcatgtgccaccacacttggctaatttttgtatttttagtagagacagggtttctccatgttggccaggctggtctcggactcctgacctcaggtgatccacccacctcagcctcccaaagtgctgggattataggcgtttgagtcagcgtgctcggccgatacagtgtctttttaatgcacgtgtgttcctaaaaagatcattaattactcaggaacaagagtaacatcttaattatatgggctttcctatgtttatcccacacctcatctaaggataatgtaatggacaactggaagtaaaacaaaatctatctctaaaaagtcaacagggagatcaccagaccaacatgctgtatttaagcaaaagtaccttaggctttcactcagaatcatttctatacatataatttacacacgggtcaaattcacaaaatgacaacaaaataaataaatatcacatgcctactccatagaaatgcaaggaaaacagaagtctttaaaaatgtccaatcatctctcaatgaattgccaacatctatttttactacgggctaacagcttgggacccgggctcctgccactcaagaatggcacctaaaccagcagcagcagttggcagcttgttagaaatgcagactcttgagcctcactcaggactactaagacagaatgcacatttgaacatctccagatgactgatactgagaagcactgacccaaaggctagatgaatgaaagataaaccaagcagcttctaatgagaacactagctacagtaaagtttatataaattccaatcacccttaaagcaaaccagccttaaatacatacccatcctcatagttccacatgaatatatcactgtcaattgtgagccaagctctgctgataggagggaacacacccatcatgcaattacactgcatatctgaggtagtgtggatgtaaggcagacagaggtgaatcttattcttctttaacttgtttcaatagcttttgacttaatatttacgtaaaaaatcacaatgtgtccactctttaatacaacatggaacccatatacttaaacgaattttaaataaaacccttaaatgaatatataacacattaattaaacatagaacaagaattataagaatgaaaaataccaattttaacatttttaaaataaatacaaagtaataggatacgtccaaactgctcaacaagttcaggtgggagaggaactcttcggatggaactgatctctggaaggttgggtacggacagcaaaccaggtccttgcaaaggataatccatatctgacatgccagaaacggtgggattatctacaaaaagaaaatgaagtatttataataatgtactgctcatcaaccgggcaaacaaaaggattgagtgccacaaaaaaattgttgtgtgttggttccaaaggtacagagagaatattctagttttgacccaacacaaagtagtcctgaaatattcccttgtgaaggtaggaacagttactggtttcaggcctaaagggaaagtcatatctcaaaaaacttgctctgtaacaaaggaaatgtttattttattttattttttttttttttgagatagagtctcgcactgtcgcccaggctggagtgcagtggcacaatctcggctcactgcaagctccacctcccgggttcacgccattctcctgcctcagtctcccaagtagctgagactacaggcgtccgccaccacacccggctaattttttgtatttttagtagaaacggggtttcaccgtgttagccaggctggtcttgatctcctgacctcatgatccgcccgcctcggcctcccaaaaggctaggattacaggtgtgagccaccgtgcccagctggaaatgtttaaatttgataatttagtgttattttaaaataaaagtggctgggcgcagtggctcaagcctgtaatcctagcactttgggaggccgaggtaggaggatcatgaggtcaggagtttgagactagcctggccaacatggtgaaactccatctctactaaagacacaaaaaattagcctgcctggtggcgtgcgcctataatcccagctactgcggaggctgaggcagaactgcttgaacccgggaggcggaagttgcagtgagctgagattgtgtcattgcattccagcctgagcgacagggcaagactctgtctcaaaaataaataaataaataaataaacaaaatgaaagcatgtaattgtattgtttgtaacacaaaggataaatgcttgagaggatagataccccattttccctgatgtgatcatttcacattgcatgcctgtatcaaaacatctcatgcaccacataaatatatacaccgttgggcgcggtagctcacgcctgtaatcccagcactttgggaggcagaggcaagccgatcacaaggtcaggagttcaagaccagcctggccaaaatggtgaaaccctgtctccactaaaaatacaaaaaaattagccaggcacagtagcaagcacctataatcccagctacttgggaggctgaggcaggagaactgcttgaacctgggaggcggaggcagcagtgagccaagatcgtgccactgcactccagccagggtgacagagcaagactctgtctcggggagaaaaaaaaaaaaaaaaaaaaaaaaaatatatatatatatacacacacacacacacacacacacacacacacacacacacagacgcctactatgtacacacaaaattaaaaataaaaaaatttaaaaataataatttagtgtttttctatcattttgctaatctgaaatgggaaaatataaaactgctttggggctcaaaggtaaaatgactataagcaaacaaaataatgactgggggaaaatactgcctttaccagctaaacatttatagattaaaacaacccatgacttttccctttagatttatccccaagaccactaagacaaatacaaataataccccacaagcagtatcttattggggggataaaaacaaagactgctctataaagtgttctcatgggcaacctttctcttgctctaagactccatcactaaggacaggagtgggctggtctactcagcctacccttgctcccggacaaggcgttatttagacctgactgatgacctacttatctcaggcactttctcaggttctatagagtacaaagatgttaaggaaaactgacatataaaacaatcttgaagtgtattatggaaatttttaaaatatatataagaaaaatacaataaatacccatgtactgattatccaacttaataaccagtaatatccccaatcatgtttcatttttatcattgttcactccttccccaattatctttttatttttattttttgagacggagtctcgctctgacgccaagctagagtgcattggcgcgatctcagctcactgcaacctccaattccctggttcaagggattctcctgcctcagactcccgggtagctgggattacaggcatgagccaccacgcccagctaatttttgtagttttaatagagacaaggtttcaccatgttggccaggatagtctcaatctttttttttttttttttgagacggagtctcacaggctggagtgcagtggcctgatctcagctcactgcaagctccaccacctgggttcaggccattcttctgtctcagcctcccaagtagctgggactacaggcgcctgttgccacgccaggctaatttttttatttttagtagagacggggtgtcaccgtgttagccaggatggtctcgatctcccgacctcgtgatctgcccgcttcggcctcccaaagtgctgggattacaggcgtgagccaccgtgcccggccggtctcaatctcttgacctcgtaatccgcctgccttggcctcccaaagtgctgggattacagatgtgagccactgcacccggccgaactctttttctctttttttttttttcctgagacggggtttcactctgtcgccttggctggaatgcagtggtgcaatcacagctcagggcaacctcagcctcttgggctcaagcaatcttccaccacagcctcgtgagtagctaggactacagtgtcatgacaccatgcctagctaattttttttttgtttttggggtttttttttgggatgggctctcgctctgtcgcccaggctgtagtgcaatggcggctcactgcaacctctgcctcccaggttcaagagattctcctgcctcagcctcccgagatgccaggactacaggagtgtgccaccacacccggctaatttttgtatttttagtagagacaggatttcgccatgatggccaggctagtctcaaactcctgacctcaagtgatccactcacctttgcctcccaaattgctgagattacaggagtaaaccaccgagcccagccaaacagcatttttctttttcctttttttttttttttgagacggagtctcactctgtcgcccaggctggaatgcagtggcgcgatctcggctcactgcaagctccgcctcccgggttcacaccattctcctgtctcagcctccggagtagctgggactataggcgcccgccaccacgcccggctaattattttgtatttttagtagagatgggggtttcaccatgttagccaggatggtctcatctcctgacctcgtgatccgcccacctgggcctcccatttcttttgagaaagagtctccctctattgccctggctggagtacagtggcgcgatctcggctcactgcaacttccgcctccctggttcaagcgattgtcctgcctcagcctcctgaataactgggattacagccatgagccaccacacccagctaatttttgtatttttagtagagacggggttttaccacgttggtcaggctggtcttgaactcctaacctcgtgatctgccacctcagcctcccaaagtgctgggattatgggcgtgagccaccgcacccagccactttttgtagagacagggttttgccatgttgctcactcaggctggtctcaaactcaagctcaagtgatccaccccacttccaggtcccaaattgctaggattacaggcatgaggcacagcgccaggccttttttttttttttttttttttttttttgagacagggtctcactctgttgcccaggctggagtgcagcggcgcaatcacagctccctgcagtctcaacctccccgtctcaagttatcctcccacctcagcctcccaagtagctgggggtccaagtgtgtgtcaccatgccaagctaatttttgtattattgtatttcttttctttaagaggctgggttttgccatattgccaagactggtctcaaacttctgggctcaagtaatctgcccactttggcctcccaaagtgctgagactattgggctgaattcatattaaagcaaatccaggctgggcacagtgggtgacacctgtaatcccaacactttgggaggccgaggcgggcggatcacatgaggtcaggagatcaagaccaacctggccaacacggtgaaaccctgtctctactaaaaatagaaaaatgagccagtggcgaacacctatgatcccagctactcaggaggctgaggcaggagcatcgcttgaacctgggaggtggaggccgtagtgagccaagattatgccaactgcactccaggctgggtgacagtaagactctgtctcaaaaaataaataaataaagcaaatccagacatcccatttaatcctaaaacataactttaataggccgaaggtggcagatcaccatgttaaatggcagtgggaacacagagggaggaatcgataactttagtgaggatgggaatgctacgaaagacttcaggccaggagtgtgacttacatctgtaatctcagcactttggaaggctgaggtaggaggactgcttgatgccaggaatttgagaccagccttgtaacagagtgagactacgtctctacataaaaattaaaaattagctgggtgtggtggcaggcgcctgtagtcccagctactggggagggcaaggcgggaggaccacttgagctcatgagttagaggctgcaatgagctgtgatcatgccactgcactccagcctggtaacagaactagaccttgactcaaaaaaaaagaacaagaaaaagaaagacaacaaagagaaactaaggactttcacagggagtctggaaaaagtttgtcaggcaaaaaaagaacattgcagaaacaataaaagtaagataaaatcctgaggaaatcctgaagatggggcttcttacggaaaatatgctaaattctctgtaatcagagcaacggatgaaaaattggatggaaaagaaggggaagagactgggtgaaagaggaaggtgtgtgtaaaggcatgagatatgtaagagaaggaccagaatgcatgcactgtttttatatcttgttttcacacctaaggaggccaaaatgagtaatgttgttcaagatgataattgctaataggccaatcaggtattataagacacgctcattggtaagtagctgtagggagcaaatactatctttgtttctatcatttctttgattacaaagctatcaatgatttttataaataatcagaagtgttctcggtttacactgcacaaattatcctatttagattactttggttcttgctcaccaacaatcttttctttcttacacttcgctggttttctccaaattccatctcacaaaggggtcactttttctagcaactgatgtaattccataagccgtggggagctggttataacttaaaactgttaaacaaattactttccagtcacctatattgtcaacacatattctgccttactctccctgtacataagcactgtgatttccctgttctctttctttattccactggtagttcttttaagatcctccagcatttcataacacacatctctacacataataaagcgtttcttggccgggtgcagtggcttgcgcctgtaatcccagcactttgggaggccgaggcgggcggatcacttgaggtcagagttcgtgaccagccaggccaatatggtgaaaccccgtctctacttaaaaaacacaaaaattagccgggcttggtggcaggcgcctgtaatctcagctacttgggagtctgaggcagaagaatcgcttgaacccaggaggcggaggttgcaatgagccgagatcgcgccattgcacttcagcctgggcgaagagggaaccgctccgtctcaataaataaacaaataaatataaagcaaagcgtatctttaagataacatgctaaatttccaaattaacttcgtttgctcttacgatctactcaaacactaacaggagaaatgaacaaatttgggacttggatctggagatgcttctcatatggccttagccataagcacttgagagcggcgagaagctcattaaggttgaggtctttgcctctttctgcttcaactgggagcttgctcttcactcttgccctctcaagtatctacaatgaagaaagtgaggaaaggaaaaaacctgaaaagaagctgcttgctgttctccaaaaatgcagccaacagtgccataaatctcagcatatcctcgccgggaccaacgctggggataagtagcaaattaggaagtcaggcgagagtcctttaggttgagaaagcagggtcactatcactcacttggggcagacaccataagcagctcggaaaggtccgggtacatgcggtcctcttgcaactgacggtcgatgagccgtccagcattttccagagcttcctgcagggctgcggcagatgtagaggccggcatcgccgcgcccaacaaagaagacggcatctcggaaatcgtagacaccagggtccagaaaaagtcaaaaaccaaggagaaacaagaaaagatccaagaagttagcttagatccgccgcctagggcgcgcgcgccaaacgagcgccttggcgcctcgacatgacgcacttccgcttcatccggtggggaactggaagacgccgttctggcctgggaagaggaagctgttgggagggggctagaggttgtgggtggagctaggaggctgctgatgctttcgagggggttgagggttttggggtgtggcagggtaaaattagggtaggttatttagggaagggagggagggaaaggaagggaaggataaaggggagggaacagggaaggagaggggcgggatggggttggatagggtgaggaggaaggagggaggagggatacggtaggtgggagctaggtcgtgtgtctggcctaggaggttggtcaggttccgttggtttaagcgcgtgctcgacctgagtcttggaacttcccgcgtcggtatccgctaactgcagctatatgagttcgcgcatgagcgcgcagtttggttctccaagtaactgcttttgtgagagtagttaagaattggtaggtcgctgtcacagagagggatataaaccagtatctcactatattcttcgcgggcttcagtgtaaattagaattcatcaggcttttccatttgcgtgtcgctgtcttttgactttgttgccccttagtataaaatacgtgtttaagaagaagctgagtgcaggtggaccgctgccgtgctttttatcgtggcagagatagcagacagttctaattcatctttccattcccagcgctagtataggaactcgtatgagataggaacccaagagttcatacaatcctaagaaactgaatacttgccttgtgcctggtgctgggactatcaaactaacacagtgtttcctgtccttaaggtgcttcaagcagagacaaagggcttcattataatttttctatttggataggtataaactatagcaggataggagaaagcagagaggtaaaagaggcttcatttactacagaaggcaacctgagtgggtaaatcaaagcactttttagaaagctgctcttatttagaatctcacctaagaaagcttccagttatgttcttcagaatttcacaaatcaataactgaattactctaaattggtcttttgctatttgaattacatttttactccctcaaagacttgactacatttctgaaaattgaaagttctttgatgttaccaatctacacttaaaatttgacatagccaatataccaagaaaaactggattttttatcattggtatatagataggcagttgggtctctagctgtgagtttactttatttggtagaccatagattgaaaagtggtggtctggcaccgagtttgtttttaatttgagacaaaatacacaaagttttcaactccataaattggaagattcaacaacgttgctgtgatattcctgcatagaagtaaagctccccaaagtgtaatctaactaacttaattcattggcatattgcctatgctttcccactacaactgctaaaccgagtaatttctacaaaagactgcaaagccttaaatacggactctggcactttacaggaaaagtttgctgacctcttccctagaacagataattatgaatttttttggtcttaggacccccttgatacccttaaaaattattcaggattccagagagtttttgtttcatgttggttacatctattaatatttgtgaataactcaaactgaaaattaaaatgtttaacattgtatttaaaagagtaacaaggccgagcacagtggctcacacctgtaatcccagcacccagcactttgggaggccaaggcaggtggatcacaagttcaggagttggagaccagcctggccaatatggtgaaaccccgtctatactaaaatacaaaaattagctgggcgtggtggcgtgcgcctgtagtctcaactgttcaggaggctgagccaggagaatcacttgaacctaggaggcagaggttgcagtgagtcgagatcgtgccactgcactccaccctgggcaacagagtaagactccgtttcaaaaaaaaaaaaaaaaagcataccaagcttaatccatgttaatataacacttttttaaaatgagaaatcactatagtttctaaaacagggagaagaatgcgattatttcatatttttgcaaatctctttagtgtctggctcagtaacggatggctggattctcatatctgtatctgctgtcaattgaagaaaaataaccctcttttaaagaattaaagtcagtttgattcagactcaggattgcaacctttcagagagtttctgttaagactgctccaaagtagcttttagcccacagcttacatgtcaggggttggaagctctgcatgtgctcagaaattacattaaacatgctcataaactgggtatagtgactcacacctgtaattctagcactttgagaggcctatgcatgagggtctcttgaggccaggcattcaaaaccaacctgggcagccaggtgtggacctgtagtcccagctacttggtgggctgaggcaggagcatcactttagcccaggagttccaggttgcagtgagccatgaccatgccactgcattctagtctggttgataaagggagactctgtctctaaaaaaaaaaaaaaaaaaaaaaaaaaaagctcataaattacattagagcaaaatctcatcaaagtttgggtgtaagagtacatctggttatagattacagaggcataatcatgaatcctatgggacactatcttatgtactggaagaggcaaggggtaggaacactgaacttacctttttttaaaaaatgcattgattgaagcaagagacgtgggaacctgtgctctaacctgcttattgtttccagggcattcttctagaagtctatacttagtcactgagttgggctttgtgaaattctgctggcaagcagaatgagcaaacttggttttttatgtttgctactttgtctaacatgtcaacattttgtgacttatttagttgaagtataatatattaatattaagaaaagctggcctcaccaggcgcgctggctcacacctgtaatcccagcactttgggaggccgaggcgggtggattgcctgaggtcagaggttcgagactagcctggccaacatggtgaaaccccgtttctactaaaaatacaaaaatcagtggggcatggtggcgcaagcctgtaatcccggctacttgggaggctaagccaggggaattgcccgaacctgggaggcggaggttgcagtgagctgagatcgtgccattgcactccagcctgggctacaagagcgaaactctgtctcaaaaaaaaagaaagaaagaaagaaggaaaaactggcctcagttacatatttagaaaaagaagaagtattttaataattgtcaacaagtgcagtcagtttttttttttttttaaacagagttttgctcttgtcgcctaggctggggtgcaatggtgcgatctcagctcattgcaacctctgcctcccaggttcaagcaatcctcctgcttcagcctcctgagtagctggaattacaggctaattttcttttctttattttttttttttgagatggagttttgctcttgttgcccaggttggagtgcagtggcatgatctctgttcactgcaacctctgcctctcaggttcaagcaattctgcctcagccttccgagtagctgggattacaggcacataccaccatgcccagctcatttttttgtatttttagtagagacgggggttttactatgttggtcaggctggtcttgaactcctgacctcaggtgatccacccgccttggcctcccaaagcgctgggattacagacgtgagccaccgcacccagctacgcctggctaattttctgtatttttagtagagacggggtttcaccatgttggccaggctggtctcgaactcctggccttgggtgatcctcccacctcggcttccaaagtgctgggattacccgtgtaagccaccatgcctgacctgtttttcttaaagtgataaactcatttcatttatttttgaaaaaatgtttgccaaatacttaaatatgaacaactgtactttgtgagtcattctttcaggtaaaaataatgttccatgaaaaaagctaaccactcaattacaagtggttttcttttcgatgaccattctacttagatatgcattagctgggcatggtggcgtatgcctgtggtcccatctactcaggaagctgaggcaggggaagatcgcttgagtccaggagtttgaggctaaagtgcttcatgactgaacttgtaaatagccactgcactccagtctgggtaacacagtgagaccccatctgtaagaaatttttttaaaaacatactttatgattacttctcattttgtcatactgaaggttaaaaagacgtataattaagggtcagggtttaacgaaatgaatactgtttatggctttattaaggatattcctaagggaaactgattttgcttacaacgcctatgtaactgaaaaatacagtgactactacaacattttgaatcctactgccttgatttattttaagggactgttttaatttag

SEQ ID NO: 601 - DNA, 247106 bp, Homo sapiens
ttaaacccaaagtgacttcaaagttgttttttggtttttaaaggggctacagaaaatggactgaggggaaggaatgggcacaatatctaggtctagctgaatcacagagctgttagctgctgctttcatccacaggtactccttttaccttattattttttagagagtcttgctccgtcacccaggcaggagtgcaatggcatgatctcggctcactgcagcctctgcctcctgggttcaagcgatcctcctgcttcagcctcctgagtagctgggattacaggcgcccaccaccacgcctggctaattttgtatttttagtaaagacagggtttcaccatgtcggccaggctggtctcgaactcctgacctcacatgatccacctgcctcggcctcccaaagtgctgggattaccagtgtgagccaccatgcccggcctattttttaatagagatggggtctcactctgttgcccaggcttgtcttgaagtcctgggctcaagcaatcttcccacctcagcctctcaaagcactggcattacaggtgtgatgccacagtacccggcctagggtgcccctttgatacgttatttttgaagtgatgttaataaataaagcttctgcttgggggttggtcatcaaaacaagaagaatcctcatcagtatggagagagcccaatcctgggcatggtccccaccaccaccaaaagtcttttttttttaactgagtctcactctgtctcccaggctggagtgcagtggcgggacctcggctcactgcaacctccgcctcccggattcaactgattcccctgcctcagcctcccaagtagctgggattacaggcacccgccacctgcctgctttttttttttttttttttgtatttttagtagagatgggattttgccatgttggccaggctggtctcaaactcgtgacctcatgtgatccgcccacctcggcctcccaaagtgctgggattacaggcgtgagccaccgcgcctgacccaacacaagtttaaaatgaaagctgttatcagtagagaatcttcaccacgttggcaccagctcaagtgtagtgtcggcgcacttttagcttagagtcagaaaaatagacatgtatgaaaatgcgtggcaggagcccttccataaagcaaatctctctgttgcagtggttcttaacaaggtgtaaacgttataactacctatggaacttttaaacctgtatgccaggccccatccaaacttactgactcaaaatctccgggcatctgtttttttgtttgttttgagatagagtctcactctgtcgccaggctggagtgcagtggcgtgatctcggctcactgcaatctttgcctcccgggttcaagcgattctcctgcctcagcctcccaagtagctgggaggtgtgcacgccaccacaccccggtaatttttgtattttttgtagagatggggtttcaccatattggcaaggatggtctcaatttcctgcgcttgtgatccgcccgcctcagcctccccaagtgctgggattccaggcgtgagccacggcgcccggccggcatctgtagattttaaaaggccccagtggttctgatgcacacccccagaagagaaacacagcgtctctacacagtactgagtccccatcaaggagacatttaacagaaactcctactgacatccattggttccttggggattactgacaatgtaacaaatcaagacagcaacttccctggctgtgaccaccaactgtggaaaacagcagcttgatagctcaatgctgtgatggagccgtccggaaaacgactcctcaacaatgaaccaaaaagagaagtggtgatctgtacacaaacgccaggagtgacaagaaccaggtgcaggagtccactggctttcccagctctcctgggttgaggacagacggctgaactggctgtgctatttggagatgggccccaccgccccttttcaactgtacggctcaggctgcttaaccatagcaactccatgggctggggtgggggcatctacagggcttcctgggggctctcccgactgccgccccccgcccttgtcttatttggaatcttttcctaatagacctcaactgaaggccgcatctccttctcgcaacacttcttttctcctccgcattctcaaatttgagacgcttgatgcgtgagagtcaaaccagctagcaaggacagcctggaagccgatgaagaaatgacactcaggatcagagctggacggcatcggggagaaagcctggcagagagggcaggggcacagagcagtggttatgttgggaaacaaggtggggatgaggaaatcaggtttccaggcagatttccaaaccttattcctactgtacggctgttacaagttttatggattttaaggaaatttcctctatcctgaaaactttttgagaaggggtcttgctctgtcacccaggctggagtgcagtggtgaaatcttggctcactgcagcctccacctcccgggtttaagtgattctcctgcctcagcctccccagtagctgggattacaggcactcgccatgacacccggctaattttttttatttttagttgagacagggtttcgccatgttgggcaggctggtctcgaattcctgacctcaggtgatccacctgcctcagcctcccaaagtgctgtgattacaggcatgagccaccacacccagccaattttttgtatttttggttttgccaggttgcccagactggtctcaaactcctgagctcaagcaatctgcccacctcagcctccctagcagttgggactacaggtgcatgccaccacaccttgcaaatttttatttttgtagacatctgtatgttgcccaggctggtctcaaactcctggactcaagtgatcctcctgccttggtctcccaaagtgttgcgactacaggcatgagccgccgtgcctggcaagatatcattcttcagcaaaagcaggcagcaacagcagcggtttgcctgtagctgtggtcatggttaactgaggcctggtttcaagggaaccgagtgaatcagggttaacggcttgatatgctgccattctctggatgcaggatgacatgagaggtcgggagcagtctcttcggcaagccctgctgcagagagcccgcggtggacaggaagggcggggggggcgggcaggctgcgtgccaggccaggctctcagcctggtctttaaggtccatattctgttcctgaggcatccagaaccccagactccttctcataacacaggaacacatcactgggatgctgcacatcacctttgctatttcagatgacgctggaaagtgctgtggacctgaaggtgagtgggcagaaaggggtttgagagtatggacttcctgggcgttcccatggcttcatctgatgagaaaacctaggaaacgtcttccaagtgaacttcctggtttcccttccctagaaaccaggagcagggtgggagtaaagaaatggaggaaggggctgggctcggtggctcacgcctgtaatccgatactcaggaggctgaggcaggagaattgcttgaacctgggaggcggaggttgcagtgagccgagatcacgccactgcactccagcctgggtgacagagcgagactctgtctcaaaaaaaaaaaaaaaaaaaaaaaaaaaggacgggtggggcccacgtgtcaagagggtgtgactgccatggggaggctacatgagtcaagggcagctcagggacctatcctccactgctgcctctgcttcacgaaccagagatcacctaaatcgccctcttagagcccagcccttactcagcgtctccgattagggcaggaagtaagacagggcatgggagagactcagtaacaacccacatgtcccaggaagtttgaagaccgacgatgtgagagtgccggggagcacaggagaggttgggggcttctggggaacgggcgctgagggtctccagccaggagcaaagggccccttgctgctgctacagtctctttttaatgagtttctcgagcttgcggatgcgtgacgactcttgctctggtgttggcgccgtcagggacagtgagccggagctttctgcccccgagggcggtgcggggagccgctggcgcaggagttccagcatgctgctctgctcactcctcttcagcccctgaggttgagagagaaacagaaccgtcacgaagtctgggccagaatggcccacgggggacagcgcagtatctggatatggggtcagcagaggctctggagacagcatagttactccaggctgaggatgaaccgtttcctcaagggactcaccatcccctgggtagtagcgtgggaggaaaagagaggggaagaaaaggtaaaggaagggaaagaagcggctgacagaggagaaaggacaggtcaagaaggtgggaaggacaacatgcctgtcctcatccccctgcccctgccccatcctccctgtgcaggtggtctcagcggggcatgcagggcctgtcagaatcctgaagtgcacgtgcccggggccatcctcctccagaggcttctctgaatccggtttgctctgtggagccaggcacatgcattttgagaaagcccccccggaacttatatcccaattcccggttaagaaccgctgagtgtgagggggatgagcaggtgtggaccaaatgtcccggcacaaaccttcatgtccagtatcttctgaaaggtttctgtgttgcagtctgtgagaagtttgatgtagttgtcaacaaacaccaccaacggttcatgaggggccatcactacctacagcgggaggagacaggagcaagcccctcaggaaaactaccaccacgggaggagacaggagcgggccctcaagaaaactcactacccaccgcaggaggagacgggagcgggcccttcaggaaaactcactcctcacttgcccgccgagcgctaaatggattctgagaggtttccttaagcagcagcaacccagactagaaacgccccagtggcccatctcatcttcacatgccactacagcaatgtcctaaatttgctgaatcctaaatacacctgcgctgctgtttgaagtatgggtttccggggccctcctctaaagactctaattcagtaggcctggctggagtcccaggtgacttttaaactatcaggaccatccgggaaaccctgcgtgagagggtctcctgttccaggcatttcaccagtacacggtacttgctccttctgccttgacgtactatgattcctgagaaatgggtggcaaaaggagctggtataagtaagtggatttctgcaaaaacaaaaatgccaaagctgcctcaccttttggagacttaaaatctgtaacttcatgtaacgactaacttaaactatcaattaacatacaaacaaaggaaaggaacggcactgcaacccttattcatttccgttttgttctggaatgcagtatctgattttctttccccagccgactgatttgttttgaattcctgagactgaagggaagagtggcgaggaggagttcactcaggcatcctctgccgataattcccagaccacaggctctcctccccagcagtaagcagcagggaaagaacatgatgaggcagcttcaccctcacctacatgagctcttcaccctcacctacatgagctgcttcaccctcacctacatgagctgcttcaccctcacctacatgagctcttcaccctcacctacatgagctcttcacccttacctacatgagctgcttcatcctcacccacatcccaccggtgtctgaggccctgctgccacttcctactcctgccgtccctgagtcatctggtttaggaagtggcctgaagagcctacaggtcctgggcttttaagaccacatcaccacaggaccatctgttctccagccctcatccctactcttcaaaatagctggaaaccagaggcagatgcgcagggcttcagacgttcctcactcgaagtacagtcttgttaaatggggctttaaaatatccatttgctgattagattcagttactacaacatctgttcagagttcatttaaagtggcagagtacagaaagccaaaaaggctgatgtggaagggagtaactgagagctgtgcctgaaattcctgctgagaagcggagatccctgacatacactgattcacagtggcaaccacctaacctccaagcttgaccacatttgatcacaagagaatcccacgccaacaagaaattcatttgtcagaaggaattactgagccctaataactatccacagactttcaacaatatctgatgaggccaaaatccagtccagcccaagaatgtggaccatgctttgaggccggtgaggataggacctaccctgtgctttcaaaaccaaggcttctcagaaaaagagattaaataaataactggccccttttaacacaagccatcaccttgaggatcatctcagcccgggtcatgcctttgacaacgatcttggtgtagctggcgggtgccttcctcaccacctgcgagctgatggaggggagatcgagcaggaccatcttcagcgagtgggtgtccagcagcagctgtggagcaaagcagagagcattaccggccccttccagcgacccagtgccgagtggactcatgccgatgagtcatgtttttctcgttatacacgtaacacattcttgttgcaaaaaattggggaaataaacagaaatataaaagaaaaaaattatgtataattcccatcacctaggagaaacaacatcaaggagccagcctatgtgtacgtatataaaaaactaaatcagggggccaggagccgtggctcacacctgtaatcccagcacttcaggagggccaggcagcaggatcgcttgagctcaggaatttgagaccagcctgggcaacatggcaaaaccccgcctctacaaaaaatgcaaaaattagccaggcgtgggggtgcgcatctgtggtcccagctactgaggaagactgaggtgggtggatcgcttaagcctgggaggttgaggctgcagtgactcaagattgtgccactgtaactctccagcctgggtgacagagggagaccctgcctcagtaacaaaccacaactcctccataaaactaaatcagaatcatactgtatgtatattcaattttataacctggttttctcacttaatatacacaatttttatattctattttcccatctttgcagtctttaaaaaacaaatcaaggtttttaagtgcactctagcctgggcctcatggcgagaccccatctctaaagaagaatcgtgatttaatggctgtgcagtactctgtgatgtgtgtggttgtgtaaactttaagatctttccaatggaatggacccatttacacctctgccagccatgcagactgcacccttatcagcactgaaaactcatcaaatcctgattattcattaggcaaaaaatagtaactcattattgttttactttgaatttctctggatgttactgaggatgtaggagatttacccaaatgtaaacattgtatcctggcaacaatctaccttttcctctttgtttgttctggttctctgggatgccaattatctagaaggacacccatagtcctaaaggctcactgactgccgggaatgacatgaggaacgttttgtcacatttaatctgagtaaagccttacctaccctggatgttatttattgttcccattttacagatgagaaaaagttccagaggattaacagctcaccaaactcatctcatgcaacggacggggttagacaaaagttggacgggaagctggaattcatttccggttgccaggtaacggggttagagaaaaggtggactggaagctggaattccatttccggttgcccaggtaacggggttagacaaaaggtggaagggaagctggaattccatttccggttgcccaggtaaatgtccctgggtggttttggtgacgagctcacactgactcctgctgactgccctgctctgctgccgccgctgctcttggcaaccagggagcagagaaatggctgaagacagaagggtgtactctggcctgttgagatggcttaggagaatggaaccacatggtcaccaagcagacaacggcagcagtggggtgacagctcccaatgccaccactcaactccggtgataacggccaaacttatattcagggcaaggcctgtactctctgccactgcctgcttctttgggaaagccttctgtaatcctatcaggtaggtgagaaatgggacccttcaggccctgcgacactttgcatcctccaatttcctatttactttgctttggacagaagaattaatgattaaagagaaactaagtaacgacagatactatgaacttaagggttatggcaattgtaattttaacaatggtagaaacatggggaagacgtcagtgttttatgtggaataatttaggtgtggtaaggaattacactaaggtcagagcaatttcatgcagctagtcaaaggcctgcaccacgcaggtcattcaactgtagccagcaaagtgcagggcattttggacctttctggatttctagagatagaaattcttactatcctagtgtctgctttgttgaaaaggccaagggctcagagaaaagggtatgcaaacctccaggagggggaatggcactgattgctcaaggcccacgtgaagagcctggcgttagcgcactttccagaattccagtggaaatgactgctgcttttcctcggaggaacccagaacaagcctctaaagcattctaggtggattaaattcttagatataaaaaagaaaaactttaagaagaaaatacagggcgcagtggctcatgcctgtaatcccagcattttgggaggccgaggcgggtggatcatctgaggtcaggagttcgagaccagcctggccaacatggagaaaccccatctctactaaaaatacaaaaattagccgggtgtggtggcgcatgcctgtaatcccagctactcgggaggctgaggcaggagaattgcttgaacctgggaggtttgcgctacagcctgggtgacagaacaagacactgtctcaaaaaaataaatacataaaaaataaaaaataaaaaagaagaagaagaagaaaatacagagattattttcattgcttatgggtggagaagaatgtcaaacatcagaaagaatgaaccacctaccctaaaatgaaaggcatctatatcagaagaaacaaacaaagtaaaagacaagacataaatcaggagaagatacgtgcaacgttgacaagggaacggggttccgaacatgaagattcctacacatcaacaggaaaagcacaaactatcccaacagcgacacaacaacaggcaaacaatactaacaccggattcacaaaagaggaaactcaaatgcccgaaaggcatatgaaatgacacgcaacctggttagtaactgggaaatgcaaattaaaaccacagatgtacaccataatacatccatcagagtcagaagtaaacagattatttgataatcaagtgtgggcacggccatggcactgaaattcacaaatgtacaccgtaatacacccatcagagtcagaagtaaacaggttgataatctagtgtgggcacggccacactgaaattcagactagtggtgacagtagaagttagttcaagcacgttgggggaaatttagcaacatttccttagctggagatgtgtatcacccataacacagcattaatacttatatccattagaggaattcttgcccatgtaaaaacgttccctgcatccgctatttataaaagcaaaagtttggaaacaacctacacgtccattgacagtggaatgaataaacaaatgacagcacattcgtgcaatggaatatgctgctgaggtgaaaatgaatgggtgcacacagcatgcattaacatgcataaatctcagaaaatagtaagttgggcaaaaaaaagcaagtggggaaatgatatgtctaatgccatttatatagttttaaaatatgcaaaacaaaatcatatatcatttgtgaatatatacacatatatcaaaacacatatgagaataaaatcaaaatcaggacagtgtttactttggggcatggaggaagagatgggcagggtggggttcatgggggcggtcttcagcaataactgtaatgatttactttacataaaaatgatctaaagcaggcagggtgtggcagctcatgcctgtaatcccagcattttgggaggctgaggcagaaggatcacttgaggctacgaattcaagattaccctgggcaacacagtgagaccttgtctctacaaaaacaaaaataataagattagacaggcacagtggcacacacttgtagtctcagctacttaggaggctgaggtgggaagatggcttaagcccaggaattccaggttgcagtgagctatgatggcaccattgcaccccagcctgggagacagagtgggaccctgtctcttaagaaaagaaaaaaaaaatgggccaggcgcggtgtctcatgcctgcaatcccagaactttgggaggctgaggtgggaggatcacttaaggtcaggaatttgagaccagcctggccaacatggtgagaccccatctctactaaaatacaaaaattagccagatatggtggtgcacacctgtaatcccagctactcgggaggctgaggcaggagaattgcttgaactcgggaggtgaaggttgcagtgagccgagatcgcgccattgtactccagactgggcaacacggtgagacattttctcaaaaaaaaaaaaaaaaaaaaaaaagatgtaaagtaaatgtggaaacatgttacatattttgctgagctgagtagttagttactgttttttacattattttctgtacattaattaactggaatttttgtttaaagactaccattcaggactcaactctgtcttccatgtagcaaattttgagagccttgtcaaaatcaaagccatgtcttagcattcatttgttggtaggaaaaaaaaaatcagtcattatattttaaagcatatggagatatttcctacttttctacttcccagagatacattatatgcataaataattgtacagtcttaaatgacaggaagggtttgaatgcaccaggcataattctctagtgtccctcatatacagggagatatgacactttcattccctggccagtcaccataaaattctgtctttaccagacactgagaggtgaaaaccctggtctcaggttttatacataaagcaaggcagtcagaaaaggcgggaatgagcctgacagatttggcggctgtctgtgcaaagacaagacagaaaggtcccatttatcatgaaaatctgctagttttcaactttgaaatagttgataattcatcttcttaggcatgagacattgggcaaggggtggctattgccacattcatttctgcctcagcgataatttctggggcagtgtgggctggctaatgttgttgatgggatgtgggggtgcaagggtggccagtatgccatgcctgtgaaggctgatcacccagcaatggaaatctttgagaggggccctttacttcccgaggagcctcctacaattcttggggacatgatgactatcaacagtgatgaaaattttgcgtaaataagatacaggcccacactcctagaagacaaagaaccatgtgaacaaaaccacataggtgaaccatattggtcccaccatagaaaattcttcaatgaggtggcacaggggagacagctcaggctatcaggagggatggaacaaggtggacacatgttctatttctttttctttttaaaaaaattaggtataactttcacagagtacacaaacaccacgtatgccatttgatcaacatccagacatgtgcacatcctgctgcctaacggaagacagagcacacttctggcatccctgaagccttcctcatgctctcgtccagtcaatgctctcctttccctctcaacaaactctcctgctgtctctcactgtagctagttgcctgctcataaacctgctctgaacattcgtctctcctactctctctcactgtagctagttgcctgcttcataaacttgctgtgaacattcgtctctcctgctctctctcactgtagcttgtttcctgctcataaacctgctgtgaacattcgtgcgcatgcctttggtggtcataaagtcctcatttctctagggtggaagctactcaagagtagaactgctggatcatggggtaggcatatgtttggctaactgcctaggagttttccaatgtggctgggctaacttccatttctaccagcacatatgaaagttccagatgctccacatccttaccaacacttggtatcatcactcttttaaattattattatgattagagacagggtcttactctgtcacctgggctggaatgcagtggtgcaatcatagctcactgcaaccttgaactccttggctcaactgatcctcctgtctcagcttcccgagtggctaggactacaggcacgtgccacacttggctaatttttaaattgttttgtagagatggggtctcgctgtgttgcccaggctgatctcaaactgctgagctcaagcagtcttcctgccacagcctcccagagtgctaggattacaggcacaagccatcgcacttggccaaagtcttttaagtactcaaaataaccaatcttttcttttatggttagtgcttttaatgttttgtttaagggatctttgcctaacccaaggtcataaacatattgtcttatattaaatcttccagaagctttattgccttattttttagagccataatccatctgggattaattttctaaaaatggagatataattcaaaaaccataaaatttaccttttggaagtgtacaattcagtggtttttaaggtctattcacaaggttgtacagctgtcagcattatctggtttcagaacacattatcaccccagaaagaaacccttacccattagcagccattcccatctccccctccctcagcctttgccaaccattaatccactttctgttttacggatttgcctgttctggacatttcacagaagcagagtcacacaataggtggctttttgtgtctggcttctttcacttaacatggtttcaaggctcttccatgttgtagcatgaatgggtactttattccttttaatggctgagtaatattcccttgtatggatagaccacattttgtttatcatcagctgatggacatttgagttgtttctactttctggctattataaatggtgctgctatgaatatttgtgtacaagcttttgtgtgaacacatttttttttcaattcttttttttttttttttttttgagacagagtctcaccctgtcacccagcctgaaggtacagtggcgcaatcttggctcactgcaatctctgcctcccaggttcaagtgattctcctgcctcagcttcccgagtagctggagttacaggtgcacaccaccatgtacagctaatttttgtatttttagtagaagtgggttttcaccatgttggccaggctggtctcgaactcctgacctcaggtgatctgcctgcctcagcctcccaaagtgctgggattacaggtgtgaaccatgcaccctgcctttttcaattcatttgggtatatatctaggagtataattgctgggccctgtggtaactctatgtaaatgccaaactgttttccaaaatggctgtaccgttttgcattaccaccagcaatgtatgagtgttctaatttcaccaaatcctctttggaattgatttttatatatggtgtgtggcaaaggtcaagatttttttccgatatggatatccaattacccagcactatttactgaaaagactctctttgaatgatgccactttggtcataaatcaagtatctacacatgtgtgggtctatccctcagctcagatctgttctgttggcctctttgtccctggggccagtgccacactgctctaattacaatactgctgcaataagtcttgatatcctgagctttaactcctccaattctgttctaagattattttggctgttgtcttctgtattttcatctaacttttaaaatcagcatatcaattcacacacacacactcacacacacacacacacacacacacccctgctgggattctactgtatctatagataaattgatacagtaattaggattgaattctatctatagattaattttggaataatttgccgctttttaaattgttatttattttttattgggcagcctcctcagccagagcaggctcagaaagactccatatgtatttctttttgagtctttcttatcaatgaacatgagctatcctgtcattttaaaggtctttatggattctgtgtcttaatattgtacagttttctgtgtagaagacttgtacatttttaatttactcctaggtatttaatgtttcctgatgttattgtaaatgatttcatttaggcctgggagccatggctcacgcctgtaatcgcaccactttgggaggctgaggagggtggagtttgagaccagcctgggagacacagggaggcagaccctatatctaccaaaaaaaaaaaaaaagagccagccaggcatggtagtacattcctgtagtcccagatacttgagaagttgaggcaggaggatggcttgagcccacgaattgagactgcagtgagctatgattgtgccactgtactcactccagcctgggcaatacagcaaaaaaaaaaagtatttcactcaaaaatgttcatttttaaattgtttgctgctggtatatagaaatatattttaaaacactttccttatagccagcaaccttgctaaatttatattctttttttttttttttttttgagacggagtctctatcactcaggctggagtgcagtggcgcaatctcagctcactgcaacctcccaggttcaagcagttctcccaggttcaagcaattctcctgcctcagcctctcgagcagctgggattacaggcgcaccacaccttgcccagctaatttttgtatttttagtagagacgggggtttcactgtgttggtcaggctggtctttaactcttgaccttgtgatccgcccgcctcggcctcccaaagtgttgggattaagggtgtaagccactgcacccggcctgctaaatttatattctaacagtttatctgtagatccttttagatttattactcataatcatattttccatgaaaaatgacagcttagtttcctcctttctaatctgtatatattttgtttcttttaaaaatattgtattttttgccttgttgtcctagccaggacttcaacaacaacgtgggatagaaatggtgacagcggacattctcctcttatccttaatctcaagggaaagaaaagctttcataggtgaacgcagtcataagaataattagtgaccctgcaaaacaggatgatctgaagatcataaactagcaagaagcatgatcaatattggtgtgggtcagttccacgtgcccttgcaattgctcgaggactctggggcccaaagataaagaactcactttatatagtactcagagaacaaagagcagaaaaatgtctcccatcccattttcagcataagtattaaagcaaaacctaatttaggatctggcacccttgtggcaaggcagacacagctgaggttgggctaaatcttagcttccaatgccatagcttttgttcaagtttggatggcagctgctccactactggaggcagcgtctgtttcagtctatgaacactgctgagttaacttgattctgatggttctgctgcctgagtgaacacgcctgcagctacatggctgcttgagtttcaaggcccagacatcagggcaagtacaggcccagccaaacctcaactcatgtgagaatcgttcaggggccacgttgccctgtagttcccacccacaccctccccattctgggcctgtcaagatccacactcccctactgcccacctgaactggcctggggtctgattaagtaaaactccagttccagcagatggttttctcatccacacctcaaaacggaagtaaacataggatgttggctgtgggtttgttaaaaaataataacaataatggatgtaagcactggatgaactgatatttttctgaagatattggctttgggtctgagcttactataatcattaaaagactctttttttttttgtggggcagatggtgtcttactctgttgcccaggcttcagtgcagcggcacgatcatagctcacttcagcctggattcaaagaatcctccgacttcagcctcctcctgagcagctgggactacaggtgtggaccgttttttagctaatgttttattttttttgagagatagggttgcactatgttgcccaggctggtcttgaactcctggcctctagtgatcctcccatctcagcctcccatcactgggatttattctttttttttttttttttttttgagatggagtctcactctgttgcccaggctggagagcagtggcgtgatctgagctcactgcaacctccacctccacctgcaagtgattctcctgtctcagcctcccaagtagctgggattacaggcatgcaccaccacgcctggctaattgttttttttttttttttttttttgagatggagtttcgctcttgttgcccaggctggagtacagtggtgtgatctcagctcactgcaacctccacctcctgggttgaagcaattctgcctcagcctcccgagtagctgggattacaggcgcccaccatcacgcccggctaattttttgtattattagtagagacagggttcaccatgttagccaggctggtctcgaactcctgacctcagatgatccgcctgcctgggcctcccaaagtgctaggattacagacgtgagccaccatgcccggccaatattccaagttttttgctagtttttttgtttgtttgtttttttgagatggagtctcactttgtcacccaggctggagtgcagtggtgtgatatcggctcactgcaacctccacctcccgggttcaagtgattctcctgcctcagcctccccagtagcctgcccccatgcccagctaatttttgtatttttagtagagatgggatttcaccatgttggccaggctgctctcaaattccttaccccaggtgatctgcctgcccaggcctcccgaaatgctggggttacagcgtgagccgctgtgcccggcccagccacttcttcttattggagtgtgagcactaggagcagggacctttccatggtgcttgctgtgttataccctgcacccagaacttagtaggcgttcaaacaaaatttttaaaaataaatggaagaacgaattaagaaaccttccgggtgagtcattatactgtccccaaacaggggacatcatcaattttattcctgccaagtagatctggactagaagaatatgtgcttgatctacaacaaaagctgccaggcaaatgcctgatactacgtccatctcacctgttctgctcccaccatgctaattggcttgcacttgaagaggtgggtgatgaatttgggaatgaaggagctgtggataaaaaagaagtgacaaattaggcttattctctcttgaggaaagaaatgcaaaaactttaaggttccacgtatctccatgaaaaaaccttttttaatgaagaatcgaagtggactccactgttgcccattatcttatttttcttctgagtgaagtcctggttttgtttagttacatgaggccctggcaggcccgggaaaaccggatcccatcctagactcccagtgaactctaactattctcagctcgtcagagcacagcattcctttggtgactgttgtttgtcctgagagggaatatgatcgaagctagcccaatcagactggatgtaagggctacaggcaccgcacctggctactttttaatttttttgtagaggcaggatttcgttatgctgcccaggctgggctcaaactcctggcttcaagcagtcctcctcccttgggctccggaagtgctgggattacaagcgtgagccactgggccaggcttccttgattcttcattctctgtctccagcctcatcctgctaagccctggcctccctatgcttcaacccaactgagccacttgcagatcccaggattctgggggctatttaatgcctacactgctccctcgcctggactgcctttcctagaaggggcttgtgggtcagtacacacgcacctctcagatcctgttcaacggcgtctctagaaagcctttcttctgctgccttcgccatactctacatggagtctgcaggcctccaccctcacatctaacctagttcattatgctcatttgcttacatgtctattttgcttcacctgactattaaggcaaacgaagatgggggccatgtttatcaggccaaaacatttaactctgggtctgagacataggagatgctcaagtgaatgcacattgagtaaatcataaacttttttttttttttgagacagagtctcgctctgtcacccaggctggagtacagtggcaccatcttggctcactgcaacctctgcctcctgggttcaagcaattctggtgcctcagcctcctgagtagctgggactacaggcacgcaccagcatacccagctaatttttgtatttttagtagagatagggtttcaccatgttggccaggctggtctcgaactcctggcctcaagtgatcctcttgcctcggccccacaaagcgctgggatgacaggcgtgagccaccgcgcccagccacctaccactttttgaatgtcagcttggtatcagcactttaccaggaagttaatatgtgacttctcattttatcttcccaaccactattatgagatttgtctcattatctccttgattgaagggaggaggatcagctcagtggatgagggaagttgcttgtggttcaactgcagtttcaaccaggctgtggattttgatgtctcaacaggaaaggctgctattgcttaagacagcaaacgaggtaaaaggaaacatctatggttttgcaggggtggggtagaaaggaagctgagggagaggaaactggagtccggagatcggatctggaggtggcttgtgatcaggaaggagagtaaacaaggggctatttggaaggaattcctcagtgctggaaaccagagccagacaagcaacatgaaactgaactcatgaccaatggcagctgtgcacacagcgctttgtaacctaagttgcttcacattagaacatgctccggactgggcatggcagctcatgcctataatcccagcactctgagaggcccaggcaggtggactgcttgagcccaggagtttgagaccagcctgggcaacatggcaaaatctcatctctacaaaaaatagaaaaatgagctaggccgggtggcgagcgcctgtaatcccagctattcaggaggctgaggtgggagaatcacctaagcccaggagatgggggctgcagtgagctgtggttgcaccactgcactccagcctgggtaacagagtgggaccctgtatcaaaaaaaaaaaaaaaaacctttggctgtgcccctgaactggctctctatactagtctacaggtggcgatggggggagtatgaggacctgacacacgtcctgtggggaaaaaaccaagcaatgtgctgggtaactgccaagggcttctctgggccatcagggcggtggtggctgctgcccttgaccagggaagggtctcctcacaagcccacctctgttaagcgggattttagcaggatgagaaggcaccatggatgaaaacagaaaaccacttcctagatcccaggctgaatgattacagatgtgagggggggcatccaattcccagcgcactcaacctgggcttagcaatgaaactcaagggctctgagagaatgtgaggctgatgctgggagatgctgggactggctaagtcaaccgactcctccttcactttaacgtaagctcaatcatatgactgagctgggagacgccgggactggctaagtcaacggactcctccttcgctttaatgtaagctcaatcatatgactgagcagggagacgccgggactggctaagtcaacagactcctccttcactttaatgtaagctcaatcatatgactgagctgggagacgctgggactggctaagtcaacggactcctccttcactttaacgtaagctcaatgagaccccggagcagccaccctggagattttgagtcacagtaaatttttacagagacactgcttctaccagcagttatggggagcgtcacgatgtgatttatcagcaacatttctaacacactaatgagcacccagagagtgagggaatttcacctcctggtccatctgccatctgcaaacattaatgcctccctggagagtccactctatcctttcttgacaaactagaaagtaaagctgacaccacaagccgctccataattgttagtcctgaggggttcatttgtgaggtacagggaaactgggagagattgggggaagacagaaacttggagtcctgaatcaccagctggggcctggatgggaacaacccaaatacagtagcttggcctgggctgaccctcctgaagcccttccctgagaagtctgccaaaatgcttgcttgataactggtcagaggagacactgaccctcaccaccacctggtatcacggaaaatggtgctaagccagatggtgatcggcaaagaactaaactatttcctcgcttcaaaactcagggcagaaatggccacacacaagacacagcaggaagacacacggctcagggtgcactcacctgccttggccagggagctccctggcttgtgcatcccaatttctagtgccttcctcggaccaagagtgtgtccaagtatgaatagataaattctagcagccatggtaaaaaataccagggggagggaggacaagaaggctcaaaagaaacagaaccgatggctcctacccttaagaggcatttattaagccagtcagagaaacaaaatgcatatatgaaatccctgaaaaagaattttaattatccaatcctgggcaaggagagcttatgcctgcacagttcaaaacaacagtaggccccattcatttttgtttgccttgacgtggctggcaattgtactgctgttactgttgcctatgactttaagtagcagatttagttttatgattatgcttcttttgtgtacaaattaaaatcagtactgcaggcaccagaacaaaccgcagctggatggtggggacactcaaattgtgaggatgctggtgggaagtatggttttaaaaacaacccagttgagtatgacactgaaatggcggccacacgtcactgtacatttgtccaaaccgagggaatgtccagcgcgacgtcagagtccgggtgataatgacgtgttgatgcaggttcatccactgtaacgaatgtgccactttgtgtgtggggaggtgtcggtaatgggaagactgtgcatgttgggggggtcaggtacacgggaaatctctgtgcttgctgcttaatttggctgtgaacctgaaactgttctaaaacataaagtctattaaaaagaacaagaacccagagatgagcacgccccaggacttactttgcaaatttaacgcagaactgagtgaagtacttgcgtgtggaagccaggttgtcacggatgatggggacgttctgcttgatgtgcagaatgacagaggtgacgtaggggctctggtcaccaacgtgctccacgttctgccactgcatctgaaagggagaaaggatgaggcgttgaatccctcgcaggagaacggtgtcgcctgttactggggaagggaggggctggagtggaagtcaggtcacagctttggtatcccaggaatcaggcccttttgtcctggggagtttcttattcgttctgtagggactgatactcaggacaaatgcgagtgtgcccagcggacccgacagtgaggtgtgacccagaccctttccttttcctgccttgtccccgacctgcctgaaacagccttcccttctcagctaagctacccactcgtaaaggatcctgttctcctgccgagtgccccacagcaggggactgcagcagaacggggagggacaccgactcccaagctgaccggcagcctgggagatgagagaggtggctggactaagtgacatgcaacctggaggggaattcacagacacctttctctccagtcaactgggaggagtttgggattctttaacacagaaaactagaaatgatatgacacgtggggatgttgcttcaaaataatatgaagttaccgggaagaggtgcagatgaaataagatcgtgaagctgagtgacaggtacatagaggctgaccacactgtttcctctacttttgaatatattcaaaaatttccataataaaacacttgaagaggtatgcgtgtagaatcttacactcctaaaacctttgggattatgtcaggatttcaataaggggaagggaaagagaatctctggcaaacactagggtggaccagagggtaagatggagacgtggggaacaggccaggagccaggcgcaggggagagaacattgctgagagcaccgaggtggtccctgaacaagctgtgaacaaaagtgacagacctgcttcaacctgagccctaacgacaggctctggaagacacctatagcaaactggcgggattcttggactacgtggcacttggcaacattgagtcctgggaacagaaggaggcaatgctgcagtgtgccatcccccaagggtgcatgcaggagatgggtgcagcaccagctcctagcctgccccgggctggcagggaagggcattctaatcccgaagagtgggaatggtctggagggttctgctgagtcagcctttcacagtggagctggacggtctggagggctctgctgagtcagcctctcacaatggagctggatggtctgttaaagagatcctaagccaaacacaaaccatataatatgttcatagaaggaagtcagtagttctgaggccctgatgtctctggcaagaaaacactatttttacagagctcttggggaaaggaaaaaatcaatactgagagagcttgtttaaaagaatcacatcgtacgtggatgattctccagctgtgggaagctcaaatgactcctaatgttttttcaaatcagcggatatttgtattctaaaagctttagggatgtgtacacacagaaccacagaaaagcaggaagggacctccatcttcatttcacagataagaaagccaaggcccagaaacatgaagagtcttatgcaaggtttcataaccaggctccacacaggaaaaagaactctaatttattactgggaaaaaacagaaacaaacaatgaagaaacagtagaaaggtctaatatgaagtgacttaacattctaatgctttggttatgtgaaatgttttcctcattatcttttatcttacgcaagaggcttctttttccatttgattttgaagatttgacccatccaaacaatgagcatcctgggtgattttaaatgagctcatagggtgaggccaaaattgacaggtgctgtcagcatttcctgggctctgcagcaggactcggagcagaatgttctgggtagacacagcgaactgggagggcttgatgcccccaaagccaatcatgtccatagcaatgactgttactttccaagctggcagctttgtatatttcaaaatctcaaaacggtttatcaacaataatctaaacatgacagccctccatgaaagaaggtggcgacgtgctctgtcaccagttacaaagcagctctgaagcaagaccaagcaggggcctgggatttcttcaacttcccactggttattccgcatgctcgtcaccgaactcctcttgatgatcactggccaagtcagtatgtgcccacatttggaatatatgtgaaaagagctgatttgctttaatactctggtcagtcatgactccattggtcaagctaaaagaagtattagcaaaggccaagtggattcatgattttaaacttaagtcagcttagtcaactaagaaagtgatttaaagtactagaaaacaataaaaggtgaccttacctttagtattttttaaaaatgtggcacacgcctatagtctcagctaccagggaggctgaggcaggagggtcactggagcccagaaggttggggctgcagggagctgtgattgtaccactgcactccagcctcagatggctgatgcttgccatcatcccccatgggtgactgaaggtttgggtcacaacctgaactgcccaggatagctacattaagaccgaacttcgcaggtccctttgcatggccctaaacatacgtcgtctcatttactattcatacatgatctcactaagttctcacaacaaccttatagatgaggaaattcaaaaagctcaaagagatttggtatcttgcacaaaatttcacagctgggacaaccacgtctatctaaagcccaaaccaggtctatctaaagcccaaaccaagtctatctaaagcccaaacccggtctatctaaagcccaaccaggtctatctaaagcccaaaccccacaacaaggtgcttgctagacaacttcccccccgacccgcccccgccaccctgcccaaaaaaagaataaaagcacttaactaggccttcgttaaaggtaaggcctgtttctcaaggagacgctaatgaaacatagtgatcaagcaaaggactctttatttttcatttttttttgagacagagtctctgctgcccaggctggagtgcagtggtacaatcatagttcactgcagccttgacttcctgggctccagcaatcctcccagctctgcctcccaagtagctgggaccacaggtgtacactaccatgctcagctaattaaaaaaatatatttttttcttttttactttttgtagagacaggggtctcaccgtgttgcccagactggtcttgaactcctgggttcaagcaatcctcctgcctcagcctcccaaagtgctgggattacaggtgtgagctaccacgcctggcccaaagaactctttcaaaaaaggaaacaaacagtaccttgcattggaagaacaaacatcatgaaaagccatcagtagaaatgagacctcaacttttccaggtaaacttttcatttgacatttagaagttacccctctacacttaaaattgtttcttgttgtgctttttgttttgggggcttgggtagagttgaatacagatggggttcaactggtactactatctaaatgagacacagtttgaagacagtaagaatgatgagtgcctccgggacctagtttaaccaccacaagaagagactgcagggcccagagtgtccccagagcccagcttctgcggcctgggcaggaagtatgtgctctgactgacgctccacagtggggctggggggtcagcactctttctagagagagtctactgtagcaggaactttgaccagagaacagcgctccacaactagcttcagtggatcttgttttttcctattgctataggaagcttggaaagaggtttcttgaaaatgtgaatacttaaattcctacttcttcactggattagagagacacagagcatagactcagacagctgggctctgggaacatttcaggcaactgaagtctcataactgaggctgccggggtgttggcctcaagctgtagactttactcaggcacacacgtacacgctcactctcactctgatgcctggtggggctttcactcccgcagcatctgctatatttataggtaccttcggcaagtgcagcagggcactgagcatcaggtggagaccaaagagatgaaggaatgtttatcaaccgcctgccacacactgaaggaatgtttgtcaagcatctaccatgcaccaggggctgaaggaatgtttatcaagcacctactacgcactgaaggaatgtttatcaagcacctaccatgcaccaggcactgaaggaacgtttatcaagcacctaccatgcaccaggggctgaaagaatgtttatcaagcacctactacgcactgaaggaatgtttatcaagcacctaccacgcactgaaggaatgtttatcaagcacctaccacgcaccaggtgctgaaggaacgtttatcaagcaccgactacgcactgaaggaatgtttatcaaggacctaccacgcaccgggcgctgaaggaatgtttatcaagcacctaccacgcaccaggggctgaaggaatgtttatcaagcaccgactacgcactgaaggaatgtttatcaaggacctaccacgcaccgggcgctgaaggaacgtttatcaagcacctaccacgcactgaaggaacgtttatcaaggacctaccacgcaccaggggctgaaggaatgtttatcaagcacgtactacgcactgaaggaatgtttatcaagcacctaccacgcactgaaggaacgtttatcaagcacctactacgcaccaggcgctgaaggaatgtttatcaagcacctaccatgcaccaggggctgaaggaacgtttatcaagcacctaccacgcaccaggggctgaaggaatgtttatcaagcacctaccacgcactgaaggaacgtttctcaagcacctactacgcactgggcgctgaaggaacgtttatcaagcacctaccacgtaacaggtgctgtgcctgacattttcacatgaccttgctgcctgatgaatgaatcatgtagtgaaagaggtattattactcctctttgtgagtaataataaatgaggatgaaacaggattgaggacagcgagtgacctgcctaaggaagcgtaactgctaagttagcaggaaaggtcattaagatggtacttaagatgctgaaattgagtcagccagtctgacttctgacactgtgcaaccttctaaaggggtgaccgggacaagtcatctaatttctctgagcctcagtattctcgtctataaaattgggatgatggtaacatctataatctattactgaaagataacgcatggaatgctcttaacacagtgtctcgcagcacgtataaattccacagtaaattttagctactgttataattttaagaatacttgcactatcactaaaaatcactaaatttcgataactgataattatcaattaattcagatatgtatcaattaattgaaattatggtgatttaagttttattctttttttcaaaaaaatctgaccgggcgcgatggcaacatgcctgtaatcccagcagtttgggaggccaaggcaggtggatcacttgaggccaggaattcgagaccagcctggccaacactgtgaaaccccgtctctaccaaaaatacaaaattagccgggtgtggtggcaggcacctgcaatcccagctacttgggaggctgaggcaggagaatcacttgaacctgggaggcggaggttgccataagcacaaatcacgccactgcactccagcctgccggatagagcgagactctgtcaaaaaaaaaaaaaaaaaatctgcatttttctaaaatggaagtgatttagttttgtcataatgggaaaaatcttttttatgaaaaagaaagctgtgtcttgattctaggtagaacttgacagtttcttagtcatggctttctgtgggccttctgaaacagatgtgcattttaatgactgaggaaaatgaaaatgagaacagacttgtcttgattcaacgtagaagtgaacttgaggatttcttagctgtggctttccatggtccttctgaaacagatctgcattttaatgactgaggaaaatgagaacagacttgagaactcttctacctgtttcaaagtgtctttgggggattataacgcagcctcctaaatgggtacatgttcacaatcctgaaacctaatataaattatgtgccagacggtaagaaaatttaatttattcagtttctgttttttcctaaaactaccattaataggcaaaacactaggtgtgtttgcttctgaacagagacttggatttatttacctgagtgatgtgagcagccctaggaaaaggcacggagagaggcggggaccatgagaccaacagcccctgctagggagcccacggctctctatcctacgtacaggggcataaccagacatactcatttctaaggatttgtaggatttaaatctaaaagatagaatcctttgtatttccaccaaaacactccaaataactactttttccagaatcaggagaactagttttacttctagcttcactattataagttatatggctttgggcataatatgaagaagagaaggaaggaaggaaggaaggaaggaaggaagggagggagggagggagggagggagggagggagggaaggagggaaggagggagggaaggaggggagtttggagggagggaagggagtctggagggaggggaggggacaggggaagggagggagagaggaaagaaggaaggaagggagagtgggaggaagggaggaacggagagagggaggaagggagggagggagggagtgaggaaggcagggagggagggagggaggaagggaggaaggaaggaaagaagataccagaaggaaagttcattagttttcagggaaaaatattcaacgcagattggaatatgtgggttggctgttcaacacatcttctccactgtagaaaagtcctggtgtcagatcaagaaaagctggagatgaatatacaccatgatgatggtgaatgcttgaagaactcataatcatatcagcatgaacactcgtgtggacccaccaggactgggcacatgctgacagaaatgtatcaactaattgaaattatggtgatttaaattttattccttttttcaaaaacatctggtcgggcacgatggcaacacgcttgcaatcccagcagtttaggaggccgaggctcttccacttttaggcaggttacttaagctgattttgcctcagttgccacatttgccaaaaagacttactcactctctctgtatggcatgccacaatcctgcataaagaggcactgtggtggcgtgatcacagctcactgcaacctctgcctctcaggctcaagtgaccttcccaccttagcctcccaagtagctaaaagatctggagcaggtgatttaatgtctctgtttcagcttctttatctgtgaaaaggggaaatagcatagccatctgatgaatttattgttagaatgaaattaattgggttccaattcctggtaagtgctcagtaaatagtaacttattatcaactcatacaggttatctaagaaaataagcaatatggaggccaggcacagtggctcacacctgtaattccagcattttgggaggccgaggtgggaggatcactagagctcaggagtttgagactggcctgggcaacatagcaagacctcatctctactaaaaatcaagaaaattagccaggtgtggtggtgtgcgccagtagtaccagctatttgggaggctagggtgagaggatcactggaacccaggaggtcaaggctgcagtaagctatgattatgccaccgcacccaagcctgggcaacagagtgaagaaatttttttatgaaagaaagaaaataacactatgggaaggaaacgtggtctagaagttaattttgctgtaactcatcagcaacactactggaatctcaaagtcagagtttcagagggaccacctgactttcatcacattttcctcccccttcttcggcctggcctgcagaaggctgcacctgcatgtgaatctagcaaactaccgctctgcatttccctctccttgtctagcagcaggactcagggccacacccccgcgggctcgtattccttcattcccacatctcttcaatcggctccaggatgccacctgctgaagtcagaagcccttctgctatcaggtgccattgaggagcatcactccatcctcaacagcaccagctatggacctaaaggtttcagggattctatgaccccaccgtctctcacaaagttgtccaagtttcctactctacatctaccagctccacctggctacctctgctcagtagagttatctatgtctcacttgtttaccaatctttggtcaaaagtgtgtttgtggtcctttggttctttctctcccactccctggctccctctttaccttcaaagtcattcagggaatactacagttaagcaagtactgtgccatgccacgggtttccaaaatgaataagacacagccctcaagttgttcaaagtttaatagggaagacaaagacataaaaatgattacataacaaagcagaaaggtagtctaggtactatggtgtcttgaaagagaaataaatatgctctggctgaggcaagaaatgctgacattgtaagggacctagaagagccaaaacagtgttgaaaaagaacaaagttggaagactcatacttcttgatttcaaagattactacaaagctattatagccaaacagtgtggtactggcctgagggtggacatacagatagatggaatagaactgagagtccagaaataatcccacacatctatggttaactgattttttacgagggtatcaagatcatccaatgtgaaaagaatagtcgtttcaacaaatagtgctgggaaagctgagtatcctttcagcaaaagaatgctgctgaatctttgcctcacaccatatgcaaaaattaactcgaaatggattgaagacctacatttttttcctttttttcttttttgtgaagacctaaatttcttagaagaaaccacagagtaaatctttatgattctggatcaggcaatggtatcttagatatctcacacacacacacacacacacacacacacacacacacacacacacacgatataccaacttcagaaaatcaaggacattatcaagaaagtgaaaaggcaacccacccacagaatgggagagaatatttacaaatttcatatctgataaggggtctagtatccagatataaaaagaacttttacaattcaacaacagaaagacaacccaattttaaaatgggcaaaacatttaattctcatttcttcaaagagaatatacaaatcgccagtagcatctgagaaggtgatcaacatattagtcatgcaaggaatgcaaactgtaatcacaatgagataccacttcacacccacgaaaatggctataattaaaaaaggaaaacaagtgtgggagaagatgtggagaaactggattccttacactttgctgtggaaaggtacaacggcacagtcacttcagaaaacagtgtggcactttctcaaaatgttaaacataaattgaccatacggctctttcagttccattccttaggtcccttagatccttttttttttttttttttttttgagacagagtctccctctgtcacccaggctggagtgcagtggtgcaatcttggctcactgcaatctccacctcccaggttcaagccattctcctgtctcagcctcccaagtagctgggattacaggcacgcacgctaccacacccggctaatttttgtatttttattagagacagggtttcgccatgttggccaggctggtcttgaactcctgacctcaggtgatctgcccacctcggcctcccaacgtgctgggattacgggcatgagccaccacgcctggcctttaggtacatattgaagagaactgaaaacatgttcacacgaaaaattgtacatgaatgttcacagcattattcaaaattagaaagtagaaataactcaaacgtccaatagacgaatgaataaacaaaatgtggtctatccatatgatggaatgttactcagccacaaaaaggaatggagtgctgacacatgccccaccatgcacatgccctgaaaacactacgctaagtgaagaaagccaagcacaagatgtcccacatgccatatgattctaggtatgcaaaatgtcaggaggggcaaatctatagagacagaaagtaggctaatggttgtcaggggaatgtagaatgactgctgagaggtacggggtttctttttggggtaatgaagatgttctggaattagatggtggtggtggtttcatgacattgtggatatactaaaaacaactaaattgtacactttatttatttatttataaaatagagtctcactctgtcacccaggctggagtgcagtgctgcaatcttggctcactacaacctcggcctcccaggttcaagagattctcctacctcagcctcctgagtagctgggactataggtgtgtgccatcatgtccagcaaattttttgtgtttttaatagagacagggtcccaccatgctggcctcgaactcctaacctcagatgatttgcactcctcagcctcccaaaggagtgagccactgctcctggccaactgtatactttaaaagggtgaattctgtggtatatgaattatacctcaggtttttaaatggggacagacatttgaacttgatcttaaaggacgtgctccttgggcagacgatagcaggaagaaaattctgggcagaaagaataaaatgagaaaaggcatggaagccgcaaaagagcaatatgcattcagggaagtaaacatggctgcgactggagaacagggcacatactccggagtgagcggcagaaactgacctagcagtggagtaaagagatagataatgaaagctctatatgccaaccaaggaagaggccatgggatgccttccatgagaatgaggtctcccaggaaaatgacttaaccaagttgccaggctcaatccctcttgtcaaggaagtctccttccgtcaactcagaatcatccaatgactacactccactttggccagccaacagtccttctggaatcatccaatgactacactccactttggccagccaacagtccttctggaaatatccaacgactacactccactttggccagccaacagtccttctggaatcatccaacaactacactccactttggccagccaacagtccttctggaatcatccaacgactacactccactttggccagccaacagtccttctggaaatatccaacgactacactccactttggccagccaacagtccttctgacatttataagatacacttatttacagtattggttgttctcagttttcttcccagcagggtatagactccttgaggacagtctcgtttccaatcttaactctgtcagtccaagtacaggagtagcctgaggagcccctgggatgttgaatgagattggcagtttgaaccaagctctttagcttccctaacctctctttactcatgttttcaccctgtttgaactgccctactaatcacaaactcattcagaatttcgccctcatctgtttcaaacaccacttccttacgagggccttctttgcctccccacctggatatgaactcctccctctttaaaaagggtgtattttgtacttttcttatggcactgatttcctcatctcttatattaaagttactgggtattgctgtcatcttacacatctcttgccctcagctactggaatctaaacaccttagccaagggtttatgcctttctgagccttgcagctcccagcactgtgctgggcagggtctgaactgaactgtttaaccagcagcaaaaatgatagaatcagagacagaaataaccattatcacaaaagtttttttaaatcctagaagaaactacacaaaacaggatgcaggcatcaagaacacagaatgtgtgttgaatcaatttgtgaccacttggcttgtttatttccatcacatggattttattttgctagaactccagaagactcagacaaaaagtaatggcctcccagctgctgcgttcccaagtctgtggttttcctatgatataaacaaaggactctggaggcacggtctctgttcgtatttgctggtgtgggcacggggcagaagtggagggtgggacggggcagggtttgagggaaatccaccgaacgaaccgacagttcgtataagcaacacttgcagtgttaaaccccttccaaccgtgattttattgaaaaaaaaaaatcccactcttcctttggtgaatgtgaaaattctttcggcagctgcattccgatctgaagtgtgtggcagttcaggagagatggcagctggcacagatcccactcaggatgtagagaatgcttaccagcagcgaggggatcatgagagctggcaaaacgaatcctctaagcagatggactggcctcactttgcctgctcagagtgttctcctgtgaatgctgagaatactggaagtacccatcagcaccggactgctgaaaagatcagctttttgaataaaactgtgacatcagctattttaggacttgccacttcagttcataaaaccctaaagcctacattttggttttaatcttatttttgttaaatatttacaatctactgcaaaaccaaattcagaccaaatgtctgcttacacaaccttgtgacatggtcattcctcctgacaagagggagagggaactaacatttaatgagcatttactatgtgcctggcactagacccgcccgttccatgtttcatcctcacagcaatgctgggaggcagagatccacagttcacttggggtatgtgggcccagatgatgtcacgttggcccagacaggtgaatcatttgctcaacaccccaaaggaaaccctggaggagttaggtctgtctgactctaaagttagtgttcctcccactgccctctggtactggccagtataacctagataaattgtttctccagaatttgctacaagagcctatgactctagagcagacattggcaaactttttctgtaaagggccagacagtaaatatttaatttttttagctttgtgggctagtctctgttgcaatggctcaattctaccactatattgcaaaaaggcagccatagataatacataaataaaggaacatggctgtattccaataaaactttattttcaaatacaagcagtgggccagatctggttcccaggctctagtttgccaacccctgctctacaaagttctagagttgcagctgcatgttacttgggtttagcataacaaaggcccatttccaacttaattaacaaaaatgaatctcccatattcaagactacaagagagataaaagagggggtgaaagacatggtctgtgcacttacggaattgacattcatttgggaaaaaaaggcataggcacataaaagtcaaaaataggaagatgaggtagcgctcagtaagtgccaaaggaggagacttgagggccaagggctgactgatgggccaccacgatattagaaaaccagagttcacaacctgatcaaatactcttacattggcaccagagctcagaaggagttggaaaaacctctcagtgggcaagaatgaagaatgagtcagaagttactactttaagcactaatgaaaacacccattctggtgagaccacaccaaggtttttagcatgtgtcagatactaatcaaagataatacgtaaataaaggacatggctgattggtttttaattaacaaaaatgaatctcccatattcaagactacatgagagataaaagaggggtgaaagacatggtctgtgcacttacggaattgacattcatttgggaaaaaaaggcataggcacataaaagccaaaaataggaacatgagaggaacatgaggtagcgctcagtaattaaaaatgatccatctcagctgggcactgtggctcatgcctgtaatcccagcacttggggaggactcggtgggaagactgcttgacgccaggagttcaggaccagcctgggcaacatagcaagactcttagctctacaaaaaatttaaaaagtagttggacacagtggcatgcacctgtggtctcagctacttgggaggctgaggcaggaggactgatgagcccagagggtcaaggctgcagggagtcatggtggcaccactgcactccagcctgagtgacagagagagaccctgtctctaaaaaaatataaataaaccacagacaacatctcctttagactcatcaaacacatttacttcgtctcttttttttttgccatcctccaatactgtgatgctctgtctcattctaaaaggacaagcaactgaactgacgcaggtgcgacactaactgagtgctttcaggaactccggggcctctccattctcctcagctgatcctttacgctccgatgagcctggagaagctacagacaagggccagtagaagccaccttgggctgctctcgttagtttgtaggatgccatttcccaagaccttaccttgctcatggcagtcagggcaggatcacaggcagcatccagatcctgaaccagcagctgaatactgctggagatgacgctgcaaatcaaacaaatcactgtggtcaccctttcaaacaacggccgtctgaatgactgacactcaggcccctgtgtaaaaatcagattcatcatttcactggcaaagtttgagctttaattaatgacagcggaggaacagcttggctctttcttcatgtcctggttttatctgggtgtgtcctcacccagtcaggatatagaatcccacggtcagtctccctaatcaccaccccagtatccctgttcacatcttcctcccaaagaacctgcttcccaaaaatgtttaagtcagaactgaagaaaataaaaagctaagaaaagtggaggaaataaactaagaagagaattttgattcttcgtcaataagtggttgatgtgaaagctgagaattttgattcttcgtcaataagtggttgatgtgaaagctgagaattttgattcttcgtcaataagtggttgatgtgaaagctgaggcctggcccatgcctgtctcatttaatggcagtggaacagaaactgaccacaacaaaaataccacaaggtcctaacagggaaagaagactttactgttagaacttcctggacggacctcccctgccactcccacactcttattccctcggtggctaaatttaagccatttatactttatactttaaaacactgaaggtaggcctggccttctgtgggtttaggtgggggcagatcagcaatggccaagggagaatgtcttctctgtggttattcttcacagtgagacaatgaagaccccataagctaaaagagcaactgcatctgaggaggtacaatggcagcccagttctgaagcttcttcttagtggccagtagggactcattctgacccaacagaaacctcttaggttctgtagtgactaaagccaacagcctgaggcacgctgctgtgtagtggagaaagggcaggcagcgagcaagtgtgtacaaggtatatacgtgccgcacgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagtgtgtacaaggtatatacgtgccacatgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagcgtgtgcagggtacatacgtgctgcacgctgctgtgtagtggagaaagggcaggcagccagtaagtgtgtgcagggtacatacgtgctgaacgtgtccatctctccagtcagattgattcgttcaatcagacttacatccactttttctttgagtttttcttctagctgttgaaaaacagaagaaatggatgcacggttaatgattatccaaagaagtaccatcacaataatagttaacatttactgcgtttgatgattcaggcataattccatacactttttttttttttttttttgagactcgctcttgttgcctaggctggagtgcagtggtgcgacctcggctcactgcatcctctgcctcctgggttcaagcaattctcctgcctcagcctcccgagtagctgggactacaggcgtgcgctaccacacccggctaattttatatttttagtagagatggggtttcaccatgttggtcaggccggtctcaaactcccaacctcaggtgacctgcctgccttggcctcccaaagtgctgagattacaagtgtgagccactgtgcctggccaatcttacaaccttatgaggaagattctattattatcatcgtcattttacagatcagaaaaatagagggggggcctacccaagatagaagtggtagggccaggaatcaaacttcctccagagcctgtgccctttagcactgtgcagtacttgtttcttaccacacatcaataattcacatcaactcattctgaaaagacgctgattttaagatactccctgccccatgaactacagacttgcccacccacaatggaaacctttggtgttgagtagcagtaaaaccagctaaaatagtcagtgaatgctactacgggccaagcacctcattaaggcattggggatacagtggtaaacaaaagaaatgtggtccctgccatcatcagccgacagccggggacagaaacactcaacacgctcctggcgctcaaagaaaaataacgggaccaagacttgtaaatacttggagatatccctgggagttgattaatctagcactgtaaacctattacacaaactctaagaatagctaatgttttggcctttttttttgagacggagtttcactcttgttgcccaggctggagtgcaatggtacgatcttggctcactgcaacctctgcctccagggtttaagtgattctcctgcctcagcctcccgagtagctgggactacaggcgtgcatcaccatgtccggctaatttcgtatttttagtagagacggggtttcaccatatcagccaggatggtcttgaactcctgacctcaggtgatccacccacctccgtgtcccaaagcactgagtagctgggactacagctgggattacaggtgtgagccaccgtgccaggacagaataaccaatgttttgtcttaaatttgaaaatgctgttggggtgcataaattagcataaactttttggaaggcaatttattcaaaaagcaaaactttaaatacacatattgcctaaaccagcaatttcacaactagaaatgcatttcaatgaaataaggagaataacatacaaagatatgcaagtattttttgcagcattcattaattcaaccaatatttaatgagagcccgctttgttcaggctgtgtaacagaataagagagttatttagtgaacaaaacagatcaatactgttctcataaagctggaaacaatctacatgtgtatttacaaaggataaaacaaattatggcacaggcttatcatgcttaaactcttcagcagcctcttcctatgacaccgaaaataaaatccaaattcctaaccatgaattgggtcctgcccagctttctggccccgtcttgccactttccaccttgcctgctaggcttcagttacactggccttttaaatttctgggagacaccagggtccttcgccctcaggaccttcatacttcacacttccttattcctctccctgaaacatggcctgctcagccctgctgacccactgccttgctttgccgcacccccactttctaagccctccaggctcctcactttttggccacatgttggccatgctggtctcaaactcctgacctcgtgatctacccgcctcagcctcccaaagtgctgggattacagacgtgagccaccacgcccggccctaatttttgtatttttagtagagacgggggttttactatgttggccaggctggtctcgaactcctgacctcaggtgatccacccacctcggcctcccaaagtgctgggattacaggcgtgagcccctgcactcggccagagtatcattctttatacctcctaatggaataatggatctgggctttgagcatcagaggctgctgacatcacacaaagagcaaccaaacattatgtatcttgatgacagacgtacaaaacatcattatgatgtagttttctgtaaaaaagaatctgaatcagctcaggcttctacatctaactaccaatttatgggaaatacgagacaaagtaaaatgtccattaatactcgtgggtgcaatcaggaaaatccaaaacttgggaaaatctacagggcaaacaacacagtttctttaagaaaagattgcagagggggcaaagggaaatggaagaagaaaccagagacttaataatctgagcaggctggacccagtggctcacccggtaatcccaactctttgggggctgaggcaagaagatcacttgagcccaggagctcaagaccagcctgagcaacacagtgagaccctatctctacaaaaaataaaaaaatactggccaggcatggtggcaggtgcctgaagtcccagtgtagtcccagccacttgggaggctgagggtaggatcgctttcgttccaggtttcagtgagctgtgatcaaaccaccgcactccagcctgggcaacagattgagaccccatattaaacaaaaagaatctgagcaacaaggaattggaaaataaaatttaaaagcaacaccaataatacatcattattggttcattaattgtaacaaatatttcatatcaatgttaataatatgggaaactgggtaagtggtatatgggaaccatacaaacgatctttgcaatttttctgtaaatgtaaaagtatccttaaaagtgtagtttatgttttttaaaaactatttacaatagcaattcataacatcgttctgtggtttgattgtgttctccaaagtttatgggttataagcttaatccctgaagccacagtgttgagaggtatgaggtcatgagggctctggcatcatcatgggttaatgccattatctcaggagtgggctcttttattccttcaagagatctttattaagcacttattacgtaccaggcattgtatttggtgctaatgaacagaggtgaacaaagtagactttctggcatgtaacttaaaactaatgggggcgccagataataaggaagtaagccagccgagacgtaacttcggttttgtggtgttaggaaataaatttggcagtgctggaataagggagctacctactgaaggggggtggccaggagggcctctctgctgaaggggggtggccaggaggggctctctgaggaggtgatactgaagcggggacctgaggcttggggaatgagactgccaagtgagaagccaccacacccggctaatttttgtattcttttagtagagacggggttttgccatgttgacgagactggtcttaaactcctgacctcaagtgatccaccctcctcagcctcccaaagtgctgggattataggcatgagccaccgcgcccccactcttctggaagctctgaggaaaaaactatttacacctctcttctagctttgggtgtttgctggcaatccttgatgttccttggctcatagaagtctgactccagcctctgcctccttctcacggccttcttccctgtatctctgtgtgttcaatctctctctcctttctaaggacaacagtcattagataaggccccccaccaatcctaaatccaggaccatctcatcttgagatacttaattacatttaccaagataaagtcacatttacatgtcccaaggcctaggacttggacatattttggggttggggggacacttcaacccactatatctccctgggtcctcttgagatgacactaatagtctttgatatttttcttgctttttgtgtaacatgatgttctgattcatcttgtagatttcctgcccttgacctggaattagtcatttctccaggaatctctggtttcttttagtggaaaattgtatttagagatcacaataaaggtgctaagaatgtattacttttgtaatcaataaaaacaattttcactaaataaaaaataattggccacttgtatcatcagtcatcaaaatggtcttcaacttatttctagaacttctaagagtctgttctagaaaactaatgcaaaacatttaagatgctatattcagaaagacattctttgtaaggattatctttttttttttttttttttttagagacagggtctcactctgtcacccaggctggagtgcagtggtgtgatcatagctcactgcagctttgacctcccaggctcaagcgatcctccaacctcagcttcccaagtagctgagaccacaggcatgtaccaccacactcaactaacttttaaattttttgtaaagaccaggtctcactatgttacccaggctggtcttggactattggcctcaagcgatccttccaccttggcttcccaatatgctaggattacaggcgtgagccactgtaccctgccaggattatctataaaagcaaaattttggctgggcatggtggctcacgcctataatcccagcactttggaaggccaaggtgagtggatcacgaggtcaggagattgagaccatcctggctaacacagtgaaaccccgtctctactaaaaatacaaaaaattagctgtgtgtggtagcgggtgcctgtagtcccagctactcacagtggctcacgtctgtaatcccagcactttgggaggccaagacgggcagatcacaagatcaggagatcgagactatcctggctaacacagtgaaacccggcctctactaaaaataaaaaaaaattagccaggcgtggtgatgggaacccgtagtcccagctactcgcgaggctgaggcaggagaatggcgagaacccggcagggggagcttgcagtgagccgagatcgtgccactgcactccagcctgggtgacagagagagactctgtttcaaaaaaaaagcaaaatttgaagcactataaacaacgatcagggatgcttgctaaataagttatggtacaaggccgggcacaggggctcacacctgtaatcccagcactttgggaggccaaggcaggtggatcacaaggtcaagagttggagatcagcctggccaagatggtgaaaccccatctctactaaaaaaaaaaaaaaaatacaaaaattagccggggatggtgatgggcatctataatcccagctactcaggaggctgaggcagaagaattgcttgaacctgggaggtggaggctgcaatgagccaagatcatggccactgcactccagcctggaagacagagcaagactctgtctcaaaataaataaataaataaataatttatggtatagtcccttaaagagaaatattatgtggccataaacaatgatagtaataatgaccctgtaatgatagttatgattattactatcattataatgacaggagaaatgctaatgctatgtatgacactaacaataaaaggatataacagtgaattaagattgtaacattcaaaactatgtctatgaataacaattgaaaaaataccccaaattgctaatatgattatttgaggatgatgggattaaaagggatctttatttttttaaatactacggttattttacctttaaaatagcatatttacatgtatcgtatttctttctgtgcacacccaaaatagttaaacagtgtttcttcatgaaagaactctggaacccctgccttggaggtccttacagatagtgccatcttacctggggagtggcctggggctaaacggactgctctgtggctccaaggccaaaccctggaaggtcatgaccttcgcaactcaacatgaccaggtccccaggcagagtgtgctgctgcctctgcctctggctggcttatgtgccactgaggggccttggtagacacacttcctatttgacctgctatattgctgccctggcacacaggagctccaagctgggctgtctgaactatcatttatgactgtcttcttgtggtctaggcatctgtaaattataaatacaaagtgggtagaagagcagaacctttccaaattactttctttctcttggcctcaggggaatcccagaccaagtgtgaaaaggacttctaattccatgtttaaggctgaatcaaaggttattctgggtcttccttctgctccatcagttgctgaactatggccatgtgggggcctccagcagaggcatcaccctttcctgtcccccagttcctaaacgtcagcatcccaaacaatggctatttgttgaggcagattgaaaatgccatgtaaatttcagaagacacataaaagcccaaaggattctgcttaacttagtaacacttctgagcatggaataactggctgtgactcatcatcaccaaaggctgggtcctagcacagacaagcttgttactgcttttctcatatgggttggagtgctactgacctacttttaacaggtcatgccctttgaggagcttacacaactccagggaggtgaccagtcatactttcttgcccagtcttcttttaacaaggcctttctgtaagacagctgcctgggcagccttatggctggacactgagctttcctctgtggcaggccaactggtctgacccaaggttgtctgtggccatgttaggacgtatattcttactcgccgagcgacgcagcccagagggttcaggaaaaggaggtggtgagtgggcagccaggatggctcacctgctgggtggtggccagacagtactctgccgtgctcaggatgttacagatgaggcagagctcctccagagtgaacttggctacttctgagccctccttttccttgaggaggctgctgatagtcagtcctccactgctggttgtggttctgaagaaaaggaacaggaacaagtcagcatggaatttctaatttgcttcctgaactggaaactacattattttaagatacagaaaagggggaagtaaaggctggacatggcccaaatcaattcacatacaatgagtccttttcctactgaccttaccttgacaccgtcagaaataggaagagatgattcctattttagttaatctgaatcatcagcaggccattagtcacattaactaggatggtctaatatccaaagggaaggctgctgagctgtcctctctttagcttggaatctcctgatgtgcagaactcatttaggaccgtgtggagcacgaaagatggttacctaccctgtttctttcagttaagaaaagtctgcactgggactcatgtgtgctggtggaggaggacataagcgcatgttaagagaagtctgcactggaactcatgtgtgtttgtggaggaggacataagtgaatgttaagaaaagtctgcactgggactcgtgtgtgctggtggaggaggatataagcgaatgttaagagaagtctgcaaggggactcatgtgtgcttgtggaggaggacataagcgaatgttaagacatgcttcctgcccaaggccctaagtgtctcaagaggccaacacccatcacacatcctcctgtgactacaggttttggggcagccccagctactgagtgagttctatggtagtaaccactacccactcatatctggatgctttggaatcctctgttggctcctttcaccttgcccccacttctgtgaacagtctctctactgacataatcccagctgagtatgccatttttttctgctgagatgctgactaatacacgtgggaaaatgctcccacgatgaagttaaacggtagctgcagggaataaagctataagcagtatagccccaattccgtgacacaaacaaacaaaagcacacagatcacacacattaggtatctatcaagaacggaaaaatatatacaaaaagttacgttctctttgggtagtgggattatacataatttatttatttatttatttattttttagggcggagtctccctgcaatgcccaggctggagtgcaatggcacaatctcggctcagcgcaacctccgcctcccgggttcaagtgattctcctgcctcagcctcccgagcagccgggactacaggcatgcaccaccacacccagctgatttttgtatttttagtagagatggggtttcaccatattagccaggctggtctcaaactcctgacctcaagtgatcctcctgcctcggctgcccccaatcctaccgcatcttcaaacattaggctatgtccagttctaatgcctcaggataacacaatagtccccataattaggagctatgcagtagctgacccccaatcctaccgcatctgaaacattaggctctgtccagcatggcaggaagtgtgcaccacaagagggacttggaacctactgggaatgaggaaaaagcagattcattcctccaacccatcactccggggcatcatctcaccaaaagaggcttgggtgaaactgcttaagctatttatcagttatttccaccacaacctcactttttttgtatgtgccaagtatctatagctgaatccatgaaaattaaataggcatacaatgggattggttctcgagtccaccgtggtaagatttgcccacgtgggcagtcagtgtggacatttcctctgatggtcttgatcagctgtggaatgtcagagaggaaatagcttcaggccctcgggaactcaggaagcgtgctttcctccttgatactcttggtggtttagtaaacaacttcagagtggatttccttaagattcccatatttaggtctatttgccaccactcagactatgaagaacaggactcacttgggcaggttgccagagaggattttccaggcgtattctcggaggtacttctggaaaatggtggtcagggcgatcatgggctccccagtactgagctgagagcattgcaccatgcacttcttgtagtagacaaagaggtcggcgcagctggggagcacggcacccccttcatcagtgttgggcttaggtggcccctgggctttgaaatcagccacaaaccgatctatcagctctccgaggttcctaggaggaaaaaaaaaaaccaaaaatgttattttacttcaagaaaagtaaagcaaatgtgctcgtttgcaatgtacataaactactgccacaagtaatcattcctactgcatttaaaacttaaaatcggatcgattttaatcaatatcatcattcactaccaccaccactcctacaacagcagtaataaaatctgacatatgagattctaatctctaagtcgattgacatttgtgctttatacttttcaaggcatttcattatcatattggactccaaacccctgtaagcaagatagggtattactggtcccgctaaaagatgagaaaattaagtcctagaaagtttctcacaaagtctgtggcagagctgagcctagactccaatactaaagtaagaaactaatccttctatcatattagtactgtttacccctccaaaaaggaaaaccctaaatcatgatagtgatcgttttctgaacacttgagatgcaccaggtattatgtccatgctttatacccatctcactgaacttcatttcctttttttttttttttttttttttttgagacagagtcttgctctgttggcccaggctggagtgcagcggcatgatcttggcccactgcaacctccatcttcagggttcaagcaattctcctgcgtcagcctcccatgtagctgggactacaggcacacgccaccatgcccagctaacttttattttcagtagagacagggtttcaccatgttgcccaggctggtctcgacatcctgacctcaggtgatccacccaccttggcctcccaaagtgctgggattacaggtgtgagccactcactgcgcccagctcatttactttttacaataaacttacatagtatgtattattactatcctcattttcaaagagttaagtacagaaaagttgagtaccttgtccagagtaatacagcaagaaaacaggagagccacgattaaaaactaagcagcctggctctaagcttcaagcctttaagcactctacttcctaaaaacaaaaaggttatgatgtcagcacatatttagacatcacgaacctaaatgtgcccaagagacagatgcctaaacaaagagaaactgtgaaatgtgttataatggtttctttctcctccgatttagttttttcttagaacttccagaatcaaaggtttaaaaaaatcttaggaaaagagagggtacgggcagagtgtggtggctcaagcctgtaatcccagcactgtgggaggccgaggcgggcagatcacttgaggacaggagttcgagaccagcctggccaacatggcaaaaccccgtctctactaaaaatacaaaaattagccgggtgtgggccgggtgcggtggctcatgcctgtaatcccaacactttgggaggcccaggcggcggatcacttgaggccaggagttcgagaccagcctggccaacatggcaaaaccccgtctctactaaaaatacaaaaattagcgtggtgtgggccaggcacagtggctcatgcctgtaatcccagcactttgggaggccaaggcaggcggatcacaaggtcaggagatcaagaccatcctaacacgttgaaaccccgtctctactaaaaatacaaaaaaaaaattagccgggcatgatggcgggtgcccgtagtcccagctacttcagaggctgaggcaggagaatggcatgaacccgggaggcggagcttgcagtgagctgagactgcaccactgccctccagcctgggcaacaaagtgagactctgtctcagaaaaaaaaaaaaaaaaaaaattagctgggggtggtggcgcatgcctgtaatcccagctacttggaaggctgagacctgaggcagagaatcacttgaactcaggaggcggaggttgctgtgagcccagctcacaccactgcattccagcctgggcaacagagcaagacttgatatctggaaaaaaaaaacaaaaaccaaaacagggtatgagcagctccagacttgcctcaggccacagtggggatgagagttgcaatttttctccgatttcccattcaaacatccctgtaattgttccgttgaattgtgtcatcacctgtgaggatccagcagagctgcagtaactgctgcctgcacagctgtgctgtgtgaagaatgggaagggttcccaccactcctgacatgttgcatctttttaggttgccgtttaaggctataggaatccagctgtgttttaaaaatgtatttatataatggtaaggaagaaaaagacaagaaccacacataccaccaattagcaggaataggagaaaattgacattttactcaaaggcttttgttattgaaagtctattataggcccaacgtgggggctcacacctgtaatcccagcactttgggaagccggggcgggtggatcacctgtggtcgggagtttgagaccagcctgaccaacatagagaaaccccgtcttcactaaaaacacaaaaaattagccaggcgtggtggcgggtgcctgtaatcccagctactcgggaggctgaggtaggagaatcacttgaacctgggaggcggaagttgcagtgagccgagatcgtaccattgcactacagcctgggcaacaagagcgaaaccccatctcaaaaaaaaaaaaaaaaaaaaaaagaaagaaaagaaaaagaaagtctattatatccagatacaaccactctgccctcaaagagcttctggcctaggctaagtctctgtctgtggtgatagtgagaaagcagggaaggatctcgttggttgacctcggaaagcttcatggccaccactcttgttcctcataacctctcttgcctcactttcccactgaatctcccacctctcctccacagctgacccaacactccagccagaggttcctcgcaacagctcccctgctggcctactcccggtcagtgggcctcgcaacggctcccctgctggcctactcccggtcactgggcctgtgtgacgtcctggccaaaacgctctcccaccacctgtccactcccctttcaagctcatccaggtctcacccgcagcagctgcaacttctgtcatctgccacccaccaacactttatttaacactttattagacagtgcgaggatgccatatattcaagaaataaccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagaaataacctatcttctcccatcctgggccacggtaggcaatgctaatcaacaaggagccctttcttcactgatctctcttgtgattccagaatccttcttgagacagcactccagccagtcacctctatcaactgaagttggtacaaaaggcgaaggaggtagaatcatctgtttcgtgcctgttaacacaagctccctgagaggaggaatgacgtttatgctggttctgctgcccccggcccgcccgtcatgccaatgagtggagtgaagcttcatgctagtgctcgatacatacttacctgatcaacctccacactttgttcctaggggatgggaatggagggtgggaaggtggaaacgggatggaggccggtgcagtggaggagaacatggaacagaaggcaaaagattcccctggggtcttcttatgagattctaatctctaaattgatagtgccaaccaaatcagggaccagagctctgacatgggtgttttttttgtttttttttgtttttgttttttgctttttttggagacggagtctcactcagttgtccaggctggagtgcagtggtttgatctcagctcactgcaacctctgcctcccgggttcaagtgattctactgcctcagcttcctgagtagctgggactaccggcacacaccaccacaaccggctaatttttgcttttttttttagtagagatggggtttcaccatcttggccaggctggtcttgaactcctgacctagtgatcgcccgcctcagcctcccaaagtgctgggattacaggcgtgagccactgcgcccagccgactctgatgtgcttccaggcgtgagccaacgcgccagccaactctgatgtgattctattttcatcactcacctgttcccctagaagatggatacttacttacttgcttcctatttcagagccaccccaatgagtaagattataaactaattatgatcatacagcataaagaaaatgttcacttcaaaaagctctaaagatctatactttgtagaatgtctacaggatgtctactcggttacttctgacattgttctttcaagtggatgagaaataaaccagttggggaaaccttcccctgccttccatctttcaccctgcatcagcatgctttgatgccacatgagacattagaaaatcagtagccagtatttcacagaacagaagaatgtaagttaccccaatgggaatgcgtaaggctcattagttttgaatacatgatccaatctgatcacatttcttttttttttttttgagacagagtattgctttgtcacccaggacaaagtgcagtggcatgatcatggctcactgcagcctcaacctcccaggctcaagcaattctcctgcctcagcctcccaagtagctgggactacaggcgtccatcaccatgcatggctaggaggaggccaggagtttgagaatagtgtgggcaacaaagtaagatccctatctctaaaaaaaaataaacaaattagttaggcatggtggtgtgtgcttgtagttacagttacttgggaggctgagggaggacgatcatttgagcccaggagtttgaggttacagtgagctataatgccaccactgcactccagcctggacaacagagcaagacattgtcgaaggggaggggaggggaggggaggggaagggagaaggaaggaaatacctccttcccgaaatactgctgggagttccactgataaattacatgccctaggaatgaagacagttgcagagtggtatcagtagagggaaaaactaaagtgaggagaaaaaatatgccattgcagactgggtttatccatggatggccaaggccatttctctggtgggcctgcagtcagcattcacagaaacaatattctaattggaatgtcaagcagtgaggcacagggagagaaagacagtagccagaagatggcaacgcaggtgagcaaggtcaaggcagctgaagatccccattaagttagataacttatttatttatttttttatttttttgagacagggtcacccaggctggagtgcagtggcatgaccacagcttactgcaacttctgcctcccaggctccagcaatcctcccaccccagcctcctgagtagctgggactacaggtgcacaccaccacacctggttaatttttgtgggcttttttttgtagagacagggttttgtcatgtcacccaggctggtctcgaactcctgagctcaagccatccacctgcctcagcctcccagggtgctgggattacaggcacgagcaaccatgcccgaccctagagcttcttaattcaagggtactcccactaatttgcatcccttcctcttcctttttgctggggctgaggatgttgctctggtgtggccagtggggctggggagccaaggtgtggcttgagcacagctgggagatgggttacatacaggcaaactgagcaaataggtaaatatactgagcatgctaggacccaaatttctcactgttgtagaaggcagttgccaacgttgaatgggagaggctaaaataaaccctgtggtgtgagattagaattgaaggcatcagcatcaaatgcacaggttctaatatagaagcaggtgcacacacagctatagaggcatatatgtagaagcaggtgcacacacagctatagagacatatacacgtatgtttatacacacatacatttcttagctctctcagccaaggcaatctggaagcaatgacaccgagcagcaatgagcatacttggtttctaaatgtcatcctccaccaaaggaacaagaaatgcctggggaaatggacgactccagggctgggatacaaaagtacaggataagcctagtatattttattgtgccagagaggaaggaggtgctcaaaaaatgatagtggcatgtaaaaaggatgaagagccagctttaagaggctcccactggccaagtcagggacaatttgagtactaaaataacaacgacaaatcctggaaggaaaaacagacactaatggaaaaactggtgaagttcaaacacggtgtgcaggttattaaatagtaatgtaccaatgttaacttgccagttttgacaactctgctgtggttatataagatgtcaacatcaggggaagttgggtgaaggggaacataagaaatctgtactatttgtgaaattttcctataggtatacatttattccaaaatacagtaaaaataaaagagatagtgatgcctacaacctactgaataaaatataaaaatccatgagtccatgctgacatagacataagggggagaagtgacagcttttcttaaagtagaatgccaactgataaacgcagaagaaatgatgtagctagaaaaatcaccatttgactgggcgcggcagctcatgcctgtaatctcaacatctagggaggccgaggtgggcagatcacttgaggtcaggagttccaaaccagcctggccaacatggtgaaaccccgtctctactaaaaatacaaaaaaattagctgggcatggtggcgagcatctataatcccagctacttgggaggctgaggcaggagaatcacttgaacccaggagccgagattatgtcactgcactccagcctgggcgacagagcaagactctgcctcaaaaaaaaaaaaaagaagaaaaatcatcattgtcaatcatcttagtaataaattacatgataagtgaaagatgaggaaaaggatattgataaagtttcaaggtttctcccaacacttattaataaatagagatacccagtagagacaacatctacaccaagtaataaaaacgaacatcataggctggccgtggtagctcacgcctgtaatctcagcactttgggaggccaaggcgggtggatcacctgaagtcaggagttcaagaccatcctgaccaacatggcaaaaccctgtctctactaaaaaaaagacaaaaattagctgggtgcagtggcgggtacctgtaatcccagctactcaggaggctgaggcaggagaattgcttgagcccaggaggtggaggttgcagtgagtggagatcgcaccactgcactccagcctggggaatagagtgaaacgactctgtctcaaaaaaaaaaaaaaaaaaaaaaagaacatcacatcacaagttttgggataaactggcattctgtgcctcctgatatgaattcctaggaacacaggaccacttctgcataaatcataaataatgaggaaacatcagacaaacccaaactgagggaaattccagaaagtaattggccaatcctcttcaaaaatgtcaaggtcatgaaagacaaagaaagactcaattagtcttctgggttgaaggagaccaaagagacatgacaactaaatgcaacctgtgatcctagagctatttaaacaaacaaacaacctgcgatctgagagctattcaaacaaataaactaacaacctgtgatcctagggctattcaaacaggccaacaaacaagcagattgggacaactgctgaaatgtgaggaggagagcatggatgaagcagtaatactgtatcactgtgaattccctgatgttgatagctgtactgtggttatgtgaggggtctgggattaagcagtaatgttgtatcaacgttaatttcctgatgtggacagttgtactgtggttatgtagaaaccttgtttctaagaaatatatattgaagtattaaggagtagtggcgaatcttgtctgcaacttgagaattcaaaggttcaggaaaaaagtacaggttgggcacagtggttcacgtctgtaatctcaacactttgggaggccagcagatcacttgagcccaggagtttgagaccagcccgagcaacatggtgagaccctgtctctacaaaaaaacaaaaattagactgatgtgatggcctgtgcctgtagtctcagttactctagaggctgaagtaggaggaggggaagggagaggaagggaggggaggggtggggaggggagggagaagagaaagggaaagagagaaaaagaaaaagaaggaagagaaaaaagaaaaggaaaatgcatgcagtgtctgtgcattacgtgtgtgggggagataactattaatgaggaatctggatgaaggctatacaagggctctttgtataattcttataattcttctgtaagcttgaaattaattcaaaataaacaacaatgggctctccctctccctctccttctccctctccctctccctacagtctccctctccctctccctacggtctccctctccccacggtctccctctccctctctttccacggtctccctctgatgccgagccgaagctggactgtgctgctgccatcttggctcactgcaacctccctgcctgattctcctgcctcagcctgccgagtgcctgcgattgcaggcgcgcgctgccatgcctgactggttttcgtatttttttggtggagacggggtttcgctgtgttggccgggctggtctccagctcctaaccgcgagtgatccgccagcctcggcctcccgaggtgccgggattgcagacggtgtctggttcactcagtgctcaatggtgcccaggctggagtgcaggggcgtgatctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtccggaaagtgaggagcgtctctgcccggcccccatcccatctaggaagtgaggagcgcctcttcccggccgccatcccatctaggaagtgaggagcgtctctgcccggccgcccatcgtctgagatgtggggagcgcctttgccccgccgccccgtctgggatgtgaggagcgcctctgcccggccgcgaccccgtctgggaggtgaggagcgtctctgcccagccgccccatctgagaagggaggagaccctctgcccggcaaccgccccgtctgagaagtgaggagcccctccgcccggcagccgccccgtctgagaagtgaggagcgtctccgccgggcagccaccccgtccgggagggaggtgggggggtcagccccccgcccggccagccgccccatccgggaggtgaggggcgcctctgcccggccgcccctactgggaagtgaggagcccctctgcccagcgcgtctgggacgtgtgcccaagagcttattgagaacgggccatgatgacaatggcggttttgtggaatagaaaggcgggaaaggtggggaaaagattgagaaatcggatggttgccgtgtctgtgtggaaagaagtagacatgggaaacttttcattttgttctgtaccaagaaaaattcttctgccttgggatcctgttgatctgtgaccttacccccaaccctgtgctctctgaagcatgtgctgtgaccactcagggttaaatggattaagggcagtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaatgatcaataaaaataaaaataaaaataaaataaaataatcaacaatggtaattagtttacagacagatgctaggctctagaaaagcatgagttctagtctaacaaaagttattagagggaactcaggagaatgggcagatatggagtcaccagtaacttccctgatggagaacgccatagaatggggtaaagaaagtgcctatgtagaaatttcttttgcaagagtcagccagaggaaatcactaaatgccaagggtagaagacagactaacctcctctttgaacataaataaaaattgagaaagccatttaaaggatgtaaggacggcttagcccaacctgctagtggccatccccacttcctgcctcctccctgagtactggctctgcagtcctcctactgctacttggcttttggctggggcagatgctgccggaactttcccttggcaggtgggaggctggggagatgagaaggtggaccccatgccaggctcaagagaaatctggccacactgacaaggccacccacccacataggagtcctgaaaaagatgagagggatggcagggcaggcactgttcctgagcaccatttactgtgtgctgaaggtgaaaatgccacctcttctcctcctcgccacaaagtccatgaggtcggccttatgatcctcacagtgtagaggggctagctaggagcatgctcaaggtcccagcctagcaagcgcgaagcctcacatctaggtatgtctgggatcaggcccacgctctttccaccacactgtgttgcgtctctgtcatctgggaagttatgaatggtctcatgctttctgagttagagctacagcaaaagtagtaatgtgcacaaaaccagtccccacctgagttccttctccagcctcaggattctttgaagggaagaagcagttcctagaactccttgaaattacactcaaaatagtgtgtgcatgatatggatttttttgacaagagcgtcgatgctttccattgggttcttaaaaaggatctatgactttaaaatggttaataacgagtgcgttgggcattattttgtctgactatctctcttgacagataaggaaatggagttctttgaactctattttctactttgagttacagtgtttattctgcaggaacagcagcacagcctgcgcagtatctgctccttccttagtgctgcggaaacttcctagtgaggccaaacagcagggtaagtggccagcacttcatttttcacaggaaaatggagagtccccaaggaagggaggcctggctccttgcccaaagtatcatgaacaatgagtatactttgtataaatcaaggccatgtgaaaagagtggatgccagaattacaataactcagaaaaatgaccctttaaaccaggtaggttttgggaaaggatgtggctacctcagacatgtgctttaaaccctgggccttggctgggcgcggtggctcatgcctgtaatcccagcactttgggaggtggaggtgggctgacctcttaagcccaggagttcgagaccagcctgggcaacatggcaaaactgcgtctctacaaaaaatacaaaaattagccaggtgtggtggtgtgtgcctgtagtctcagctacttgagaggctgagtaggaaagactgctgaaacccaggaggttgaggctacagtgagtcctgatcacgcctctgtactccatcttagctgacactgagaccccgtctcaaaaataaataaataaaaataaaccctggacccagtaacttttaagccttttaaaacgaaaaatttgggttaagagaagatggggctttggctgaaaagagtcatccaggggggttcctcaaagacctgtgactctaataggcaaataaccaatcctttttcctgcccctcaggggtgtcttagtaacttcctggaggcaaactgtgaatgtagaagacagggtgctctcaaggacaaagaggcagaagtccccactgtacctcggtgtgcctgctgggcacgtgcccactgggcaagagcaagggcactactgggtctttgcaaggcaaatgacggcaaggcaacttgcctttggtggtgggctgatggggagacttccatttgatgatggagaagctactgggcaagttcattttctgagattttaatatgaagtactttgtaatcgggcatgaaaagcatagaagcagtccataaaatcacgtgagtgaataatacagttccatgtgaagtttctaattgaaacattgtcttactgttacggtttaagaaacatgtttgaaactaagaatgtgctcacccatgatagaagcattaaaaacaaggggaggggtgaagtgcaatcagacctaaatgcgtaaatgcaaccccagagagcctccctaaaaacctaatacgttcccagagaacttccctcagaacctaacgcgttcccagagaacttccctcagaacctcaatgcgttcccagagaatgtccctcagaacctaatgtgttcccagagaatctccctcagaacctaatgcgttcccagagaaccttcctcagaacctcaatgcattcccagagaacttccctcagaacctaatgcattcccagagaaattccctcaggatctaatgtgttccagggaacctccctcagaacctcaatgcgttcccagagaacctcccccagaatctaatgctttcccagagaacctccctcaggacctagtgcgtcccagagaccttccctcagaacctaatgcggtcccagaagacttccctcaggacctaatgcgttcctagaaaactctcagaacctaatgcgttcccagagaacttccctcagaacctaatgcattcgcagcgaacctccctgagaccctaatgcgttcccagagaaattcccttaggacctaaatgtgttcccagagaacttcactcagaacctaatgcattcgcagagaacctccctcagaacctaatgcgttcccagaaaacctccctcacaacctaacgcgttctcagagaacttcactcaggaccaaatgagttccgaaaaaccaccccagaacctcaatgtgttcccagagaacctccctcagaacctaatgagtttccaaagaacctccctcagaacctaatgtgttcacagagaacctccctcaaacctaaatggttcccagagaacctctctcagaacctaatgtgttcccagacaatctgcctcataacctaatgcgttctcagataacttccctgagaacctcaatgcattcccaaagaacttccctcagaacctaacgctttcccagacaacctccctcaggacctaatgcattcccagagaatctccctcagaacctaatgcattgccagagaacctccctcagaacctcaatgcattcccagaaaacatacctcagaacctaatgcattcccagagaatctccctcagcacctaatgtgttcccagagaacctccctcaggagctaatgcattcccacagaacctcctccagcacctaatgcgttcccagagaacctcccacagacctcaatgcattcccagagaacttcccacagaacctaatgtggtcccaaagatcctccctcagaatctaatgcgttcccagaaaaatttcttcagaacctaatgcattcccagagaacctccctcaggacctccatgcgttcccacagaacctccctcagaacccaatacgtgcccagagaacctccctcagaacctcagtgcatttccagagaacctccctcagaacccaatatgtgcccagagaacctccctcagaacctcagtgcattcccagagaacctccctcagaacctaaagcgttcacagagaacctccctcagaacctaatgcgttcccagaaaacctccctcagaacctcaatgctttcctagagaacctccctcagaacctcaatgacttagcagagaacctccctcaggacctcaatgcattcccagaaacctcgctcaggatctagtgcgttcccagagaacctctcagagaacctaaagcattcccagagaacctccctcagaacctaatgtgttcccaaagaacttccctcagacctaatgctttcccagaaaacctccttcagaacctaatgcatttccagagaacttccctcaggacgtcaatgcgttcccagagaacctccctcagaacctaatctttcccagagaacctctgtcagaactcagtgagttcccagagaacctccctcagaaccacaatgcattcctagagaatctcccacagaacctcaatgagttaccacagaacctccctcaggacctcaatgcgttcccagagaacatccctccaaacctaatgcgttaccacagagcctccctcagaacctaatgcgttcccagagaacccccaacagaatctcagtgcattaccagaaaacctccgtcaggacctaatgcggtcccagagaacatccctcagaacctaatgcgttcccagagatcctccctcagaatctaatacgttcgcagagaaactccctcagaacctaatgcattcccaaagaacttcctttaggacctcaatgcgttcccagagaatctccctcacaaagtaatgcatttcgaggcaacctccctcagaacctcagtgcattaccagagaaccttcctaagcacgtaattcattcccagagaacttcccccagaacctaatgcgttcccagagatcctccctcagaatttaatgcgttcccagagaaattccctcagaacctaatgcattcccagagaacctccctcagaatctcagtgcattaccagagaaccaccctcaggacctaatgtggtcccagagaacatccctcagaacctaatgcgttcccaaagatcctccctcaggacctaatgcgttcccaaagatcctccttcagaatctaacacactcacagagaaattccctcagaacataatgcgttcccaaagaacttcccttaggacctcaatgcgttttcagagaacctccctcagaacctaatgcgttcccaggcaacctccctcagaacctcactgcattaccagaaaaccttcctaagcaggtaattctttcccagagaaattccctcagaacctaatgcgttcccaaagaatctccctcagaatctaatgcattcctagagaacatccctcagaacctgatgcgttcccagagatcctccctcagaatttaatgcgttcccagagaaattctctcagaacctaatgcgttcccagagatgctccctcagaatttaatgcgttcccagagaaattctctcagaacctaatgcgttcctagagaacctccctcagaacctcagtgcgtttccagagaagctccctcagaacgtaatgcattcccagacaacttccctcagaacctaattccttcccagagaacctctctcagaacctaatgcattcctagagaacttccctcagaacctaatgcgttcccagagatcctccctcagaatttaatgcgttcccagagaaattccctcagaacctcagtgcgttcccagagaacctccctcagaacctcagtgcgtttccagagaagctccctcagaagccaatgcattcccagacaacttccctgagaacctaattccttcccagagaacctccctcagaacctcagtcaattaccagagaacctccctcagaacctaatgcgatcccagagaacatccctcagaacctaatgcgttcctagagaacccccaacagaatctcagtgcattaccagaaaacctcccgcaggacctaatgcggtcccagagaacatccctcagaacctaatgcgttcccagagaacctccctcagaatggaatgcgtttgtagagaacttccttcagaacctaaggcgttcccaaagatcctccctcagaacctaatgcgttcccagagaacccccaacagaatctcagtgggttaccagaaaacctccctcaggacctaatgcggtcccagagaacctccctcagaacctcagtgcattaccagagaaccttcctcaggacctaatgcggtcccagagaacatccctcagaacctaatgcgttcccagagaacctccctcagaacctaatgcgttcccagagaatctccctcagaacctaatgcgttcccagagaacctccctcagaacctaatgcgttcccagagaacctccctcagaacctaatgtattcctagagaacttccctcagaacctaatgcgttcccagagatcctccctcagaatttaatgcgttcccagagaaattccctcagaacctaatgccttcccagagaacctccctcagaatctcagtgcattaccggagaaccaccctcaggacctaatgtggtcccagagaacatccctcagaacctaatgcgttcccacagaacttccctcagaacctcagtgcgtttccagagaacctccctcacaatctcagtgcattcccagagaacttccctcaggacctcaatgtgttctcagagatcctccctcatgacctaatgtgttcccagagaacctccctcagaacctaatgcattccgagagaacttccctcagaacctaattccttcccagagaacctccctcagaacctcagtgcattaccagagaaccaccctcaggacctaatgcgttctcagagaacctccctcagaacctaattccttcccagagaacctccgtcagaacctgagtgcattaacagagaaccaccctcaggacctaatgcgttcccagggaacctccctcataacctaattccttgccagagaacctccctcagaacctcagtgcattaccagagaaccaccgtcaggacctaatgtggtcccagagaacatccctcagaatctaatgcattcccagagaacccccaacagaatctcagtgggttaccagaaaacctccctcaggacctaatgcggtcccagagaacctccctcagaacctcagtgcattaccagaaaacctccctcaggacctaatgcggtcccagagaacatccctcagaacctaatgcgttcccagagaacctccctcagaacctaatgtgttcccagagaacctccctcagaacctaattccttcccagagaagctccctcaaaacctaatgcattcccagacaacttccctcagaaactaatgcgttcccagagatcctccctcagaatttaatgcgttcccagagaaattccctcagaacctaatgcgttcccagagaacctccctcagaacctcagtgcgtttccagagaacctccctcacaatctcagtgaattcccagagaacttccctcaggacctcaatctgttcccagagatcctccctcaggacctaaggtgttcccagagatcctccctcagaacctaatgcgttcccagagaacctccctcagaacctaatgcattcccagagaacttccctcagaacctaattccttcccagagaacctccctcagaacctcagtgcattgccagagaacctccctcaggacctaatgtgttcccagggaacctccctcagaacctaatgtgttcccagagaacctccctcaggacagaatgcgttcctagagaacttccctcagaacctaatgcgttcccagagatcctccctcagaatctaatgcgttcgcagagaaattccctcagaacctgatgcattaccagagaacttcccttaggacctcaatgcgttcccagagaacctccctcagaacctaatgcattccaagagaacctccctcagaacctaatgcattccaagagaacctccctcagaacctcaacgcattcgcagagatcaagacctctacgcgttcccagagaccctccctcaagacctaatgggtacccagagaacctcccacagaacctaatgcgttcccagataacctccctcagaacttaatgcattcccagagaccttccctcacaacctaatgcgttcccacaggacttcactcaagacctaatgtgttcccagagaacttccctcaggacctaatgcattcccagagaacctccctcaggacctaatgcgtttccagagaacctcccttaaaagctagtgcgttcgcagagaacctccctcagaacctaatgcattcccacagatcttcactcaggacctgatgcgttcccagagaacttccctcaggatctcaattcgtttccagagaacctccctcaggacctcaatgcgttcccagagaacccctctcagaacctaatgggttcccagagaacttccctaagaacctaattcgttcccagagaacctccctgagaaccctgaggtcacagaggaccttcctcagaacctaatgcattcccagagaacttccctcaaaacctaatgcattccctgagaatctccctcagaacataatgcgttcccaaagaagctcccacacaacctactgcgttcccagagaacctccctcagaacctgaatgcattcccagagaacttccctcagaacctaaggcattcccagagaacttccctcagaacctaatgcgttcccagagaacctccctaaggacgtaatgcattcacagaggacttccctcagaacctaatgcatccccggaaaaccttcctcagaacctaatgcgttcctagagaactttcctcagaacttaaatgcgttcccagagatcctccctcagaatctaatgcgttcccacagaaattccctcagaacctactgcgttcccagagaacttcccttaggacctcaatgcgttcccagagaacctccctcagaacctcagtacattcgcagacaacctcccttggaacctcagtgcattcccagataacctccctgaggacctcaatgtgttcccagagaccctccctcagaacctaatgtgttcccagagaacctccttcagaacctaatgcgttcccagagaacctccctcagaatctaatgcattcccagagaacctccctcagaacctcagtgcaatcccagagaacctgccttcaaacctaatgcgttcccagaaaacatccctcaggaactaatgagttccaggagaacttccctcagaacctaatgtgttcccagagaacctccctcagaacctaatgcatcccagagaacatcactcagaacctaatgtgttcccagagaacctccctcagaacctcagtgcattctgagaacctccctcaaaacctcagtgtgttcccagagaacctccctgaggacctaatgcattcccagagaacctccctcagaacccaatgtgtccccagagaacctccctcacaacccagtgcgttcccagagaacctccctcaggacctcaatgcgttcccacagaacttccctcatcatctaatgcattcccaaagaacctccctcagaacctagtgcattcccagagaacatcactcaggacccaatgtgttcccagagaacctccacagaagctcaatgcgttcccagagaacctccttcagacgctaatgtgttcccagggaacttccctcagaacctcaacgcagtcccagagaaactccctcagaccctaacgtgttcccagagaacctcccttagaacccaatgcgttcccagagaacctccctcagaacctaatgcgttccgagataacctccctcagaatctcaatgcgttcccagagaacttctcttagaacctaatgcgtttccagagaacctccctcagaatctccatgcattctcagaggacttccctcagaacctaatgtgttcccagagaacttccctcaggacctaatgcgttcccagagaacttccctcaggacctaatgcgttcccagagaacctccctcaggacctaatgtgtttccagagaacctcccttagaacctaatgcgttcctagagaacttccctcagaatctaaagtgttcccagagaacctccctcagaacctcagtgcattagcagagaacctccctcagaacctaatgcgttcccacagaacttccctcacaacctaatgcgttcccaaagaacttccctcaggacctcaatgcgttcccagagaatctccctcagaacctaatgcgttcccaaagaacttccctcagaacctaatatgttcccagagaacctccctcagaacctcagtgagttcccagagaacctccttcggaacctcagtgcattcccagagaacctccctcagaacctcagtgtgttcccagagaacctccctgaggacataatgcattcccacagaacctccctcagaacctcaatgcgttcccagagaccttccctcacgacctaatgcgttcccagagaacttcccccaggacctaatgcattcccagagacctctctcagaacctcaatgcgttcccagagaaccttcctcaggacctaatgcgttcccagagaacctccctcagaacttcaatacattcccagagaactttcctcagaacctaatgcgttcccagggaacttccatcagaacctaatgcattcccagataacctccctcagaacctgaatgcgttcccaaagaacctccctcagaacctaatgtgttcccggagaacctcactcaggacctcaatgcgttcccagagaactcccttctgaaccaaatgcgttcccagagaatctccctcagaacctaatgggttcccatagaacctccctcagaatctaatgtgttcccagagaacttccctcaggacctcaatgcattcccagagaacctccttcagaacctcaatgcgttcccagagaacttccctcagaacctcaatgcgttcccagagaacctccatcaggacctcatgcgttcccagggaacctccctcagaacctcaatgcattcccagagaacttccctcagtacctaatgcgttcccagggaacctccctcaggacctaatatgttcccagataacttccctcagtacctaatgcattccccaagaagctccctcagaacccaatgtgtttccagagatcttccctcagaacctcagtgtgttcctgaagaacttccctcaggactttcctgcagccgctgttgctctccccatgggagccaccttctggtcccttccgagtgcgttctttagactgtgaggcttcctctgggagcccaggccagtctgtctccagtcatctcgttacaatcatcttgacctttccaaaacctgccttccaacgtggaagggcttggctgcggacaaggacgcagggatgaggaggagtcttcctccttttctaatgccccctcacgcacacaacggacactggagcacgaacacagtcttcggctgttagtttggaagtctttgggatttttttaaaaacagggtgggagggaagaaacctggccgcagtgagatgctttataaaaatatttggaggctacaagtttgtgaaaagcatatagtatattttgtttgcttttcttttctttttttcttttgagacgaagtctctgtcaccaagctgggtggcatagtgacggctaattgcagcctctgcctcctgggctccagtgattttcccacctcagcctctcgagtagctgggactacaggtgtgcatcaccacacctgactagtttttttaaaaaaattatttataaagatgaggtttcagcatgttgcccaggctggtcttgaatcctgggctcaagagctcctcctaccttggcctcccaaagtgctgggattacaggtgtgacccactgtacctggccacgtgaaaagcatatactgtattatatagatgatccataaaataaaatcagaatccatgagttcatactgatatataaacaaataggggagagggaaaattcttccatatagtagaactccaattagtaaatgtagaagaaatgatgaaaatagacaatcgacatttggcaaatgccacagaaacaacgcttccgtcaggaatcaatcaagggatgcgaaatgagtgggcaaaagtttgatgagagcaggatatttacaaagtatcatcccataagatacttattaattaccaggagaaaaatagtaacttcacattgaagacagttggcaggtaccacctaaagcaagtaatcgaagtccccaataatgggacaaatcaatgtgatgtgcctcttgacacaatgcactggggatacaatgccacttttatggtgttcttgcccaaaattgatttcatcaagaaaaaacaaacaaaaactgaggacattgtacaaaatacctggccagtacacactgaggtcgtgaaagacaaagaaaacttgaggaatggctgggcaaggtggctcatgcctgtaattccagcactttgggaggctcaagtgggtggatcatttgagcccaggagttccagaccagcctgggcaacacagggagacagaatctctactaaaaatagagggtggcatgtgcctgtggtcccagctacttgggagactgcagtgggaggattgcttgagcccaggagatggaggatgcagtaagtcataatctcaccactgcaccccagcctgggggacagcgtgagactctgtctcaaaaaaggaggggaggggagggaataaaaagatgaggaactactcaagattaaaggagaccaagatcaaagagatctgacaacgaaatgcatgattattgggtcctggaccagaaaaaggggcattaatgggacagtattaccttctcgattttggtaactctggttgttatgtaagatgttaacattctctgaggagggcatgtgaaaattttttgtcctatttttgtaacttttttataagtctaaattatttcaaaataaaaggataaattatacttgaaaacatatatattagagactaggctttcttccaatacccagtgcctgacactgtaaagctttgtgggctgatatatgtcagggctcaacacccacataggaagggatcccaatgtagggatccactggggaccttattaggggcaaactcaggctctgagatttatagacacaattaatgataacattcaaaagatgtaaaaatacccctaatgggtttctagggagggtcacaggcatgccacaaccatctttcagccccggaaggagctgtgcgctcctaagacccagtcatgaccagagcggcgagaaatgcaggcagaaaacagcgaatgttcctcactcacttgtcttgggattcgatatacacgtagagatgaggctcaaaacacttggaaacaatgccatgaaatggattgtctggggctttaggcttctttggctgtaaaaacaaagaaaaataaaccccatacttgagtgatctttgcaaatgttcaagaatttttttaaaaacatcatttcaaagttcattcctaagtcacagataagagagtactcaatgtaacccaatacgatggtttcaccattcaccctggcaggtgaagaaaaaccagctttgttagcataactcacttgctctggacgatgaaagacatactgctacctggataacatatgtgttttgaatctggaagcaagtcatcatctatctgactggtgttttccagaatttaaatcccagctaataatagcaccttgtatttacacagtgctttagaatttaaaaagtgctttcacacaatccaatttttgatagcactttgataccaactaatatgtcacctgctcctcacaataatccttcatgtaggtatgactactactattttacacctcaagaaatgaggactcagaggttctctaacctgccccaacacatatgtagacgtctgcttttcttaaactagaactctttctgttataccattattttcctgcaatggttcccagaattttttgaattccatcagtaagaaaatgtaagaaaaagaagaatggacaaccaatagaggattgttaactttattttgctactttctattcttaccacgagttcctaaaaaaaaaacaaataaagggtttttttgtttgctttttgagacagagtctccctctgtcacccaggctaaagtgcagtggcgccatctcagctcactgcaacctgcaccttctggactcaagtgattcttgtgtctcagcctcctaagtagctgggactataggcacacgccaccacaccgagctaatttttgtattttaagtagaggtggggttttgccatgttggccaggctagtctcgaactcttggcctcaagtgatccacccacctctacctcccaaagtgctgggcttataggcatgaggcatggcgcccagccagaaaattgtattttatacccccaaattttataagaataaaatagcagcatataggcagtactttctaagaaaggacagttggtaaccttacatcagatagatagagagagagacaggcaggcaggcaggcagactatattgtctttattttttgctttaggccactgcaacactagatgagcgctggttcccaggctgttacttggaagccactgataaagaagtcatatgacaggcaagtattttaaaacaatatttgccacttaattcctttccaaacatctaaaaaataagcaaagattttcctatgtattacttctattcctaacaaatgtgaattctgtctattgccaaatgtctacaaaatgaccctgagccaaacacaccatgctggggttgatactaaatcataatttgcatgtaaattggcacccacaacatacttgttaaattgaactactcatatcttattttttaaaaacccactttattgaggtatgattgacattttaaaagccctacataattaatgtatacatcttgatgcgtttgaggataagtacacacccacaaagccctcaccaccatcaaggcagtaagtgtatccaccacctccccaagcctcctcccacccctgttgttacgattattattacttgtggtaagaatgcttgctgggcacggtggctcacgcctgtaatcccagcactttgggaggccaaggtgggcggatcacaaggtcaggagttcaagaccagcatggccaatatggtgaaaccctgtctctactaaaaaaatacaaaaattagcaggttgtggtggtgtgcgcctgtagtcccagctacttgagaggctgaggtagaaaaattgcttgaacccaggaggtggagatggcagtgagccgagattgcaccactgtactccagcctggcgacagagtgagactccatttcaaaaacaaacaaacaaacaaacaaaaaagaatacttaacataagatctaccctcttgaactgcttatatattttaataaatactggaagagataagccctaatgacagaaatgataactacctatttctggcctttaaaaaaatttttttttaaataacacgttgcaatggttaaaaacatctgtaaaaactgatttgtaaaaaatgatcactaaaaattaaatgtcaactttagacacatctactcaatcttgtacttaaccctcttccctttttacctttcaggagttccatgtctttcattttttggcaaggtttctagaaactttggtccttcctaagaataaatacaatctgcactgtttttactcttatcatctggaagtcactgccaaagccaggccttggactgagcccacaaccacacaagcctggctgattgagcttgaatctgccggatctagaattccacttgagtgcacagatgtcctgggagtttttctgcatttccattagtttaagatgaaggatctatgatggaggatgaggattgtgaggggtgtcctcacccacttgtcctgtttattccaagtcagtatcttttattattgattcaataagatgacttaagtgaatagaaaaatgtgatttaatttgtctaactctataggactagatatcatggattcagatttggaaaacatggctactacaaacagatatctttttattaattaaataataatgataagtattatagctattctttttatttaatttttttcttcttttgaagaaaatattcacactctgcaggataacttctggtaattatacatgtgaatttacataatacagaatgttaacatttaaaaaaatcaacgtgtatattttgctttttttttaaattttgaacatgtatattttgtattcagctttactgacttactaatttatgtgtactttcccaactactgacaatattttatcactttaaaatggctacattatgaaaatctttaaaagcctatatattatagattactgtatggatgttaaattttctgattttgatctatggtaatagaattgaatgccctttttcttaagaaatatatactaaaatatttaggggtaaaggacattatgtctacaacttacaaattgttctaaaggtcgggggggagtggggaggaaataataaagttatatagcaaaatgttaacaattgctgaatccagaagaaagatatttaggagctccttgtaacttttctcttagtttgacattattttaaaaagaaaaaaagtaaaggataacgtcagaaaacttggaaaatgggtacagtggcctggtggaaaattccagagacctcaatggagccatcttaagaatggcatattgtcccattgatctatatctcttgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctactcatgagaatggaatgttctcccatttgtttgtatcctcttttatttcactgagcagtggttcgtagttctccttgaagaggaccttcacatcccttgtaagttggattcctaggtattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagataatggggttttctagatatacaatcatgtcgtctgcaaacagggacaatttgacttcctcttctcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcgcttatgattttgagatacgtcccatcaatacctaatttattgagagtttttagcatgaagagttgttgaattttgtcaaaggccttttctgcatctattgagataatcatgtggtttttgtctttggttctgtttatgtgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagagaggattccctctttttctattgattggaatagtttcagaaggaatggtaccagttcctccttgtacctctggtagaatttggctgtgaatccatctggtcctggactctttttcgttggtaagctattgattattgccacaatttcagctcctgttattggtctattcagagattcaacttcttcctggtttagttttgggagagtgtatgtgtcgaggaatttatccatttcttctagattttctggtttatttgcatagaggtgtttgtagtattctctgatggtagtttgtatttctgtgggatcggtggtgatatcccctttgtcattttttattgcatctatttgattcttctctctttttttctttattagtcttgctagcagtctatcaattttgttgatcctttcaaaaaaccagctcctggatttgttaattttttgaagggttttttgtgtctctatttccttcagttctgctctgattttcgttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgtgtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttaatccagagttctagtttgattgcactgtggtctgagagatagtttgttataatttcttttacatttgctgaggagagctttacttccaactatgtggtcaattttggaatagatgtggtgtggtgctgaaaaaaatgtatattctgttgatttggggtggagagttgatttggggtggagagttctgtagatgtctattaggtccgcttggtgcagagctgagttccattcctgagtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgaattgatccctttaccattaagtaatggccttctttgtctcttttgatctttgttggtttaaagtctgttttatgagagactaggattgcaacccctgcctttttttgttttccatttgcttggtagatcttcctccatcctttcattttgagcctatgtggtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcgtagtcttgatggtctttacattttggcatgattttgcagtggctggtaccggttgttcctttccatgtttagcgcttccttcaggagctcttttagggcaggtctggtggtgacaaaatctctcagcagttgcctgtctgtgaagtattttatttctccttcacttatgaagcttagtttggctggatatcaaattctgggttgaaaattcttttaagaatgttgaatattggccaccactctcttctggcttgtagagtttctgccgagagatctgctgttagtctgatgggcttccctttgaggataacccgacctttctctctggctgcccctgacattttttccttcatttcaaccttggtgaatctgacaattatgtgtcttggtgttgctcttctcgaggagtatctttgtggcgttctctgtatttcctgaatctgaatgttggcctgccttgctagattggggaagttctcctggatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaactggatcccttccttacactttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgaccaatgggatctaattaaactaaagagcttctgcacagcaaaagaaactaccatcagagtgaacaggcaactacaaaatgggagaaaattttcgcaacctactcatctgacaaagggctaatatccagaatctacaatgaactcaaacaaatttacaagaaaaaaacaaacagccccatcaaaaagtgggcaaaggacatgaacagacacttctcaaaagaagacatttatgcagccaaaaaacacatgaaaaaatgctcaccatcactggccatcagagaaatgcaaatcaaaaccacgatgagataccatttcacaccagttagaatggcgatcattaaaaagtcaggaaacaaccggtgctggagaggatgtggagaaacaggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcagcattattcacgatagcaaagacttggaaccaacccaaatgtccaacaatgatagactggattaagaaaatgtggcacatatacaccatggaatactacacagccataaaaaatgatgagttcgcgtcctttgtagggacatggatgaaattggaaatcatcattctcagtaaactatcgcaagaacaaaaaaccaaacaccgcatattctcactcacaggtgggaattgaacaatgagaacacaaggacacaggaaggggaacatcacactctggggactgttgtggggtgggaggaggggggagggatagcactgggagatatacctaatgccctaatgctagctgacgagtttgtgggtgcagcgcaccagcatggcacatgtatacatatgtaactaacctgcacattgtgcacatgtaccctaaaacttaaagtataataataaataaataaataaagaatggcacattgtcaacaccgcatgggctggagggcaacactgtgtgggaggcaaaggcactcctgcctcagcgaaataggggtgtggatcaatttcctggtttgatgatgcactctagtgccccccctggaggaagctgggagatgggaaggggtctggatcaatttcctggtttaatgatgcactctagtgtcccccctggaggaagctgggagatgggaaggggtctggatcaatttcctcgtttgatgatgcactctagtgccccgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgtccccctggaggaagctgggagatgggaaggggtctggatcaatttcctggtttgatgatgcactctagtgccccaccctggaggaagctgggagatgggaaggggtctggatcaatttcctggtttgatgatgcactctagtgtccccctggaggaagctgggagatgggaaggggtctggatcaatttcctcgtttgatgatgcactctagtgtccccctggaggaagctgggagatgggaaggggtctggaccaatttcctcgtttgatgatgcactctagtgtccccctggaggaagctgggagatgggaaggggtctggatcaatttcctcgtttgatgatgcactctagtgccctgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgcccccccggaggaagctgggagatgggaaggggtctggatcaatttcctggtttgatgatgcactctagtgtcccccctggaggaagctgggagatgggaaggggtctggatcaatttcctggtttgatgatgcactctagtgccccccctggaggaagctgggagatgggaaggggtctggatcaatttcctggtttgatgatgcactctagtgtccccctggaggaagctgggagatgggaaggggtctggatcaatttcctgatttgatgatgcactctagtgtccccctggaggaagctgggagatgggaaggggtctggatcaatttcctcgtttgatgatgcactctagtgtccccctggaggaagctgggagatgggaaggggtctggatcaatttcctcgtttgatgatgcactctagtgtccccctggaggaagctgggagatgggaaggggtctggatcaatttcctggtttgatgatggactctactatgttagctgtcccctggaggacgctgggagatcagtacactgtacctcgctgtactaggtttataatttatgagcccataattatttcaaaatataaagttttttaaaaagtggttcagaagatgtggacctgcatgtgaagaagttttagaaatatctttatttattttgcctatagtttcctttttatgtatgcacaaaagtgatatatgatttgaaagaaactatgttggagtaagtgtgaagagctcatctcttaggtataaaatacagattccaagtgagtaaagaaaatggctacataattccaacgaactcatcttgttcagtctgccacaggccctgcccttgatgacgtcccacaggtcctgcccttgatgaggccccacaggacactcagaaagctgcatgaccaggcagtgccagggttccacctctatctgcagatgacgctgccctgccctgccctccccaccaacagcactcttctgcagtgaggagggacccttgaccctgccaccacagcacccgggtcctcttgcagcacttctagtgagctgaagcaagagaggaataatgggagagactgcctgaagtttccttttttcttacttttttcctgcagggctgcctcctgcctatggctacgttatgaacgtgctcagtttagatagtaggtgctggaattttggctaactggcatttccctttgcaccaagcaactgcccaaagggttgattctcagcttaaacactacactaagtcatttagcagtaatgtttgggccgggttctgagtgtgtgaattctgtccaaaagctgaagatgtttaagctatttcctcctggagtttggtggaataataaaaggttactgttgtcacagtgaggaggtctgcagctggtcccacttcctttcattactacccaatgtaaacagattaaatcgaaccgctcggatcaccagaagggacattccttatttctgctcctttctgttatgctttcagtgtccctcaggctcctttcagatgtcagtttttatcattgggaatatcttggcaactgattgctcaggccctcttgtaaacgaaataccttctttcaggttccctctctcttctcagcagcgaggcgtaaactgcagtagtgagcagggtgtgacccttaccttgagggccacatggctactgactgcagccatgaaatgggttaggtcacccacagagccggcagagaccttccctccaaccacctctggctgatttcaccactaacacctggtggggtccctcccccaccccaagaggtctgcttttgttgtgcaccccactctgggaagagggagatcctggggcgcccacctaatcagccaccagcaaggccagggctggtgacgcagcaggaggtaagggatggcgtgggtggaggcattagtcactggcatgtaagtgttattactaatcagtaatagcccatgaaatggtgggtggatcagctagattagggggtttagttgtttcttttgagatggagtctcactctgtcacccaggctatagtgcaatggcgtgatctcggctcactgtaacctccgcctcccaagttcacacgattctcctgcctcagcctcctgagtagctgggattacaggcatgcaccaccacgcccggctaattttgtatttttagtatggtttcaccatgttgtttagtatggtttcaacatagtttcaccatgttggtcaggctggttttgaactcctgacctcaggtgatcggcctgcctcagcctcccaaagtgctgggattacaggcatgagccaccattcccggccattttttttttaaattacataaaacctctggttcaaaaaaaaatttcatctgaaagcccacaatacaaaatgacttgcagctctccctctccctctccctctccccacggtctccctctccctctctttccacggtctccctctcatgctgagccgaagctggactgtactgctgccatctcggctcactgcaacctccctgcctgattctcctgactcagcctgccgagtgcctgcgattgcaggctcgcgccgccacacctgactggttttggtggagacggggtttcgctgggttggccaggccggtctccagcccctaaccgcaagtgatccgccagcctcggcctcccgaggtgccgggattgcagacggagtctcgttcactcagtgctcaatggtgcccaggctggagtgcaggggcgtgatctcagctcgctacaacctccacctcccagccgcctgccttggcctcccaaagtgccgagattgcagcctctgcccggccaccaccccgtctgggaagtgagaagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggctgcccattgtctgagatgtggggagcgcctctgccctgccgccccgtctgggatgtgaggagcacctctgcccggccgcgacccggtctgggaggtgaggagcatttctgcccggccgccccgtctgagaagtgaggagaccctctgcccggcaaccgccccgtctgagaagtgaggagcccctccgcccggcagccgccccgtctgagaagtgaggagcctctctgcccggcagccaccccgtctgggaagtgaggagcgtctccgcccggcagccaccccgtccgggagggaggtgggggggtcagccccatgcccggccagccgccccgtccgggaggtgaggggcgcctctgcccagccgcccctactgggaagtgaggagcccctctgccaggccagccgccccgtccgggagggaggtgggggggggggtcagcccccaacccggccagccgccccatccgggaggtgaggggcgcctctgcccagccacccctactgggaagtgaggagcccctctgccaggccagccgccccgtccgggagggaggtgggggggtcagccccccgcccggccagccgccccgcccgggaggtgaggggcgcctctgcccggccgcccctactgggaagtgaggagcccctctgcccggccaccaccctgtctgggaggtgtacccaacagctcattgagaacgggccatgatgacaatggcggctttgtggaatagaaagtggggaaaggtggggaaaagattgagaaatcggatggttgccgtgtctgtgtagagagaagtagacatgggagacttttcattttgttctgtactaagaaaacttcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaacaaaaacaaaatgacttgcgataaaactgctctgatcgcagggatctaggtctctggcctcctcctaacttccacagtgacatctgatggggcaccaaggaatacagtttgaaaaccattagctctcactaaagacaagctagggaagtctaaagagagaataacctactgaaggtcacatggtcagtcggttaatggccgacaagagtccagcattttcccagcacctgactctgctttaccccatgtactggtcagatgtcagtgttctgtgttcttagaatgagcaggtcttggtccttacaacagtaacttcaagctttcataggaggaaaaagttccaagaaaaaggaaaattacattttacctggcaaaactgattttgtaggtaatggggcctatcttaatccaatttaataacatccagagatgactagcgaaaagaataacttttcctggcaacactgcaagcatctgagtgtttaactgcacaatttcggacatgaccatggcagctactagcattcgtgagacatcagggctctgcaaatggctctcctgcgcaaagcatgctcacagggcagaggtggccctgtgtgggtggaggacatgccagaagcatgggctctacacccagagccttctttccaccctagtccctgctcccaaaatgcaattgagaactgcatttaattagttacaagaaactgtttgttttcttccatgccagtcaatactatgacggctttaaatcaactgcatctaatcctataaatacatctccgggatggagcctcctcaagatgtcccatcagttttgttcatttacttctattcctgagattcagttctatgtcctctactcttcaatgagacatgagtccatcaacaaaatagcactgggaaaggaattctagtttctgacattgagacctggcttccagtttaagctcctccacttccaagctgtgcaaccctgggccaaccacttaacctctctgagctgcagtttcatcacctataaagcaagaggcaggaattgtgacgataacataaagcatgtaaaagaatttaaaagtgcaaaggactataaaagtgtgagtatccattctattacaatcatttaatcaagggaccagacacatttgattgcatcatttcagaactgctcctggaagctctgctctcttggctcctgcccttgtggtgctgggaaagaatgaatgcagggctagctgcaaagtacatggttacaggtttctcagagctggtcctcccagccagcctcccttttggtggtgtctggagcaaaacaataccgtaaaataatcctccagcagccaagtgtagacaattaaaaacagggatcactaatctagaagggaaacgttctgatttattgctctaacctcccttgtcataacatggcagttaaccaaaaacaccattctgtaggatgaagggagaggaaatttagacttggacagaaaaatccaaaggaaattaaagtgttagtgtgctctgaaaagtaactcttcaaatatgccactggccaccttgacatttccaggcctccccaatggcttccagacctaaagtgatcagcttacactgcatggaggcctctcctagccgagggtgctgctggcttcccggggattgttcagcctctctcatcatcactgtaccagatgacagtcaaaccaaaaactcagctgacaagctcaggagatgctgaatgaggcagagcagaactctcctggccccaccacagtggctaatgaagcttgtgtgtgtcctggaggcggggctcttcaggagcagagatgtgggcagggaagtctgccctttcatggagttttctacatgcactttcagataaaggccttctgtaaagaccacaacagctgtcatctctgaacgtggccaagagccaaaggatcgtatctggagcaagcagaccgattttcagaaacgcacattgggtaggttacccgtggtgacgcaaaccagacttacttgatctaaatctcctttctccgttgccagttcctccatctctggtgttggctcatcttccaggaagggattggtagatgggggtggagactcaagctttttctgttaggtagatatgagaaagagaagtgttttctgagcatattcaatagctttccccattgatctgctttttctaggtgtctccaacaaggaagtcatgcacgctatctgataaagaagaactgaggcaacccagaccacattcttgcctccgggccttcacagtgctttccctcttcctgcaacctccccgaccaccccgccccaactcgaatctggctaaaacgctcacgcatcctcagtcctcaaaccggaactccgttctgctgggaagcctttcccatctgtcaggtttgggtcagatgtccctgacacgtgttcccaaaccaagctacatgtctcctacccaggcatttattaaaatatagcaattgcccattatttgtcttttcccttctggcctccatgatggcagagattgtgtctgtcttgttccccatcctatctcagtgcctagcatgtagcaggtcctcagtaaatagaaatgaatcaaagtgccagatggatttcaacgcaagaacaaactacaaaactaatctcatgtgttctagattaacagatgtctcttcccaagtaagccccattacaacaaccacaacagaaatctccttgagaaaatcgacttctcagcttccaaatatgaccactatttcaaaatacatcacggagtggaaacatgggccagtgggaaggctgcaggcaggaggcatggtagctgtagctccaaccgtgcggcactggccctatcacccagcttctctgagcctcagtaacttcatctgctgaatgaggatgtagtcacaggactatctggaggatcaaatgtgaaaccctagaagcagcacatgatacacacaagggtcactgatgacgttaattccagtacaactacagaatcaaggcagctctctggaattcctttacagttttcacctagagatgttgtttatgcctgggagctgaaggctttagcagaaaggaggccaactggacaaacagaaaagagggactgcttggtgctggggacgagggaagggggcaaggcatggctctctggagacgagaagttaatggagagggagtttctaaatgtacttggtattttagccaataccagtgggtcaatctgaattaatctctaagccaaaagggacagcagatggactatagcgtgaataactttgccaagtgccaggacaccatctgaagctattacaaacaaaaataaaaccaaaacttacacaaaggccgggtgcagtggctcacacctggaatcccagcactttgggaggctgaggcggcggatcacttgaggtcaggagttcaagaccagcctgaacaacatggtgaaagcctgtctctactaaaaataccaaaattagcagcgtggtggtaggcgcctgtaatcccagctacttgggaggctgaggcacaagaattgcttgaatccaggaagtggaggttgcagtgagccaagatggcaccactgcactccagcctgggtgacaaagcgagactccgtctcaaaaataaaatacaataaaataaatacattgcacaaaagcactacacctgcgtctggtttttggtttaagacaatactgctaacagtcatttaataactgcttattttttggccaaaacacttggatgcaagtgatgtggacagatacagcctcggtgcatgacaaagccttgtggtgatggcattagctcgaggtaatcagtagtaagatgatggtttttgtggtatcctggtgataaacaatatggtctaacacccaagcaagtatttcacatttgcacactccaaactttggcttctttacctaacatgagagaaaaaaaatccttaaaaatgtacagctcttgttagaaagcagtatttctaagcttgagttgtcttcttaagggctgctgatattttagagagagaggaatagtaataaagggaatctaccaagcttaatcttcaacaaccataaaaaaattaaattaggtaatagcattagactcctgattccactggcttaacagtgggctctgggattatgctgttgagctgagtcactatgattctaagtcttttggtcctttgtagatatgaaaagcaagtcagctaactgaagttaaaagctttgatcaaaatcattcagtgacagacacagaatttgagtttttgaactaaatgcccctcatctattgctaagtctattgggttgataacagcacctcacaattacataaagatgggcctcgtttttaaaacataatgtgttattggaaatcatggcaaacagcagatgtcagtgacgtggactgagaacgttcccgggctctgctctcgctggcataaagcatcaagaaaacgcagagggtaggaagaagtcaaacctactctcactggcgtaaagcatcaagaaaacgcagagggtaggaagaagtcgagcctactctcgctggcgtaaagcatcaagaaaacgcagagggtaggaagaagttgaacctactctcgccggtgtaaagcatcaagaaaacggagaggggaggaagaagtcgaacctaacgggcagccctgaagaagcaggcaccatctgaggcaggtgagcacaggccactcgctcagtgtcaccatctgggatagagtgagcatgggccaacctcagcctcctgagtagctgggactacaggtgcacatcaccacacccaagtaatttttgtattttttgtagagatgggattttgccatgttgcctgggctggtctgaaactcctgacctgaagcaatccatctgtctcagcctcccaaagtgctagaattacaggcgtgagccaccatgcccgtcctctattaacatgaggggagttgtggacatcaaggagctcctagctcactcatttgtggcacatgcattccacatgtggaccaagttagtacaggaaaagtgattcattccttccctcatccactcaacaaagggatatgcttggccctaggagtagagcagtgagaaagacaggccagcctccgccctcatggagattagagtctgctgggggagacagccttcaatccaacagtcacacaaacagtgagaagggccaggaaggaaaagcagtcgtcatggaaacgtgcaacagagggccgcagccgtccctaaagaaaagatgtctgagccagagctgaaggatgcctcagagtgaaatatatgaggggtggagggcggagggaacagcacgtgtctgccgctcactcaacaatgatgtactgggcatccactctgctccaggcactcttgggtgcaccagggatgcaagtgaggaagatggattagagaggcggcactgtagtggtgagaagaaaactcagggagtgggatgagctggggatgagggtgggaaagtgcttctacacacagggtcatcagaaaaggtctctgaggagatgacggctgagctgagtaagaaggaactgctcaggcaaaacccaaggaagggtgttctcagcagggagacccggtggagacgctggaaagcatatggtgagtctgagggacagaaaggaagatgggggcctggggtaagaggggtggcgggagtcccatcatattggtgaatcagggatggaaaggaagatgggggcctggggtaagaggggtggcgggagtcccatcatattggtgagtcagggacggaaacaaagatgggggcctggggtaagaggggtggcgagagtcccatcatattggtgagtcagggacagaaaggaagatgggggcctggggtaagaggggtggcgggagtcccatcatattggtgagtcagggacggaaacgaagatgggggcctggggtaagaggggtggcaagagtcgcatcatattggtgagtcagggacagaaaggaagatgggggcctggggtaagaggggtggcgggagccccatcacgcagccttttgtgggccatggtaagggtcggttttcttctcactgcaattgggcagtcgctggtagttttcaacagcgaagtgatgtgatctaatttggattttaaaaatattccactgctgtaggggaatggattataatgacagcaggcaaaccagtttaagaggctgctacagtgctccaggaaagggctgatgggaaccggactaagccagtgttccaggaaagggctgatggggaactggactaagctggtgatggacgatagaaaaaagtgtccatcggatttggggcacagttaggaggcagagccaggaggctttgctgagagagtgagaacgagggtgagggaatgaaaggagtgaagggacagtcactttctggtctgagcaactgcacggctgatgttgcccttaactgagatggggcaccctcgtgtagtggcaagggcacaggctccgtatctgacagacccgggttcgagtccaggttccaccatggggtatgctgtttaacttctagcctcagttctcctacctgcaatgtgaagggataggaatacctacctcgtatggctgccatgaggatgggatgaggcatgcgtgtcaggcgtgagctacacagttacgtgctgccatgaggatgggatgatgcgtgcgtgtcaggcgtgagctacacagtcatgcaccacatcaccatgtttccatccatgacgggccacggtacaaggcggttccactagattataatggagccatacaatagagtaggccaggggtccccaacccctgggccacagtccatggcctgttagcaaccaggctgcatatcacgaggtgagcagcagtgagtgagcatgactgcctgggctccgcctcctgtcaggtctcataggcaaaccctgttgtgagctgctcatatgagaggtctaggttgcacactccttctgagaatccaatgcctgatgatctgaggtagaacagtttcatctcgaaaccatcccctacccccatcccctgcactcccacccccacccccacctctggaaaaactgtcttccacaaaaccagtccctggtgccaaaaaggttggggacagctggagtaggttctagcaggcacactctatgaggtttgcacagtgatgaaactaatgatgcatttctcagaacatattcctgctgttaagcaatgcatgactgaatatatacagcagcttaacatgctgtctggcacagagggcaaggctcagcaaggggaagctttgagcagtaattaatagggtgagctacgaaacaaggcaaaactgttgtgcttctcttaataaagcagctcacagaaaacgtgggcatgcaggcttaaaagtcttgtcaaaagaatttctattaaccataagtggagcctcgtcccaactactttgtctctttgggatctctctaagaaataaaagcaaagggcccatcaactttgcactttctaagtggaaaggcacacggagctgctcctttcttccccagtctacaacaacgcacataccaccctcctccctgttgataaaagtcctaaaaccctaaggtgtggatatgcattcccgctagttagagggctacattactgctcagactgacttgctaagatgaaagaacaagtccttgtggggagcgatcactggcataacgcagccttctgtgctaagagccacacagatcacgcttctcaggcttgctttgcagctgtcacaggccacagagaattacaactttggggttagattgtcagtaactcaaaggacatatttcatgaactctgaggctgctaaataaagccaaaaatttccaagaagtgaatgacttccaattttgaaagaattcattctttttgctatgatgacagttgatttcaagccgatataggaaagcaaaattcttcatatagcaagttaatccctactgattaaatcacaggggattcccagcaccttcaaaacagttcagaccacaggacagtcaggctgtctaattcactgtcaagaagggaaagtctggcttcagtcagcagtacatccgtatctcgtctgcctacacaaatccctgtgtgaggccctagctggacacatcgaattatcaaagaaggaactctgaaatttaagactcttcctttccctagaggggaaagctttcgcttgtgagatgaaagttcctcagtttctgcatttctcactccataaatgctttactccagcccaattcctaattggtccttaaagagatggctgcggggctttagctgacagtcaggactgcaagcccaggggttcacacacttggtgtccaccatttctggggctactctcttgctaccgccatgtccacttcttctattgcaacagttatgtacagacttctttctcctactagaccctaagtgccttcccgatccaatttctcatcttttccaaagccctgaacaaagagggaagcttgaaaaatataagtgggtaaatgctgatcagatgaaaggccctcaataaaatcctcttcagaaacatgggcaacactttctattttctgtaaacaaaacaaaaagcctgcgtatatgtgtgcaagcgtgcttgcagaagcgtcaaaaatataccccaaagaattaaacagtgtggatacctccagggggagggatatacagtagttaagaagagatgtttatttaaaatttttttttctatttgagtttttaataggcatatatagctatttctgcttttttcttttcttttcttttctttttttttttgaaacagagcctcactcttccacccaggatgaagtgcagtggtgcaatcacagctcactgcagtcttgaactcctggacttaggtgacccttgcacctcagcctcctgagtagctaagaatgcaagtgcacactaccacgccctgctcattttaaaatttttttttagagacagggtcttcgtggcccaggctggtctcaaactcctggctgtaagagacctgcccacctcggcctcccaaagcgctgggattttaggcatgagccattatgcccggcccactgctcatttttttttttgacagaatatttatctgaagagtaaagatgatttataactaaactcatacactatcttctaaagcctttaattctaaattgtgatgtaattcatgtcacataaaactcaacattttaaagtgatttactattcagtggttttcggacattcacaaggttgtgcagccatcaccaccaattccagaacatttttcacccccaaaagcaacccctacctgttactgggaagctgttacttcccagtcttccccttcccaaccccatcggcctctatggatttgcctcttttgggtatttcctatagatggaatcatataatgtgtgacatctgtgtctggcttctttcactcggcatggtgtgtccaaggttcacccaggtcagggcacgtatcagcacttcattccttttacgtgaataatattccactgtacggacagaccacgttttggttattccttgtctactgatgtttctactttttggctattgtgaatagtgttgctatgaacatttgtgtaagacatacgaacatatgtttttaattcccttgggcatatacttagaagtagaaatgtgtaattaaaaaaaaagaattcagattgctttgctttttctatttggcagagttaccccttcacattaggcatggcacattaacactgtgagatgcactgaaacaagcagggactacttttaaatcttaactgcatttggaagaacagaaaggaagaggaacagaaagatgtttaaagcagaggctgaaattgaaagtgctcacaacttgagccgataattccactagtgtcgtaagaaaatcatctcactgctttgggtaagagacagcgaagaggagagaagagagaagagaagagaggaaaaaaacaatctcaaatgcatataaaattagtagacaaggccgggtgcggtggctcacgcctgtaatcccagcactttgggaggccgaggtgggcggatcacgaggtcaggagatcgagaccctcctggctaacatggtgaaaccgtctctactaaaaatataaaaaaaaaaattagccaggcgtggtggcgggcgcctgtagtcccagctacgcggaggctgaggcaggagaatggcgtgaacccaggaggcagagcttgcagtgagccgagatcgcgccactgcactcgagcctgggcgacagagtgagactccgtcacacacacacacacacacacacacacacacacacacacacacacacacacaaattagtagacaaaaatattcatatagccctatttataaaagtgagaaaaaactaagggtcctacgagaaaagaataattaggggaatcactgagtatctatagaataaaatctttctgtagtagttgagaaacaacttaagctgtgacatatgaagcatattttcatatgtgtgtgtgagttaatatggaaattaactcaaaatggatcaaagatataaatgtagcagctgaaactataaaactcttaggaggaaacctaggtaagtctctgtagccttggattacgtaacagtttcttggatatgacactaaacacaagcaagaacaaaaaaccttcattaaaacggaaatcctgtgaaatgactatcaagagagtgaaaacccacagatgggagaaaacattggcaaatcatatgtctgatacatgataaaatatctaaagaagttataaagcctgggcatggtggctcacgcctataatcccagcactatgagaggtcgaggcgggtggatcacttgaggccaggagttcaagaccagcctggccaacacggcaaaaccccgcctctactaaaaaaaaaaaaaaaaaatacaaaaaatacaaaaattagcctggcatggtgctgcgctcctgtggtcccagctacccaggagactgaggtccgagaattgcttgaacccaggaggcagaggttgcagtgagccgagatctcaccactgaactccagcctgggcaacagagtgagactctgtctcaagaaaaaaaaaaaaaagttatagaatatatctagaatgtgtaaacaactcttacaactcaacaataaaaacaatccaactaaaaaatgggcaaaaaatgtgaatagacatttccttttttttgagacatgagtggcgcaatctcagctcactgaaacctccacctcctgggttcaagcgattctcctgcctcagcctcccgagtagctgggattataggcacccgccaccacgcctggctaagttttgtatttttagtacagacggggtttcaccatgttggccaggctggtcttgaactcctgacctgaggtgatgctcccacctcggcctcccacagtgctgggattacaggcgtgagccaccacacccagctgaatagacatttctttaaagaagctgtgcaatgtcactagtcaatgggaaaaagcaaatgaaaaccacaaggagatactactctacacccatgagaatggctataattaggggaacaaaggagacacgcgtcagcaaggatatggggaaactggaccctcctacattgtgggtagaaatgtaaaaccgtgtggctgcttcgaaaacagtttgcagttcctcaaaaagttaagcctagggttaccatgtgacccagcaattccactcaggtatattctcacaagaataggaaacacgctgacacgaaaacctgtacaaatattcacagcagtattcatacagtgaaaacctgtaccgatattcacagcagtattcacatagtgagttcacacagtgaaaacctgtacaaatattcacatagtgagttcacatagtgaaaacctgtacaaatattcacatagtgagttcacacagtgaaaacctgcacagatattcacagcagtattcaaatagtgaattcacacagtgaaaacctgtacaaatattcacatagtgagttcatacagtgaaaacctgtactgatattcacagcagtattcacatagtgagttcacacagtgaaaacctgtacagatattcacatagttcacacagtgaaaacctgtacagatattcacagcagtattcaaatagtgaattcacacagtgaaaacctgtacaaatattcacagtgagttcacacagtgaaaacctgtaaaaatattcacatagtgagttcacacagtgaaaacctgtacagatactcacagcagtattcaaatagtgaattcacacagtgaaaacctgtacaaatattcatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtaatcaaatagtgaattcacacagtgaaaacctgtacaaatattcatatagtgagttcacacagcgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtattcaaatagtgaattcacacagtgaaaacctgtacaaatattcacatagttcacacagtgaaaacctgcacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtaatcaaatagtgaattcacacagtgaaaacctgcacagatattcacagcagtattcaaatagtgaattcacacagtgaaaacctgtacaaatattcacatagtgagttcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcatagcagtattcaaatagtgaattcacacagtgaaaacctgtacaaatattcacagtgagttcacacagtgaaaacctgtacagatactcacagcagtattcacacagtgaaaaagtggaaaccacccgaatgtccacagctgatggaagagacaacaatatgtgcatcacccacacaacggtgcactattcagccatcaaaatgatgcactgacacacacctcatcatgggtaaggctcgcagacactgtccagagggagggaaggcagacacaaaaaccacacatcgtagcatccgtttatgtgaagtgtccacaacaggcatccgtaaagacaaaagtcaattcgtaactgcccaggactggggaaagagaacttgaaagtcctgcctgctaaggagggatttcttctggggtaacagaaatgtcctggagttgcacagctgggatcgtggcatcatcttatgaatatatgaaaaccaactgaactgtatactttaaacgataaatttcatgtgacatttcgtgacatgagttatatctcaattttaaaaactaggcagagaaaactgtatttaaaaaaatacaatttcaaccatgtaaaatatatagaaagaatatacccaaatcctcatctctgatttggatgacttttttcctgcttctctattctcgccataatttccaaattttctatcctgaccctgtattattctcttctcagaaacagaagttaatcgtcccttgcaatattattcaaatggaagaatacatttctttagcaccagtaaagcatccataaaatattttccaacgctgaagggagtgcatgaggcgggggaatctgtcactgtcggagacagatgtcctcaagctgtggcagagctggaaaacctgcccctgttccttacacagtctccctcatgcaggtgccggaagaccagggtgtagagtgagacatgctgggtggtctttcatgagtcgtgagccttttgcaaacgctcttacactcaaattccatggctgacaattgtacccatatagcttctatctttagaatgtaattctaaaaactggggaagtaaaggcccctataagccaaaggacaagtctgtttcaaaaggcaacttatgcagtggtcaagaggaagggaaatccagctgcataaaaggggaacatttttaattttattactacaaaaaaaacaaaaaacaaaacaaaaacctcccagtgaggcagttataaaaagctaatccgatctagtctgcttttctgctttcagcagaaggctgaatgtcatttgctcaccttgaatctaatcatcaagtcactaataatgcatatggatccagttacatcacatccagacattctcttttaatttcaaggcattttaatttatagactctcttgaattcctcctaaagggtcagaagttgaggcaactgggaaaagcacaggcagctcacctcctcaagtaacagttacagcacaggacatcgtgaaactggttaagcaacaagcctgtccctgaggctctttcagtctaaagttctatcaaatgttgaagtcacagctcttgaaaaagagccaaggatgatgcatcccactgaagtcaggagtgatgggtcaggaggagctgagctgtggcaggtcttgtcttccgggcgagctggccacactctcaagctcatcctcactgtttcactgccagtcaccaaggactggagaggtttggaatgatacagtgaaggcggcagtgggggtagggtggggatgacgtacagcctagggaggggcagcaagggagagtctctggccgttttggctccttggctgacatcttacctgttttgtggcacctttctgaggaattcagtaactttctataaaatctggcatatatcaaagggtatcaagatataccttggttcgtttcacaatttattctggtattttgaaacaaaatggtagccaaaaaggagtttccaaagagtgtatcctgaaaggaaggtagcatggggaaggggtcaggggccagggagcagcatatctccaggcagggtacccagcagctagactgggggtcaggacagctggaactcctggccttgcccaggcagccccttcccggtgctttgcgttgggagcatggtcggtagccatgatgaattcaccaaggtccctgccactgagggtcgcagaataaaggtgaagaaggtcgtgcacggcccacaatgagatgatggtggggaccaggctcagtgtgaacatcagctagagtgacagccttcacgtctcctcacagcagagctgcagtgaaccgattcctcaaggcccgtcccacctgggtaaagtggccatagggcttctgttgccttcctagaaacttatctttaagggaaaacccttgaaggatatcagacagccattttcaggatttggaatgcagaataactgccaggtcgtgatacctggcacaaagaatagggtaggaggacgaagttgaattaaagaagctgaaggatttagagaagtctgtggagaggagagctgactaaatagagagggaaagaaagaactcatggtgttcatcaggcttttctggctaaggatttagaacctgaaactctgcaaacttgagaggagaggagagcaacaactgaacaatgaagaggggatgatttaaagaccagttctgccaaaacatttcaaatatgaaaaccaaaaaggaaggagctggggaaaaaggctcaagtgttcctagctgacccctgaccaccaccacagagcaccacctcggccaggagacactgggctccaggccaggagcttggccctggccgagtgagttcaggcagaaaggggctgtgctgccctgagaaaccagtacccccagcccagtcctcccgggacagaaggtgtctgacagttggccaactgccattctgacagtcctgtacctgtgttttacaataaagcattgtctttgcaaacttgagtaagctcctgtcagtttttcatggtctctacgtggttaccctgttcagctgcctcagcttgtccagaagggccttccctgccctcgttcccttaccacttttggcctttgggggatttttccttggagaggtcctgggacagacccaggttcacaggctaccctggtcctcagatgcaacagggccatttgttcctctgtggtcctatagctccctaaatgtaaaagacaaatcaccaggaagtagggcccagccagagagggtgaagaatggctcaaaacaagtgcttggcaagaatgtcattcaagcatccttcactgggacctatttcccgtccggttatctggattaccagctcacagagcctgtcctgatgctctccggaccctgcccagccagaggccgtgggagctcagggggctactcccagggtggggcctgtgctcaatgctgaaccctcatgcttgtcgccgggcagatctccgtagggctgaatccagtgccacatatatctacgcttgaaaccaggcaggagcatggcttgggaaggtccgagaggagagccagcaagaggaatcagggggctgctaaagccaacctcatacttctcaggagaaactcaggattccttcagtgggatctctgttcctatttcctttccttttctgtttttttgagacagtctcactttgtcacccagactggagtgcagtggtgcaatctcagttcattgcaacctctgccttctgggctaaagtgatcctcctgtctcagcctctcaggtagctgggactacaggcgtgcgccaccacgccccactaatatttcccgggtagctgggactacaggcgtgcgccatcaggccccgctattatttcccaggtagctgggactacaggcatgcaccaccacgccccactaatatttcccgggtagctgggactacaggcatgcgccatcaggccccgctattatttcccaggtagctgggactacaggcatgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcaccaccacgccccactaatgtttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatgtttcccgggtagctgggactacaggcgtgcgccaccacgccccactaatatttcccgggtagctgggactacaggcgtgcaccaccacgcctgctaatatttcccgggtagctgggactacaggcgtgcgccaccacgccccactaatatttcctgggtagctgggactacaggggtgcaccaccacgccccactaatatttcccgggtagctgggactacaggcgtgcaccaccacgccccactaatatttcccgggtagctgggacgacaggcgtgcgccactacgccccactaatatttcccgggtagctgggactacaggcatgcgccaccacaccccactaatatttcctgggtagctgggactacaggcatgcgccatcaggccccgctattatttcccaggtagctgggactacaggcatgcaccaccatgcccagctaatatttcccgggtagctgggactacaggtgcccacgacacctgctaatatttcttgggtagctgggactacaggcatgcaccaccatgcctgttaatatttcctgggtagctgggactacaggcgtgcaccaccatgccccgctaatatttcccgggtaactgtgactacaggcgcccaccaggcctgctaatatttcctgggtagcagggactacacgtgtgcaccaccacacctgctaatatttcccgggtagctgggactacaggcgcccaccacgcctgctaatattttctgggtagctgggactacaggcgcccaccacgcctgctaatatttcctgggtagctgggactacacgtgtgcaccaccacgcctgctaatatttcccgggtagctgggactacaggcgcacaccaccacgccccgctaatatttcccgggtagctgggactacaggcgtgcaccaccacgcccagctaatatttcccgggtagctgggactacaggtgtgcaccaccacgcctgctaatatttcccaggtagctgggactacaggtgcccacgacgcctgctaatatttcccgggtagctgggactacaggtgcccacgacgcctgctaatatttcctgggtagctaggactacacgtgtgcaccaccacacctgctaatattttccgggtagctgggactacaggcgcgcaccaccacgccccgctaatatttcccgggtagctgggactacaggcgcgcaccaccatgccccgctaatatttcccgggtagctgggactacaggcgtgcaccaccacaccccactaatattttccgggtagctgggactacaggcgtgcaccaccacgcctgcttatatttcccggatagctgggactacaggcgtgcaccaccacaccccgctaatatttcccgggtagctgggactacaggcatgcaccaccacaccccgctaatatttcccgggtagctgggactacaggcgtgcaccaccacaccccgctaatatttcccgggtagctgggactacaggcgtgcaccaccacaccccgctaatatttcccgggtagctgggactacaggcgtgtaccaccacaccccgctaatatttcccgggtagctgggactacaggcgtgcaccaccacgccccgctaatatttcccgggtagctgggactacaggcgtgcaccaccacgccccgctaatatttcccgggtagctgggactacaggcgtgcaccaccacgccccgctaatatttcccgggtagatgggactacaggcgtgcgccaccacgccccgctagtatttcccgggtagctgggactacaggcgtgcgccaccacgccccgctagtatttccttttctgacctgcattttctttaaggctattttcacctgttttgtgacccatttttttcccttgttactaaaaagaaatcaatattgaacattagttagcaagcagagaagtatacatatttttgatgtgctaagtaggaaaagagtgctttgtggtttcagctgcattttattctaataaagtcgtgagtgagcccaagtaggcaggaccttgtggtctggcctcaaaattgggctgctgccaccaccgctctgcagtccattgcctgaaaggccagcccgattcacctgctccaccctgtctaaagaccagcccgattcacccgcttcacctgctctgaggctggtctcatgggacaaagagggaattgcactgaagtctcagggttttaggaccagaagggtaggagctagagaaggtggcagaggtgaaggttgaacaagtgagtgggactccaggtacaagtcccagcctgcccccggcttcaaccacagtagctcagtttcacggtcttacacattagctccgtggcctggagtaagtttcaaatgagcacagcgcctacttcctatggctgatgaagcacagtgactgactgcaggtaaacgcacctaatatagcgtgggtcaccaagtggatgttcaaagcatgacagctatgggtgtttcagattctacattctattttttttttttttttgagatggagtctcactctgtcgcccaggctggagtgcagtggcgcaaccttggcagcacccaccaccacgcctgactaattttttgtatttttagtcgtgatggggttttgtcacggtagccaggctgctctcaaactcctgaccttaagtgatcatcccacctcagcctctcaaagtgctgggattataggcatgagccaccgcacccggcctctacattagattttgttacaagaaaggatttggaaatcactgatttggcccatctctctcattttaaaacaattgaaaaataactttgttaaagtacacacaaagtatgtaaatgcatttgtataagaaaatttccaaaaaaactataccagagtaaatggaaaaaaatatttccttgcttctctacctactctcactccaacttccttcccaagagacatccactgttaccatttccagacctctttcttatacatttacacacataaacatgctttttactttttccataaaagacattatacctcccaaagtgctgggatgacaggcgtgagctgctgcgtccggcccccgttctaccacttttaaactgctgtgtagcatctcacagtatggatgcactgtaatttatttaaccatcttcaataataaacattacagacacagccaagccttttgcttttaaggctgcagttcacctctttctttgtgcatcttcctctacatgtatggatttttttttagacttctggtttagatgtaaaattgttgcttgacaggacatgcatatttacatttctgaaagttctgataatgacaatttatgcaccaaaaaggttgtatcaagctgtatactagccctaaaatcctgtactgttagtcttgtaatttttttctgtttgcaaacctgatgtaggaaaaatatcctgttttcttttttttcatgtttattagccaactgaatttcttcagtcaatcgtctgtctgactctgtactcatttttctaacgggttactcgtattttccttatggatttttaggagttctttacatgtgctagatattaatcgtttgtgtcatgcagcttcaactgttttttaatcccttgattatgtttctggtctctttttccaaaagaacgttgttctctttatgttgttaaaccttttagtacttttcttcatggcttttgggttttatgtcttatttagtctccctaatattctgttattaaaggataggtgggcatggtggctcacacctggaatcccagcactttgggaggccgaggcgggcagatcacctgaggtcaggagtttgagaccagcctggtcaacatggtgaaaccccgtctctactaaaaatacaaaaattagccaggcttagtggtgtgcacctgtaatcccagctacccaggaggctgaggcaggagaattgcttgaacctgggaggcagaggttgcagtgggccgatatcgccccactgcactccagcctgctgacagagcaagactctgtctaaaaaacaaaatgaaaaaacaaaaaaataaaaaaataaaggatagtcttttcttctcatttaacagggaaggcagttcactacattacagcagaatcgggattagaccacaagtcttgactgctggtccaaggattttgctactaaatcactttgcttctctattgttacccgcagtttaaaaaaaaaaaacaaatctagctctaaagaaaattcaaaggtatgattctctcaacttggatttcttcttccctccctcctttcttctttccccttccattcctgcctgcatgggttctgtgtacactctgcacgactcgaggagacggatgagtcagctacaattcctgtattcaaggagctcaatgtctacgcatatgtaatgatgcaaacagaaattaccatagaacagagtcacttggtttcccagtggacaggaaatctgaagagagcaccttgatgtgttagcagggagcctgggcctccaaagagaagaggtttactcctttctctttcttttctttttttttagagatagggtgtcactctgtcactcatcatagctcactgcagcctcaactcctgggctgaagtgatcctcctgcctcagcctcccaagtgattgggactaaggggtgcacccgactaatttttttttttttgtagggatgaggtctcactatgttgcccaggctggtctcgaactcctggtctcaagcaatcctgccttggcctcccaaagtgctgggattatacaggtgtgagccactgcatcagaccaaaaagaagaggtttccggagtgaaaatttggacctggtctttgactacacagagacaaacgtttaaccggcagtactatgttccacctttccaatggaggcacgtagtccccaggcctgtatacctggctttggggtttacagagactcattgacctagtttgttcaccagagatgttaaaaggtaaaccctaaagtaaaaacatatcctaattgtaaccaaatctgataactgataaagaaataaggtatttgtgactgagtaaggcctctgactcacaaaattactagtctgtaaaatgggatcaatacttaagaaaaatgatgacagggcattctagaaacatgatgtactgcgtaagagacaaacaataaatccacacagagtgttctgtatcatcactttcccagcagctcagtgaaatcactgcaatgaggggttaagcaccgaagccaatggatagagtcaccatacagtgaaaccctgaatcccaaccacccaacccactgatttcacgtggcagctccctagggaaggtcttaccagggtcccatcggtcagggtgcagccggagaagcgttttgcaagaaacccctcaaagttagttgttctttgaatagcaaaaagaagcaatttcacttcaatttccttcgctctggtacgcataatcttggcaagttctgcccttcaaaacaaagagataagaatactatcaaacaagctgatcattcattcagtagagataaggtaaatggccttagcttatattcagaaaaaaaaaatgtatgtggtcatttcaaaccctgaggtctgttaccaccttagtctaaaacctggggaatagaaatacatattctaaacaagatttttaaggtgaaattatccaccaggcaaaaaaatcaggggtcatggatgatatatatatacttatatttatttgtttgtttatttatttatttatttatttgagatggagtctccctctgtcgcccaggctggaacctccacctcctgggttcaaatgattcttttttttttttgtatttttagtagagatagtgtttcaccatgttggccaggctggtctcaaactcctgacctcaagagatccgcccacctcggcctcccaaagtgctgggattataggtgtgagccaccagtaatttggttacatagttactacgttgcctgtatctttgaacagtttaataattggataataatacatatggagcacctaattttttattagtgtatatagcctatataatttcacaagtcattaattactgaattataaagccctccctcttcctgagggcccaataatcatctcttcaactagagagcaggagtcctggaaacacacgcaagggacaggatccctgcgggaaaagtggcaagcacgcttagctggtccctgcccgagaagctcctgtgcagctctcactcaaacgttccatctcagaagctcagttgctggtgaacagggacatgtgagttcttagtaaggactaagctaccatcttctcacacaaataaatgacaaaatgaaacaaagagtctctgagtttatttgagaatgatgtatctgtaggattttagccaaaattctaacaatagaagcttggcagcaacactgccattagccgagacaacaatggcaggtactggcgctcacaagaaacgtgctggctctagcatacgtccagcctctcccaggctccatttctcactgagctggtttgcaagtctgctgaactgtaggctaaaaagaattagctaacagtttctcaaggaattcactctttattttgttaattgggatttagaaggtgacaatctcaactcatcttaaaccaatgctaaaaggttctctaaatctacaggagtcaatgtgtttctttttttttcttcctctttctttctttttcccttccactcgccctccctccctccctccctcccttcctcacttccttccttctctgtctttctctctcttctttttttttttttgagacagggtctcactctgtcacccagggctggagtgcaatggcatgataatggcctactgcaaccttgacctgggctcaagcaatcctcccacctcagcctctctagtagctgggattacaggtgcttgccaccatgaccagctaatttttgcattttttgtagagatggggttttgccatgttgcccaggcttgtctcaaactcctaggctcatatgatccacctgccttggcctcctgaaatgctaggattataggcataaaccaccaagcctggcccaatgtgtttcttagaataacagccacacagaatggagctcagtgcacctgtagttgcagctacttgggtggctgaagcaggagggctgcctgagcccgggagttcaaggctggggtacgctattaccatgcctgtgaatagccattgtactccagcctgggcaacactgcgagacccccatctcttaaaaaaaaaaaaaaaagccacacagaatgtatgtgaacaccaagcgtgaacactaccatgaactatggaccatcactctgggtaatgatgatgtgtccgtgtagtttcatgagctgtgataaatgcatcgctctggcggaaggtgccgaccatggggaagactatgcacgtggggccgggagcacctgggaactctctgtgtcttctgctcaattctgctgtgaacctaaaactgctctaaaaggtaaaatctattttaagaaaagccaatatcccttaaaacacttttgccccacaatgtgtttgaaacatgcaatttgactttactttccatgattttaataaaaaagacggccatggattatgggaaaaggtggttgagttatgctagatatgggcttttttttctctttttcacccagcattagatctaactgtgtactactgggaggaaatatataactaataagaaccagttaccaacactgttgtagtctagccgcaaataaagaataaaaggagttcaagaccagcccgaacaacacagcaaaactcttgtctctacaaaaaatacacacacaaaaattagccggtgtggtggcacacacctgtcatctcagctactcaggaggctgaggtgggagaatcacttgagcctaggaggtcaaggctgctgtgagccatgatcacaccactgcactccagtctgggtgacaaagtgagaccccgtctcaaaaaaaaaaaaaagtctgactctggctttagctttgtcatagatatactgatttaaccttcctgggctttgggtttttttaatataaagagactatctgtccttgggctacactcatggataacgtagagaggatgaacaaaagacggtctttaaaatgcttggaaagctcagacgcaggccaggtgcagtggctcatgcctgtaatcccggcacttcgggaggctaaaatgggcgggcagatcacctgaggtcgggacttcaagaccagcctggccaacgtggtgaaaccccatctctactaaaaatacaaaaatgagccaggtgtggttacacacacctgtaatccttgctacctgggagactgaggcatgagaatcacttgaatgcagtaaatggaggtggcagtgagctgggattgtatcactgcagcactccagcctgggtgacagagtgattctgtcttgaaataaaagctctgaactatccagaggctatacacactgtattgggagtgggaaattcattcaacaaatgtttcctctgtgtctgctatatcattaaggtagatactaccctgtctctatggaactatctatctagcaagtcagaaaataaaaatgatgatgggatatatacacagcacactgatacatgcgataccgactaggggaaaacgtggggtagaggaatcactgtaggtcaatctggtgtataagccttgagttggtggagaaggtagagatggcttgaggcaagaactacaccacggaaagtcccagagcaaagatgggggcagagggagcagctggtggggccactgtggggtacgaggatgatattagtcatctggtggggtctggaagtggcatcaaatccacaggacaacatggaaccattagagactggggaaccgatggtgaaaatttgattaaccacagaaccagtagagaactggcatctaccttgtcacatggcaaaattccaccgcaatcctctcagccatgcaccactcacgtggaaacatgcggccgtatttctcctcatagtccacaagctggcgttttatccaggcatagcgtctgtcgattttgtccagccaggcaacctggtgaaggtggagatcaaaagccaccccagtggttagaagtagaaatggcagttcaaggaaacaagcaaaaacacagagccaagcaaaagggaaccaacctctgtatttctcatggttttaaagaatctaggctacctttttaacttgattttttacttaaaaattcagaggtttttggctgggcgcagtggctcatgcctataatcccagcactttgggaggccgaggtcagcagatcacctgaggtcagttcgagaccagcctgaccaacatggagaaaccccgtccctactaaaaaatacaaaaattagcctggtgtggtgacaggcgcctgtaatcccagctacttgggagggggaggcaggagaattgcttgaacccgggaggcaaggttgcagtaaactgagatcgcaccactgcgttccagcctgggcaacaagagcgaaactccgtctcacacacacacacacacacacacaaaatccagaggtttttaacctggggtccatgattggccttcaggggtctatacatttccagaaactatatgcagaattttatgcacaggtgcatgtttctgaatttctccaaagggtcagtgacctcaaaatggttaagaactataaactcagcccctaggactcacagctcaacaaccaacactgtcagacagtcatgtaatacgaggtctaaattagtaggcttgacagcactcatgtttcaataaaattcaaatgttacatctgatcttatttggtcaatactcacatcttggttttcttgaaaaagtaccagatactctgacagatgctgtttaataaactttttgatgatttcctgtttgatcctgggatctagaatattagcaaccagacatgcatctcgtagaacattgctgggtcctcctggtctctagtaaaacaaacatgtaccaggtgaaaagccagaaacaacctttaaacctcatggcttctcacagccactacttgttatctctacgcattgtcagtcttactcctgctccttcacactcattctttctgctgtggctggatctgtcagttacctgctgctcctcgaggatggaatccttacactcgttttacagcaagcgacagaaaaactaccctgtgaatctgcaatgagatattttgggaaatgggcagtaatgatcacgggaaatttgactttctgcaaaccaaaactgaaagagatctaaaagtcagaatgccactggtctctgatgtcgcaagatgctgctgaagaggcctaagagtgggaatgccaccagcctctctcctaagagttggaatgccaccagcctcactccacatgtgccactcttccctgactccaacctctgggattcctgttcttaaagtgctatgtttttgccaaatagtgtggtctcccttaacacataaaaccaggttccaagccacgacatgtgtttcacaatagtgaactacctagaaaggcagccaaagagaaaatgctgtgatactggcctcctgacctgagcgaacactggaaagataccaggcgctgtactgacgcatcacgacgggaaggtctttgttaccaaaagcaattcaatgaccaaagttttgctgagactttctttacagtacgtcactgagtgaacatgactggctaagtggactacagtaaaaagaacacttggaatctactcctggcttggctaaaaagccatgcatgtagctttggagcacttgctcacctcatatgaaaaataatagactttaggtgataagtaaggttcttctaaatctttattttttgtcaactctttccaattccacccatctcaactgaagttccacgcttctaaagtgttatataagctgcctgagacctgagtttttaaaatgttgacttactccatgctgagtggtttttatgtcatctgctgaacaccctaacttctcaattctcacttcaggatgaaagtgacctgatagagaagtcatagatgccaaaacctatgggttcacgggttcagattttttcatttacaaagagtttactaggttgtgccttggaaaaatttttaaaaatcttaattcccacttgtgaaatggaaatagtaacacaaggcctttaagaaaagcccatagtctttaaaaagaaaactaggctgggagcggtggctcacgcctgtaatcccagcactttgggaggccaaggcaggcagatcatgaggtcaggagatcgagatccatcatggctaacatggtgaaaccccatctctactaaaaaaaaatacaaaaaaattagccaggcgtggtggcgggtgcctgtagtcctagctactcaggaggctgaggcaagagaatggcatgaactcggaaggtggagcttgcagtgagccgagatcgcaccacgacactccagcctgggcaacggagcaagactccatctcaaaaaaaagaaaagaaaagaaaactaaaaacaaaacaaaaaaaaaaccacacacacacacacacacacacacacacacacacacgaagtcactatgccagagaaaagggaggcatgttgttaaagagaaccattttaatttcatctgcccggtggaatctgggaaaaaaaatataaagcaggcctcttctaaacaataaagatgggcttcatccacatcttcctgaaacttctagaaactgaaatgagtggctgggcatggtggctcatgcctgtaatcccagcactttgggaggccgaggcgggcggatcacctgaggttgggagttcgaaaccatcctggccaacatggagaaaccccgtctctactaaaaatacaaaaattagccaggtgtggtggcaggtgcctgtaatcccagctatttgggaggctgaggcaggaatcacttgaacccagggggcggaggttgcagtgggctgagatcacaccattgcactctagcctgggccaaagagtgaaactccgtcaaaaaaaaaacaaacaaacaaacaaaaaaaaaaacctgaaacgggcagctgagtacacgtgaggctaaccttgtcctaagaagagcccagtgcttctcatgagcgaatatccccacaatcccttttcacttctttgaccttcattttcctcatgtaataaataggactaatggctttccaatatctactccctccctgcagttatatcagatgactaaggaatatgaggttctccaaggaaagtgctttacaaataagcatctgattactagcagacagccacaaaatgtgaagacattaaaatcaggagcgggcttcctatagaaagtgatgggcaaaagctggggccgctactcccacttacttcctacatttcttttatggaacacaaagaaaaaataattaagatatttccagttattgaattacagagcagatgcaggaaatgttccttggatcagtaaatgaatgtatgtccccatctctacccaccgagtagggtgaggctccttgcccctaagtgcttcagtatatttctgccttgaacaattctttctcttgaaatagctcaaacaatagagaaaaagtctcgtatgggttctttcctgtccgacacatgctaggcgctaagatggcatctgctacagttggaagggtggagctaaaagcagttccccaagcaggatggcagcttgttacatgagaagtgcaaccaacagctcccaagtgaaatgctgtgggctttgcagacacaacacaaacagctctgctaccagagagagctcaagggcatgaattccgaagagcaggcttatggtcagtaacagtgaggctcctcactatatcactctgagagttacataagatggtggatgctccacccagttgtcttttcaccaaaccaaaaccagtaagttatgtaacaatcctaaaaacaccgcggcatgaagatttcttttaaatacagccatgagaaaaaaggaattgacagggcatacaagatagacggtttgagacctacatcaaattaagcccaaacaaatcctctctttctgaggctggaaggaaacagaggaggaactgccaccacctagggacatttaaaatccagggtggtctcattaccctgaacctgcagcagaaggatttgcagctgccagcgagcatgactggaatgataaccacatggtgactggggtgagcgtgagctcggcaaggatggtgatcatctctaaagactggggaaacgcaaagcagtaccttggtgccctgggaaggaaacgcttcttcaaaatctgccaggatttgctgtcctaactcagtctgtgcagccttcactctgtgaggaagagagaacatatcatcacctggcatcatatccttatgtaactacacaccgatccacagggtcggaagggctgaagtctttcgagaaaggccaggaagggtacagagacgtccatgaggtgagaggtcacatactagttaagtgacaggttgatgagcaggacccaggcatccaagatattctcagggtgaatcttctatatccccaaaattcttctaggccaaccctttacctgaggtcatatgtattaatctttatacagttccactgggggatagtcatgctgtgggaaaatgttatagaatcacatccacatcaaatataaatctagctgggcgcagtggttcacgcctggaatcccagcatgtgggaagctgacgtgagagggtcgcttgagaccaggatttcaaaaccagcctgggcaacattagagagatccagtctccacgaaaaacaaactaaaataaaaagtacccaggtgcgggggcacacacctgtactcgggaggctgcggcgggaggatctcttgagcccaggacttttgaagatacactgagctatgatcacaccacagcactccagcctgggtgacagagggagaccttggctctaaaacaaaacactaacaaacaacaacaaataaatccactttggattactggtgtaactgctgtcctactccttggagtacagaatggcaagagggctccataatgttttagggtgttttgtaaaaaattattatgggtatataatcattatatatatatttatggggtacctgtgaagtcttgatacaggcatacgatgtataatgatcaaatcagggtaactgggttatcaatcaccccaagttatttgttacttctccgtgttaggaacattccaattccaatcttttagttatttttaaataaacaataaattattaaccgtagtcaccctattgttctaccaaatactagatcgtatcattctaactgtatttttgtgcccagtagccatcccagttactccccgcctccctgctatgcctcccagcctctgggacccagcgttctactcgctatctccatgagtttactttgaaaatgtttagcacccacatgagtgagaacatgaggaatctgtcttcccgtgtctggcttatttcatttcacatcacgtccagttcaatccatgcagctgcagtgttttgggtttcctgttaacccagaaaccaacaagctcgttaagtttttaaacaaataaatgaaaagaatgttttctaaggtaaaaacaaaaagagccaagtgacaaaatgaactgctaaatgatcactagtgagggccactgagtgaccatttaagttcagaagtttgtgaatatgaaaacggaactgcaaggaaaaccagctagaaaggggaggccagtactcaacagtggccgtgagtgtactaggagctcaagaactgtgcgtgtacttgaatgcaagggcagaaaggagaagcggctaggatggaaagcggctatggatcataccccacgatcaatcacgccccgcaatggatcaggccccgcaatcacgtcccgcaatcgatcacgccccacaatcgatcgcatgctgtgcatcccccacgagctgcctgatgttggtggccaccgtgcaccggccagccttgcagagagagagtggaacaagattctcaggccctgctgggcttcctgagcctgaggcaaatactgtctggttgctaaaaatgccttaaaagagcacacttccattctcggtctccaccctgttccttcagaattaactttatgaagtttctagaaatagcaacagctcaaaaccacaatttctttggctgctaaggagtgtctggcaacctgctgagattttttttcagatgaggggataggcatgacccaaaacaatctgttttttccgtggcgtggttacaattataccttattccaaatactttccaaggtttttccagtatcttcaaaacttttaaaaccactcttagaggtgggtttgtagccttttgagtcagttttcaaggaggccagaatgatccagacgaggctattactggaatagccgccacctccagattggaatcagggccatacgtctagagctgtccagcagacaatgggagacattccttcagcgtgaactttgacatgagagaaaagaataaaattgtacttcggagcttcttgtgatgcgcacacgaggaggcagcacacagcctgctgtggtgccaggtcacaggacagcttccagaggctcaggccccccctgttcctaccctcttcttggaagcacacacacagcaccagttccctcctaagccacagggaacttatagtaggaacttttcatggttagaagaggaaggagttctcctcacaggggaagtccagccgctagccagggcacccacagtcacattctcaggactactggccatctcaatgacactggtgggcccggctctgcccctggcccgaactatttgctactccatattcttggtgactctggaactgaggtggcagaaaggagagcctctggcccaaactattccctactctgaattcttggtgactctggaactgaggtggcagaaaggagaaccagagcctgtgacagcacctggtatcaccagagacaaaaaagaggaaaaattaccagtctctgatttgtagacttccttgccatgctcttcattttcatttttttacattaaattattatgtacaccttatttttttttattattatactttcagttttagggtacatgtgcacaatgtgcaggttcgttacatatgtatacatgtgccatgctgatgtgctgcacccattaactcatcatttacattagctatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcaatagtttgctgagaatgatggtttccagcttcatctgtgtccctaaaagggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatggggtggctgggtcaaatggtatttctagttctagatccttgaggaatcgccacactgtcctccacaatggttgaactagtttacattaccaccaacagtgtaaaattgttcctatttctccacatcctctccagcatctgttgtttcctgactttttaatgatcaccattctaactggtgtgagatggtatctcattgtggttttgatttgcatttctctgatgaccagtgatggttagcattttttcatgtgtctgttggctgcataaatgtcttcttttgagaagcatctgttcatatccttcgcccacttcttgatggggttgtttgtttttttcttgtaaatttgtttgagttatttatagattctggatattagcccttcatcagatgagtagattgcaaaaattttctcccattctgtaggttgcctgttcactttgatcatagtttcttttgctgtgcagaagctctttagtttaattagatcccatttgtcaattttggcttttgttgccattgctttaagtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttccacgtatggctagccagttttcccagcaccatttattaaatagggaatcctttccccatttcttgtttttgtcaggtttgtcaaagatcagatggttgtagatgtgtggtattatttctgagggctctgttctgttccattgatctacatctctgttttggtaccagtaccatgctgttttggttactatagccttgtagtatagtttgaagtcaggtagcatgatgcctccagctttgttcttttggcttaagattgtcttggcaatgcgggaccttttttggttccatatgaactttaaagtagttttttccaattctgtgaagaaagtcattggtagcttgatggggatggcactgaatctataaattaccttgggcagtatggccattttcacgatattggttcttcctatccatgagcatggaatgttcttccatttgtttgtatactcttttatttcattgagcagtggtttgtagttctccttgaagaggtccttcacatcccttgtaagttggattcctaggattcccaaattcctagttggattttattctctttgtagcaattgtgaatgggagttccctcatgatttggctctctgtttgtctgttattggtgcataagaatgcttgtgatttttgcacactgattttgtctcctgagactttgctgaagttgcttatcagcttaaggagattttgggctgaaacgatggggttttctaaatatacaatcatgtcatctgcaaacagggacaatttgacttcctcttttcctaattgaataccctttatttctttctcctgcctgattgccttggccagatcttccaacactatgttgaataggaatggtgaaagagggcatccctgtcttgtgccagttttcaaagggaatgcttccagtttttgcccattcagtatgatattggctgtgggtttgtcatagatagctcttattattttgagataagtcccatcaatgcctaatttattgagagtttttagcatgaagggctgttgaattttgtcaaaggccttttctgcatctattgagataatcatgtggtttttgtctttggttctgtttatatgatgaattacattttttgatttgcatatgttgaaccagccttgcatcccagggatgaagcccacttgatcatggtggataagctttttgatgtgctgctggatttggtttgccagtattttactgaggatttttgtgccaatgttcatcagggatattggtctaaaattctctttttttgttgtgtctctgccaggctttggtatcaggatgatgctggtctcataaaatgagttagggaggattccctctttttctattgattggaatagtttcagaaggaatggtaccagctcctccttgtacctctggtagaattcggctgtgaatccatctggtcctggactttttttggttggtaggctattaattattgcctcaatttcagagcctgttattggtctattcagggattcaacttcttcctggtttagtcttgggagggtgtatgtgtccaggaatttatccatttcttctagattttgtagtttatttgcataggggtgtttatagtattttctgatggtagtttgtatttctgtgggatcagtggtgatatcccctttatcattttttattgcatctatttgattcttctctcttttcttctttattagtcttgctagcagtctatcaattttgttgatcctttcaaaaaaccagctcctggattcattgatttttttgaagggttttttgtgtctctatctccctcagttctgctctgatcttagttatttcttgacttctgcgagcttttgaatgtgtttgctcttgcttctacagttattttaattgtgatgttagggtgtcaattttagatcttttctgctttctcttgtgggcatttagtgttataaatttccctctacacactgctttaaatgtgtcccagagattctggtatgttgtatcttgttctcattggtttcaaagaacatcttcatgtctgccttcatttcattatgtatccagtagtcattcaggagcaggttgttcagtttccagtagttgagtggttttgagttagtttcttaaccctgagctctagtttgattgcactgtggtctgagagacagttcgttataatttctgttcttttacatttgctgaggaatgctttacttccaactatgtgatcaattttggaataagtgcgatgtggtgctgagaagaatgtatattctgttgatttggggtggagagttctgtagatgtctattaggtccgtttggtgcacagctagttcaattcctggatattcttgttaactttctgtctcattgatctgtctaatgttgacagtggggtgttaaagtctcccattactattgtgtgggagtctaagtctctttgtagtttctaaggacttgctttatgaatctgcgtactcctgtattgggtgcatatatatttaggatagttagctcttcttgttgaattgatccctttaccattaagtaatggccttctttgtctcttttgatctttgttggtttaaagtctcttttatgagagactaggattgcaacccctgcctttttttgttttccatttgcttggtagatcttcctccatccctttattttgagcctatgtgtgtctttgcacatgagatgggtctcctgaatacagcacaccgatgggtcttgactcttgagccaatttgccagtctgtgtcttttaattggagcatttagcccatatacatttaaggttaatattgttatgtgtgaatttgatcctgtcattataatgttagctggttattttgctcgttaattgatgcagtttcttcctagcatggatggtctttacaatttggcatgtttttgcagtggctagtaccggttgttcctttccatgtttagtgcttccttcaggagctcttgtagggcaggcctggtggtgaaaaaatctctcagcatttgcttgtctgtaaaggattttatttctccttcacttatgaagcttagtttggctggatatgaaattctgggttgaaaattcttttcttcaagaatgttgaatattggcccccactctcttctggcttatagagtttctgccgaaagatccgctgttagtctgatgggcttccctttgtgggtaacctgacctttctctctgactgcctttaacatttttttccttcatttcaactttggtgagtctgacagttatgtgtcttggaattgctcttctcgaggaatatctttgtggtgttctctgtatttcctgaatttgaatgttggcctgccttgctaggttggggaagttctcctgaataatatcctgcagagtgttttccaacttggttccattctccccatcactttcaggtacaccaataagacgtagatttggtcttttcacatagtcccgtatttcttggaggctttgttcatttctttttactctttattctctaaacttctcttcttgcttcatttcattcattcgatcttcaatcactgataccctttcttccagttgatcgaattggctactgaagcttgtgcgctcgtcaggtagttcttgtgccatggttttcagctccattaggtcatttaaggacttctctagactggttattctagttagccattcgtctaatcttttttcaaggtttttagcttctttgtgatgggttcaaacttcctcctttagctcagagaagtttgatcgtctgaagccttcttctctcaactcgtcaaagtcattctccgtccagctttgttccattgctggcgaggtgctttgttcctttggagggggagaggtgctctgatttttagaattttcagcttttctgctgttttttccccatctttggggttttatctacctttggtttttgatgatggtgacgtacagatggggttttggtgtggatgtcctttctgtttgttagttttccttctaacagtcaggaccctcagctgcaggtctgttggagtttgctggaggtccactccagatgctgtttgcctgggtatcagcagcggaggctgcagaatagcaaatactgctgaacagccaatgttgctgcctgacttcgtctcagaggggtacgtggctgtgtgaggtgtcagtctgcccctactggagggtgcctcccagttaggctactcgggggtcagggacccacttgaggaggcagtctgtccattcttagatctcaaattctgtgctgggagaaccactactctcttcaaagctgtcagacagggacatttaagtctgcagatgtttctgctgccttttgtttggctatgccctgcccccagaggtggagtctacagaggcaggcaggcctccttgagctgtgctgggctccatccagttccagcttcctggccactttgtttacctgctcaagcctcagcaatggcgggcgcccctctcccagccttgctgccgccttgcagtttgatctcagactgctgtgctagcaatgagcgagtctccgtgggtgtgggacccgccgagccaggcaccagatataatctcctggtgtgccatttgctaagactgttggaaaagtgcagtattagggtgggagtgacccaattttccaggtgccgtctgtcacacctttgcttgtctatgaaagggaattccctgaccccttgcgcttcccgggtgacgcgatgccctgccctgcttcagctcatgtttggtgggctgcacccactgtcctgcacccactgtccgacaagccccaatgagatgaacctggtaactcagttggaaatgcagaaatcacccgtcttctgcgtcgttcaagctgggagctgtagactagagctgttcctattcagccatcttagaactgcctatgtcgccatgttcttcattttcaaagtcacctcttgagataggctggacctggttatgttactagtgagccgcataatcacaagtcacttcctctctgtgggtcacaactttgaatagctgtgaaataagagggtggggctagcagcccatactagatgattctgtgtcctctccagtactgattattccacaacacccatcttacggtgctaactggctttacaggtggctagaggttagatgtatgcttaatcctggagcagaaggatacgcatataaatgtcaatgtttccaacagcagtttttttctttgttttttttttgagacgaagtctcactcttgtctcccaggctggagtgcaatgggataatctcggctcactgcaacctccgcctcctgggttgaagggattctcctgcctcagcttcccaagtagctgggattacaggcgcctgccaccacgcctggctaattttttgtatttttagtagagacagggtttcaccatgttggccaggctggtctccaactcctgatctcaggtgatccacccacctcggcctcccaaagtgctgggattacaggcgtgagtcactgcgcccagcctctaccaatagcagtttgtgaagtggctatcaatgactcagatgaaagcaactattcccttacagacatcactgatggtatctatagacccaaacctcaatcccatgcattttcagggtaagatgtgaatttcagtctttataagcaattgcttaaataggattctagaaagaagtcaacagacttgaaagaatttatctttggcctcattcctttaaactccttcctcttctaaccatgaaaaggttcccactacaaagaggtagctcaactgataactgtcagcaaagcacatatatgtgccaaactaccaagatttcctagtcattcctttcttttcagactggagtacagtggtgcatttgtggctcactgcagcctcaacctcccagggttaagtgatcctcccttctctcagcctcctgagtagctgggactataggtgtgcacctccatgcccagctaattcttgtattttttgtagagatggagttttgccatgttgcccaggctgatctcaaactcctgggctcaagcgatctgcccacttcagcctcccaaagtgctaggattacaggcatgagccactgtgcccaactgatttcctagccattcttgtgaaagtccgcctacaactcatagagaacagggaaaacaaaaattcctcctggcatccacgtaagttcagcctgttgcatggtggcaaccccaaatgggtcactcttcagaaacaaaagattcattgtgctgcccagaaaggaaagtcaaccaggtggtttctggcatcctccatgccacgtgactgcagggctgttccaaggcaccctttcctaaaagtgttctcagcttttcgtaagggggagtcacagacagacagcaaattatgaacattgttcagatatctgtggataaagtagccctgagacttttgttaccttgtgagtgacagtcccaaagaaaacacccccaacagttcccaaataaatataccgccctcccaaaccacagtcttctaaacagcagggttaattagtcaaatgctacagttccaaacagacaccataaagaatctcagcctagaatcttgagtgaccccatgagacacttctgagatcaccaaggacaacactcatacttggcaaccgaggacaacactcatacttggaaagcgaggacaacactcatacttggaaagcgaggacaacactcatacttggaaagcgaggaaaacactcatactcggaaaccgaggacaacactcatacttggaaagcgaggacaacactcatacttggcaactgaggacaacactcatacttggaaaccgaggacaacactcatacttggaaagcgaggacaacactcatacttggaaagcgaggacaacactcatacttggaaatcaaggacaacactcatacttggcaactgaggacaacactcatacttggcaactggggacaacactcatacttggaaagcgaggacaacactcatacttggaaagcgaggacaacactcatacttggcaaccgaggacaacactcatacttggcaaccgaggacaacactcatacttggaaagcgaggacaacactcatacttggaaagcgaggacaacactcatacttggaaatcaaggacaacactcatacttggaaagcgaggacaacactcatacttggaaagcgaggacaacactcatacttggaaatcgaggacaacactcatacttggaaatcgaggacaacactcatacttggcaaccgaggacaacactcatacttggcaaccgaggacaactctcatacttggaaagcgaggacaacactcatacttggaaagcgaggacaacactcatacttggaaagcgaggacaacactcatacttggaaatcaaggacaacactcatacttggcaactgaggacaacactcatacttggaaaccgaggacaacactcacacttggaaagcgaggacaacactcatacttggaaagcgaggacaacactcatacttggaaagcgaggacaacactcatacttggcaactgaggacaacactcatacttggaaaccgaggacaacactcatacttggaaagtgaggacaacactcatacttggaaagtgaggacaacactcatactgggaaaccgaggacaacactcatacttggcaactgaggacaacactcatacttggaaaccgaggacaacactcatacttggcaactgaggacaatactcatacttggaaagcgaggacaacactcatacttggaaagcgaggacaacactcatacttggaaatcaaggacaacactcatacttggaaatcaaggacaacactcatacttggcaactgaggacaacactcatacttggaaaccgaggacaacactcatacttggaaaccgaggacaacactcatacttggcaaccgaggacaacactcatacttggaaaccgaggacaacactcatacttggaaagcgaggacaacactcatacttggaaagcgaggacaacactcatacttggaaagtgaggacaacactcatacttggaaagtgaggacaacactcatacttggaaagcgaggacaacactcatacttggaaatcaaggacaacactcatacttggcaactgaggacaacactcatacttggaaaccgaggacaacactcatacgtgtcaacccaggaggcccaggaggaacttgtcgaggccatagagctgtgcaggcctgtccatttccaggttgagttcttttttcactccatcatgagacctgccaagcctttctcacatttataagaggttagaaatggctgtgaaaaatatattttcgttcaagagtttcatggttttcaagagaatgtaaggctcttccattcttcattgggagatactgactgatgactagaaacattccctttcacggatatgcttaggccaggaggatttgaaatgtaaagatgctaaagaaaaaactctttcctccaatgctacattaagcatggaagcatttgccagaagggtagttggaagaattagctatgctcaaatcaaggctcatgaacttcctatttcaaatgtacaggcaaagatttcagaacacaacttttcacatgacttctacactttacagacagcaagacagtaaatttgagaaacggaagcaatgcagagggtggtaacccgcctgccatctcccgccccttacaacaaatagctatttctctcatttccagatggttctaccatcagcacgtaaacataagggaagcaaattcaccagaaaggatgctaaaaataagaagtctggacttttctcaaacgtttagtacctcttaaaaaaacaatcctagtcaagcactgaaaataaaaataagaagttgtctcctcttgtgctctttttagtgttatttttttttttcccccgagacgggtctgctttcttgcccaggctggagtgcagtggcacagtctcggctcactgcagcctccacttccggagctcaagtgatcctcccatttcagcctcccaagtaactggaaccacaggcacacatcaccacaccagctcactttttgtatttttggtagagacagggtttcaccatgttgtccaggctggtcttgaactccagagctcaagcgatctgcctgtctcagcctaccaaagtgctgggactccaggtgtgagccaccatgcccagcctttttagtgttacttaatagcacatattctgtattaacctacacaaaattattgcaaatagagattgcgaaatgaactaaaagataagtaaatcctcctgtgtttgcagcaaccttatgtgataatgaatgtttggagcactgaaatatattcatagaatgttggactttctatttttcaggaatgtgattataacagtgattattaagttccttcaaatttttaaaactacctctttaaacaaatgttgaaaagcaaagagcccaccaaaagtacaggcagcaaaagcaaaaagaaacaagtgggactacatcaacctaaaaagcctgttggagaaatgcaggtggaaaccacaatgcagtgtcacttcacgtcctaacgggggcatcttttcatgtttattggccatttatttatcttctttggagaaatgcttattcaaatcctttgctggttttttaattgagttgtttggctttttgttgttgatttctgggaattctttatatattctagatattaatccattatcagataaatgatttggaaatattcttcccattctgtgcattgccattttaccctgctgatagtgttttttcatgcacaagttttaaaatttttcataaagtcccatttatctatgttttccttttgttgcctaggactttggtgtcatatccaagaaactgctgccaaatacagtggtgtgaagatctggtcttcgttttcttctaagagttttagaattaggttttacatctaggttacagatccattttgagttattaacgaatccctatgctggtttctgccaaataaaagttagttctgtcatgttcctgccatgcacaaccccttcctttataccgactggagataggctcccacacacatctccgtgaccgtgtggccactgcctcctaagggtcttatcttttctaatccatatcacggactggagactggctcttacacacatctccgtgaccgcgtggtctctgcctgataagggtcttatcttttctaattcataccacggactggagactggctcccacacacatctccgtgaccgtgtggccactgcctcctaagggtcttatcttttctaatccatatcacggactggagactggctcccacacacatctcggtgaccgcgtggcctctgcctgataagggtcttatcttttctaattcataccacggactggagactggctcttacacacatctcggtgaccgcgtggcctctgcctgataagggtcttatcttttctaattcataccacggactggagactggctcccacacacatctccgtgaccgtgtggcctctgcctgataagggtcttatcttttctaatccataccacggactggagatcggctcccacacacatctccatgaccgcgtggcctctgcctgataagggtcttattttttctaatccatactacggactggagatcggctcccacacacatctccgtgaccgtgtggccactgcctcctaagggtcttatcttttctaatccataccactgactggagattggctcccacacacatctccgtgaccgcgtggccactgcctcctaagggtcttatcttttctaatccgtatcacggactggagactggctcccacacacatctccgtgaccgcatggccactgcctcctaagggtcttatcttttctaatccacaccactgactggagatcggctcccacacacatctccgtgaccgcgtggccactgcctcctaagggtcttatcttttctaatccatatcacggactggagactggctcccacacacatctccgtgaccgcgtggccactgcctcctaagggtcttatcttttctaatccacaccactgactggagatcggctcccacacacatctccgtgaccgcgtggccactgcctcctaagggtcttatcttttctaatccatatcacggactggagatcggctcccacacacatctccgtgaccgcgtggccactgcctcctaagggtcttattttatccagactcctgtacctctataatccactagacttttacaaaatacaagtgagatcatgccccccgcacttaaaatctttcactgtccacaaaataaaaaataaattatttagcaaggcatataaaacctgacccgatctacctatgcagccctgtctccctctgctgcctccaaactccatgagactccctcttccttctttcccccattactgtcacgttggtaagatcccacccattcttttaagattcagattaaaacagaatttgtctatgacccctgccctcagcccctgcttcagcctatcaattcctcttctgagatcctgctatgccttgtacagcatataccagttttgttacatctgttatactggaatcttctattaatgtctttcttctccatacaaaaatggtgaactctttgaaggcagagagtgtgtatttcttatctttgtgccttcagtccccagcacggggcctaggatgtagaaaatgcagagtaaatatctatcatgcaaatgaagaaaagaacaaatgaatatgaaagagatcaactctgaatcatcctgagagcaggggtagaagggactgccttcctcctcccccatccgctgacagcaaatctgcctgctccatccaggctccttctttcttgcagctcataaagtcctgttcgcctgctttcttggctgcctcacagtccagtctgataaggtgatcagctggctctaggtgtgaggggtaggaaggatgagggaaagggtggcgatttccctagcgttctgccaagctcggcaagatgcacactgagcacacgttgcaacctcccattcctgccccggagcgtcagaaataataaaaagattttcatgaaaatccaaatccagacaagaaaagtggtatactagaagcctgaggacttcctggtaggaaggatgacagaaaatcactgcccaaaaatgcttctcgaaaatgaaagacatgaaggtggcgataccaggagcaggatggggccgctgtccgtgtctgcacccacaccgtgaatgcgtgaatgctcacgtcaggcggcaggggtgggcctctgggtctgagaacttcagcagtagccagaggggcggccaacacccaagaagaccagggagcctccaagcctaggagatcagctgctgggacacccacctggcaggtttctccaggtctggcccccctcactttggaaaagctgtctgtgatacacttagccaagtagcaattcccatttctcgcccacgagcaggtagcagtaaaagagcattcttgatcagactaatagagaatgtcaaaaataaaaataaggccgggcacggtggctcacacctgtcatcccagcactttgggagactgagacaggtggatcacttgaggtgtcaagagttcgagaccagcctggccaacatggtgaaaccctgtctctactaaaaatacaaaacttagctgggcatgggtggtgggcgcctgtagtcccagctacttgggaggctgaggcaggagaattgcttaaacccaggaggcggcgattgcagtgagctgagattgtgccactgcactccagcctgggcgatggagtgagacttggtctcaaaaaataaacaaataaaataaaaatgaggtttcagctaagaatcactaaacatttgagaaatgctaaagagaaagaattgccatgctgaacaaactgaagatcttacactggaggacagaggaatggaacaggcactgaagatcttacactggaggacagaggaatggaacaggcactgaagatcttacactataggacagaggaatggaacaggcactgaagatcttacactggaggacagaggaatggaacaggtaatgaagatcttacactggaggacagaggaatggtacaggcactgaagatcttacactggaggacagaggaatggaacaggcactaagatcttacactataggacagaggaatggaacaggcactgaagatcttacactggaggacagaggaatggaacaggcaatgaagatcttacactagaggacagaggaatgaacaggcaatgaaaatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcaccgaagatcttacactggaggacagaggaatggaacaggcaccgaagatcttacactagaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaatgaagatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcactgaagatcttacagtggaggacagaggaatggaacaggcactgaagagcttacacttgaggacagagaaatggaacaggcactgaagatcttacactggaggacagaggaatggaacacgcactgaagatcttacactggaggacagaggaatggaacaggcactgaagattgtacactgtaggacagagaaatggaacaggcaacccagtgctttaacaaacacataatttctattccgtgggagagacatgagaatattatgcccatgagaaaagaatcagctagatatgctggaaattaaaaagctggatttttaaaataaaaattcaacagctgggccaaatagcacaatggatgcaagtgaagaataaattaaaataggaagactgggttgaggaattctttcagaaagcagttcaaaaggacaaagagacagaaagcatgaaaggaaaattaagagacatggcagcagatctagaagatccaacgttcacgtaacaagaattccacaaggaaagaatgcagagaccaagttgtagagactactcaaagaaaggaataaaggagaataatttcttagagtatgagaaactcatgagtgtttagaggaagaagacaactggggctaggtacagtggctcacgcttgtaatcccagcactttgggaggatgaggcaggaggatcacttgagcccaggagttgaagaccaacctgggcaacataagaagatcccacctctacagaaaaatgttaaaaatcagccaggcatggtggtatttgcctgtattcctggctactcaggaggtggaggcaggaggatggtttgagcccaggagttccaggttgcagtgagctatgaccacgccactgcactccagcctgggcaacacagcaagactccgtctcaaaaaaacaaaacaaaacactaatcttactagctacaaggaaaatgaaaattaaaggaaccggataccgttttcaaccataagatagataaaaatgaaaaacaacaatatcaagtgttgctgagggtaagggtgctctcatacagtacagatcgtactacaagtatataaagctttgctggagggcaaatgggcagtagctactaaaattttaaatgtatacaaacctataacccagaatctgtcccagagaaatacttgcatatgtgcaaaagggggcatattttaagaattagaaacaacgacctagtgctaccaaaatggtgaaataatctgtggtatgtcacgctatggggttctgtgcatcaattccagagaatgaagcaggtttatacatactgatgagaaaaaaaatatctaaaatacatgtggttgaaaacaaaaagcagtttttagaataaagcgtaaggcatgaaaccatttagttaaaacaaaacaaagcaaaaacaaagccattaactgaaactatagatttatataaatacacacacaaatccggagagataggattaaaactatagatttatgtaaatacacacacaaatccagagcgatagccactgaaactacagatttatgtaaatacacacacacaaatccggagcgatagccattaaactacagatttacgtaaatacacacacacaaatccgcagtgatagccattaaactgataacaattaccacctctgaggacaacaatgggattctgaagtctaggtaaagggaacttaggtttcacctgtatacatatttgacctttttaaacaatagaagatgtggaaccaggtgcagtggctcacgcctgtaaccccgatgcactgggagcccaagaccagccctgggccacagagtgagaccctgtctctacaaaaaagtaacaaagttagttgggtgaggtgctgcgtgcttgtagtcccagctgcttgggaaactgtggtgggaggatcacttgagcccaggagttccaagctgcagtgagcagtaattctgccactacactccatcctgggtgacagagtgagaccctgtctctattttttaaagtctatgtgtattacttatataattacaaataaggaaacttaaggaaaacaaagaagcctgtagcattcgggccttattaagaaggcagagtcagaaacgtagctgctgctcagtaacaacgccttcatttcttctttgctgcaaggaaggttagaatttgtcaattgtgacggtctctgccttctcagtgttcttcctgcccctccttctaacagaaaaggtggtgcatcaactcctcctcgtcctcccttggaatcctcatcctccttcgctctgagaaattactttcctttccactggatctgaatctgggattaaaactcaacagcaataagaaggaaagaataaggttggggggaaagtcatctttttatcgtatctaaagtttttgtggttcactgtatttttttttttttttgagtctcaccctgtcgcccaggctagagtacaatggcaggatctcagctcactgcaacctccacttcccaggttcaagtgactcctgcctcagcttcccgagtagctgggattacaggcacctgccaccatgtccagataatttttgtatttttagtagagacggggtttcgccatgttggccaggctggcctcgaactcctgacctcgggtgatccacccgcctcggcctcccaaagtgctgggattacaggtgtgagccaccatacccggccgtggctcactgtattttctaaagaccgccacagcaatctatcccatcccacatgctttttgtaacaatgtgactttgacattcctcccgttagtgggtgggagaagactatgttccttcctcttgaatcttagcagccttgtgactatggcagaagtgatgctatgaaatttccaaggcttggttctcttgggacgctcattcttggaaccagccaccttaccgtgaggaagtccaagcagcccgtggaagacaacaaagaatcccagcaacggcctggccaagctcccagctgacagcaagcaccaaggagccagccatgagagtgagccaatgcattctccagtcccctcctgagctgcctcggctaatgctgcacggagcagggatgagctggtccccgagccaggccaaattatacgtgcaaaacaattattgttttaagctactaagttttgtgctggtttgttacaaagaaatagatacctagaacagtttctctcacaaatggggacaactgagagttgtccatatatacaactgtaactatctaccacaggcagctttggaagacatgggaaggggtaaagtgggggaacgtctgcaccagacagttagatcaggtagcatctgatattccttcacacactaagactctgcagtgaacacgctgagctaagtgcttaagcacttcctagcaccaggtccttttctgaaagcaagatcacttcttccggtgacagtttaccttttggaaagtttagctgccggatctgcggaatccccatatactttccctccagtgacagtttacctttcggaaagctgccggatctgtggaatccccatatactttccctccggtgacagtttaccttttggaaagctgccggatctgcggaatccccatatactttccctctggtgacagtttacctttcggaaagctgccggatctgcggaatccccatatactttccctctggtgacagtttacctttcggaaagctgccggatctgcggaatccccatatacttgtggaagtgctccaggacattcatcacaccctgaaggagattagcaacttctccgtattgtcttcgcctggtcatggctctgcaaggaaagaataagtttaaaagtctagaaaaacactaaagacgcaagatacagacacagaacaacccacgctagctctcaaacagatatcaactcagctgaatcaacgttcgctgagcactgagtatataagctgctgtgcgttgtgggaggaaaaaacaggatctggtccaaatcctcaaggtgacaccatatagtaagggagagagtcaagtacacatctaactagtatcaaaaaggatgaactatgttctaaacagaagtacaaattatgtgctacggcaggaagaatgtgtgagtgatgaattctcatttggtgtggggaggggaatctgggaagacgatgaatttagaatttgggttggatattatgggattagcaagcttgggacagagaaccggggtagggatgttactatctgaggattacagcctatgagcaaaccaaacacaaagggtgcggccaggcgcggtggctcagcctgtcatccccgcgctgtgggaggccgaggtggctcacgcctgtcatacccacactgtgggaggccgaggcgggcagatcacgaagtcacgagatcgagatcatcctggccaacacggtgaaacaccgtctctactaaaaatacacaaaattagctgggcgtggtggtggatgcctgtaatcccagctactcgggaggctgaggcaagagactcacttgaacctgggaggcggaggtttcagtgacccgagatcgtgccactgcactccagccagggtgacagtgggagactccgtctcaaaaacaaaaacaaaaatacacaaagagcagcactttacctattaactgaaatctgtaggttctaaggcgtctgtatcacagacctctactttccctactgctaaggttaatgacgcttaaataaaaggatgctgataaaatcaagttacacacagggaggaaatataaactattagatctaaatttttcattagggttgggttatttcattaaatttgtaatttatgattttccataagaagcattgaaaaagacaggattggccgggcgcggtggctcaagcctgtaatcccagcactttgggaggccgaggcgggcagatcacaaggtcaggagatcgagaccatcctggctaacacggcgaaaccccgtctctactaaaaatacaaaaattaaccgggcttagtggcgggcgcctgtagtcccagctactcgggaggctgaggcaggagaatggcgggaacccgggaggcggagcttgcagtgagcctagatcgcgccactgcactccagcctgggcgacagagccagactccaactcaaaaaaaaaaaaaaaaaagaaaaaagaaaaagacaggatcaagttcaagccaaggtgttccgttgctaccaccacctggttttaccaccgcctggtcttaccaccgcccagtcttaccactgcctggtctgatggtttggtggacaccgaccaccccacgaaggaacaaatgtgaccgccctctggcctccctctggccgctgctctcactgctcacaggagagtggaccaggcatccctggagctcatccaatacctagagaggtcaggaaggggcccgcccctcctcctctttccctcaaggcactctcccacttcccccacccaggactttgaatgctgcatctcagtttctatgacgatgcgctttccctgtccacatacggaatcacactgaggctggagcagggggagtccccagcctgagacgggccacagaggtgagctggagtgtcagaatcttgctagtaaaggaggctttagattgctcctttgtagtaaatcaccagctcttccttctctatttctaatgttctgatgtatcattccctctacaagccaaacggaaatctactttataaaaaaaagtggtttgaatgattgagttctgtctcatagggtctcttccatgacagtgcaactcagcccaacgcaagcaggaaacctgctgaggcagaagcagcagggagtgaatatgggcctgtgtcactctgtctgcctggagtgaatatgggcccgcgtcactctgtctgcctggagtgcatatgggcctgtgtcactctgtctgcctggagtgaatatggccctgtgtcactctgtctgccttgatggtacagagccacagcctgaagatgggccatattcttggagtcgtcctgaaaggcttctggggtccccttttgactagctgccagtgtttgttaggttctgaacaccagagggcacaaagcaaaaatggtgactgaacacttgaagccaatttgcagaaagtggggcaggatggtgagactttcctggctgagaagtaaataggcgacaacaccattttctctatgcgatacatttcccgtggccccaaaagagaaagttggcattgcttactcgagggagtcgacacctcctgccagcatgtgcaggtggttcagtgtggtgattgaggtggtcaggtggcgtttggcgtgatctaattgcttaatatcacgggtgatttctttcacctaaacattgaaaaaccacaagaaagaaaggaagacggtcaagaaagatgtaaaacacttctgcaagtagctctgtaagaaacgaatgcagatgaagcagggaaaaatctcaggttagcaaacattctcacaatacaaaataaaaataatttccaaccaggcatttaaaatttaatgtggcatctctttggactttactcagggttataaaaccttcagttgtgagcatgaaatgaactttatttttttaccccaaatgaaatgatccaaacagcaattcagtattgagcacacaggacagaggaggtaagcacagcacctttccttgaacaaggtgaggaaagtgtgccttctggtgatgaagccgctgggccatataaaacacctatcagtcagtactaggtactcagacggtctttactaatggaatgagggcctgagcttccagcaaagaagactttcaaatctcaagaagattgaaatataagctctgtaacatacgcttaacatgtaagttactaggagggcaggagcagtcttcagggagtgagaaggcaatttggggagtaagagcctgacagtgttgtttcagcaggtccaagagaagagaagctgtctctgggaatgcaagtatatttcagtcaccagaaaagcatattcaatagagaagttggaaaaattccccaactttactaacacccaggtgaaatcatccactgtgtttcttggtccatgctgactaagaaatgtgtgtgtgtgtgtgtgtgtgtgtgtgtgttttatcatgccacattatttttaattacgtacaaagatctaacatgtcacccacggaccatttcacccgctgctctgtttggccgccagtctcttgtctctctcttcagcaatggtgaggcggataccctttcctcggggaagagaaatccatcgtttgttgcccttgccaatagtgaaaatgttggaaacttgagtgccaaagctgttgccactggtgtctttcacatgaaccacgtcagaagatcccgggtacctctctctgttggggatcacaccaactcttcccaggtgagcacctccagtcaccatatatggcttgccagtgtcgaacgtgatgaaatcggtcatcttgccagtctccaaatcaatctgaatggtgtcattcaccttgatgaggggtcagggtagcggatggtgcgagcatcatgagtcaccagatgagggattccttttgtgcccacaaagatttttctcactttgcacaacttgtacttggtctcctcaggtgtacagcaaagcaacctttggtgtcacggatcagatggaaattctctcctgtcttgtcaatgctgatgacatccatgaacccagcagggtatgttatatcagttcggaccgtgccatcgatcttaatgaaccgctgcatgcaaatcttcttaagtctgttccttaggaaaatgatgaggggaagacactctctcaacttgtggggactggtggacggacgaggagcaaacacaccggtcaatttatccagcatccaatgctttggagctgctacccgcttcagatgcttcttggcaccacgagccatggctgcattaggcaaggaaaagaggacctttgtcttccggtgcacatagcgaaagtttcttaatagcaatttggttgcccaggttctgtgatacctggaaggaagggagtgccctggataccaaacacaaatactgtagtcactggatagatacatcccattaaagtgagtaacttggccatgagttcatggatagatacgtcctcattaaagtgagaaacttggccgtgagtttgtggatagatacatcctcattaaagtgagaaactcggccgttgaggtcgtggatagatatatcctcattaaagtgagaaactcggcagggagttcgtggatagatacatcccactaaagtgagaaactcggccgtgagttcttggatagatacatcgcactaaagtgagaaactcggcagggagttcgtggatagatacatcccactaaagtgagatactcggccgtgagttcgtggatagatacatcccactaaagtgagaaactcggcagggagttcgtggatagatacatcccactaaagtgagatactcggccgtgagttcgtggatagatacatcccactaaagtgagaaactcggcagggagttcgtggatagttacatcccactaaagtgagaaactcagcagggagttcgtggatagatacatcccattgaagtgagacactcggccgtgagttcgtggatagataacatcccactaaagtgagaaactcggccgtgagttcgtggatagatacatcccactgaagtgagacactcggccgtgagttcgtggatagatacatcccactgaagtgagaaactcggccgtgagttcgtggatagatacatcccactgaagtgagaaactcggccgtgagttcgtggatagatacatcccactgaagtgagaaacttggccgtgagttcgtggatagatacatcccactgaagtgagaaactcggcagggagttcgtggatagatacatcccaccaaagtgagaaacttggccgtgagttcttggatagatacatcgcactaaagtgagaaactcggcagggagttcgtgggtagatacatcccactaaagtgagatactcggccgtgagttcgtggatagatacatcccactgaagtgagacactcggccgtgagttcgtggatagatacatcccactgaagtgagacactcggccgtgagttcgtggatagatacatcccactgaagtgagaaactcggccgtgagttcgtggatagatacatcccactgaagtgagacactcggccgtgagttcgtgtgccctgctctttcagggtctgatcaccctaggtgaactcatacaggttacgacctgcacagctcaattccacacctatgatcctgcaagccttacctggatcttagctataaaaagcctctttcatggggacttccccatcaagccttctctcctgtaacctccaaacaatctctgtttccaatgaattaaaaaaaaaaaaaaaggttaagaccaccaccactttaccaaatacttaaatttggggcaaaaaaaataaaaataaataaatcaggagtggtataataaattagatatagaaggctgaagattggccctgtaacctgatcacccacttgcaactctgaaatcagcatcctttttcctacaaaaaaatctctgtatctcttccagcgtttttagcttcagtctaacatagggagtctttatttatttatttatttttttattttttgagatagagtttcgctctgtcgcccaggctgtactgcagtagtgcgatcttggttcactgcagcctccacttcccaggcaagcgattctctgcctcagcctccagagtagctgggattacaggtgtgctccacgacgcctggttaatttttgtatttttagtagagacacggttttgccatgttggccaggctggtcttgaactcctggcctcaagtgatcccccctccttggcctcccaaactgctgggattacaggcatgagccaccgtgcccggctgcatcaggggtctttaaccactgtgttcaaagtcacatcatctatgactcttcctggtccctgcatcaagtcctaaatattctccctctgcttcatctcaagactctatcccttctctctatgtcctaaatattctccctctgcttcatctcaagactctatcccttctctctatgtcctaaatattctccctctgcttcatctcaagactctatcccttctctctactccttgttcaggccctcactgctctgcactggagctgactggtctctttattcccaggatctcccgtcactccccatcccacagcctgtgtttctctagacaaactgaaccactgatttttccctaaacaaagccatcaatggcagggcacaccaggggtactcaggtcaaacctacacgagatcatctgcgagacagaaggcccatggttgattcgcctcaactgacttacacgagaccacctgtgagacagaatgcccatagttgatttgcctcaactgttgcccacgggctgcgaaaacgggtagagcatgaaatgggaggttgtagagtcagacagatctagggctgaaccccagctctaccactcaccaacgatgcatcctagaacaagtttctcagcctcactgagtctcagttttctcatctataagatgggtaatcgcaaagataataatgaacataaatcctagttcataaggttgtggtgagggctaaattagagtgctgacacaaaggaaccagcacactgctggcactgaaagagctcaacaaagatcacttctcccctcactcccacctcttcctcccttcagcacagcactgtccaggaaagcaagctgctttaaaataagacatctcataacttgggagtaaactgtcactgcaaaccccctcggttggaagaggaagcatactccagaacacagattagcatcataaggatatcaataaatgcaatcaactccagcaaaagcagcatcggatactctcgctgatcttcacgctttgagggcccctggtgctgctgggtgtggtgcacccttggggaaggacgagggcccctgggtgctgctgggtgtggtgcatccttggtgaaggacgagggcccctgggtgctgctgggtgtggtgcacccttggggaaggaccacagaaaatccaggtccctaggactatgctcagtgctcttcatacgtttaattctcacaacaaccctgtgaggcaaatgccattattcttattttacagttgaagaagctggaattctgagacaactgacagacaggacattattgagtctgaatctgaacccaggatccagcacttcccagcgcctcccatggaggaggagaaggtgaatgctggattctcggtcttcggggcaagcttctgagcacaacaccgggggacacaaatttgtcaggggagaactcaaccaaaaccacatacacagatcatgggcggggacatccctcctccctccatccctccctcctcccggctccaggaccattctcagcgtgcatcgagctacataccgtacatctcgatggagaaatgcatgataccaataccaagaaatgttagagaaaggaaaatccaaaatgactaggaaactattttcagaaaggagaaaaaaaaaagttgcagctgggcacagtggctcacacctgtaatcccagcactttgggaggccgaggcgggcggatcatgaggtcaagagattgagaccatcctggccaacatggtgaaaccctttctctactaaaaatacaaaaaattagccgggcgtggtggcaggcgcctgtaatcccagctacttgggcggctgaggcaggggaatcgcttgaacctgggaggcggaggttgcagtgagccaagatcgcaccactgcactccaaggctggcgacagagcaagactccatctcaaaaaaaaaaaaaaaaatacccaaaaaacaaaacaaaacaaaacaaaaaagttgcctatttaaaactagggctgcaaacacagggcagcagagatggtgagccaccactgaccagcagctccccttgaattgatctgaacgcattcatagggggcttgctttagagatgcagatgactctggttggcaggaggtgccattattagaaaaagctcattattagaatgcctagatgagaagctcacttcctcttttggtgcaaaaaggttaggaagaaaccagaactcaccatttgctctgatttttcagctttgtctttgatatctttgattttgccaaagagttgttggatagctttctgagcctcttcaagcgcctagagtaagggaaatacatgaaaaacaaaaagtggctagagacagctccagtcactaactgtaatcaatgctaggcacaaaagaaatttccatgaagctctcctgattcattgtacttatgccaacaatttttctggaccaaaatagtagagacctatagagtccagtggctgcgaacaggtaaacactcgggactcttaccaatgttcctcacaaagtttcaacttaaaactaaatgattcccctctacctcagtcattactgtacatgttattgataacagcaaataggacaagtagatctctgtgtgtgggtgtatgcaaagactcacacagagggacaggggtagctctaaattggggcaagggaaagctctggacttggaagttccagattgtgcattcaaaaaaacctgaaccgtgaatggggactccagaactgcaacaaatcttaaagactttcatagtaagccatttgaaaaccaatgaaatgcacttagaaaggaacactgggccggacacagtggctcacgcctgtaatcccagcactttgggaggccaaggcgggcagatcacgaggtcaggagatcaagaccatcctggctaacacggtgaaaccccatctctactaaaaatacaaaaaactagccaggcacagtggcacgcacctgtagtcccagctactcaggaagctgaggcagaagaattgcttgaacccgggaggcagagcttgcagtgagccgaaattgcgccactgcactccagcctgggtgacagagcgagactccaaaaggaaagaaaagaaaagaaagagaaagaatgaaagaagaagggagagaaagagagacaaagaaagagaaagaaagaaagaaagaaagagaaagaaagaaaaaaagaaagagaaagaaagaaaaaaagaaagaaagagaaagagaaagaaaggaaggaaggaaggaaggaaggaaggaaggaaggaacgaaggaaggaaggaaggaaggcaggcaggcaggcaggcaggcaggcaggcagaaagctaatggtggctcacacctgtaatcccagcacttcagaggctgaggcaggaggattgcttgagcccaggagttcaagactagcctggggaacatggcaagactcggtctctgcaaaaaaaaaagttagccaggcatggtggcgcacaccagtagtctcagctacttgggaggctgaggtgggaagattacttgagcctgggaggtcaaggctgcagtgaactgtgatcatgccactgcactccagcctggtgactgagcgagatcttgtctcaaaaaaacaagcaaaaagctaatggtgagcccagcatttccactgaaataaaaacctacaaggacagatgctacacaatgaaagtattacaacacagctgcagcttctgctaggaggggaagcaacatgagggcagttgtgacatgtggagaccagaaagttcctgtgagtgccagcaggccacagacgtgtacagaccaaatgcactggaccgtccgtgagtaaagactacccacagctaaagtacctgtgagtgccagcagcccacagacgtgtatcgaccacatgcactggaccatccgtgagtaaagactacctacagctaaagtacctgtgagtgccagcagcccacagacgtgtatagaccacaggcactggaccgtccgtgagtaaagactacctacagctaaagtgtctgtgagcgtgtcagcaggccacggatgtgtatagaccacatgcactggactgtccgtgactaaagactatgaattcctgaggcagttatagttctaggcacgagtcagcatctccttaattcactccttcaatcactcaatgagtatttactgaatgcctcccatataccaggcatgattctaggcattgggaatccaatggtaaacaagacagtatggtctctctctctgtcctcaaggaatgaacttactttgagaagtaagggggaggagatcctggaaaaacaacaaaataaagaaacaagataattcctaagtgtggtgaattgacaggtgtggtgaaggacttatgcagtgatgagaataagggagatggtggtcacagaaggtctcctgagaaagggcacacaaatcgggacctgcaggatgaggaggtgtgagaatttgtagatttggagtaagatgattttttttttcttgagatggagtctcactctgttgcccaggctagagttaagtggcgtgatctcagctcactgcaacctctgcctcccaggttcaagcaattctcctgcctcagcctcccgagtagctgggactacaggcacctgccaccacacctggctaattttttgtatttttagtagagacggggtttcaccgtgttggccaggatggtctcgatctcctgacctcgtgatctgcccgcctcggcctcccaaagtgctgggattacagacgtgagccgccgcgcccagcctggagtaagaggattttcagcagagagaaaagcaaatgtgaagatcctgacagagaaaagacctcggtgttttggaggtccgaaaagacagacagtaggtggtagtgcaatattgcagcgggaagtgtctggaaataatctggagaggtgggcacgagccagagcacggaggcctcaaagcataaggattctgctctaagtgccaatgagaagccactgaagggtctaaacaagggacagatgtatggcttacttgtataagactgtcctggctgctgtgtggcaaaggggctgtgcaggggcaggagggaaagcgggagtgaaagctctgtgagaagttgctgcagtgtccacgagacggtggaggcctagaagaggcagccggtgctgacgggaagacgccgagcgattcagggtttccaggaaggtacaatgtgtaggactcactgatggactgtgtgtgggtgatgagggagagggagaaccaaggatgacgcccgggttttggttgaaaagccaaggccagggttcactgtctgaaccagggaatgcaggaggaggacgggcttgacaggcaggtgtgtgtggtggtggcggggctggaagtgaagagtcccatctgcaatacgttacgggtgcctgtgctatggctggaatgcatccccaaagttcatgtgttggaaacataatccccaatgcaatggtgttggcaggtggggcctttacgaggtgaccaggtcatgaggggtttgccctcacgaacaaatgaatggcattatctcgggagtgggttcttgataaaaggatctgttcagccactttctcgtgcatgcacacactttcttgccttccaactctgccatgggacgacgcagtgagaaggccctcgccgcaggacgacatggtgagaaggcgctcgccgcgggacgacgcagtgagaaagccctcgccgcgggaagatgcggtaagaagcccttgcctgatgtgggccccttgaccttggacttcccagcctccagaattataagaaatctcttttctttataaatgattcagtctgtactattctgttacagtaacataaaacagactaagaaaactggtatcaagaagtgggctactgctatagtaaatacctgaaaacatggctttggagctgggtgatggacagatgtggaacagtcttgaagtgaaggctggaaaaagcctgtattgctgtgaacagagtgctaagggggattctgctaagggctcagaagaaaagcagaaatgtagagaaagtctggaacttcttagaaattacttcatggttgtgaccggagtgttggtagaaatacagacagtaagctgggcatggtggctcacgcctgtcatcccagtactttgggagcctgaggcgggcggatcgcctgaggtcaagagttcaagacagcctggccaacatggtgaaaccccgtctctactaaaaatacaaaaattagatgggcgtggtggcgggcacctgtcatcccagctactcgggaggctgaggcaggagaatcacttaaacccaggaggcggaggttgcagtgagctgagatagcaccactgcactccaacctgggtaataagagcaaaactctgtcccgaccaaaaaaaaagatagcttacttgagatcaagtagagacattaagttggacataagattctggagcttggaagagaggtgataggttgggatttaaattcagaagtcattactttagagatgatatgtaagtctgtaagattagaagtcacctaggaagacagaatacacaagagaagaaaagatggcacagggctgacccttgggcatgccaatattcagaagtctaaaataaaaaaaagcagagatgcagagaaaaaccaccagtgacatgagaaaaaatcagggacgatgggtgttacagaagccaaacagaagtgtttgaaggagaaggaaagagtgattgtgccttctgttgttaaacactcatgtaagaggctgggcgcagtggctcaggcctataatcccagcactttgggaggccagggcgggtggatgacctgaggtcaggagttcaagaccagcctgaccaatatgatgaaaccctgtctctactcaaaatacaaaaattagccgggcgtggtggcaggcgcctgtaatcccagctactcaggaggctgagacaggataatcgcgtgaacccaggaggcagaggttgcagtgagccaagatcgtgccactgcactccagcctgggcaacaagagcaaaactccatctcaaaacaacaacaacaacaaaaaactcatgtggatcatgaggtcaagagtttgtgaccagcctgaccaacatggtgaaacccctgtctctactaaaaatacaaaaattagccaggcatggtggtgtgcacctgtaatcccagctactcaggaggctgaggtaggagaattgcttgaacccaggaaacggaagctgcagtgagccaagatggtgccattgcactccagcctaggcgacagagcaagactccatctcaaaaaaaaaaatgaagacagctgctactgattttgacaacagggaagttgttggtgaccttgacaagagcagtctcaatgcagtcaagggaatggacagcgatgacatgaagtagaggctgtgatcacagagcaggccacaaatgatggcctgtgggctgaagccagtctgccacgtctgccacctgtttttgtaaacaatgtgtttttggaccgaaactcattaataatacttaaaccaaactcatttgtttaagtattgtttatggggacttttgccacacaatggcagagataaatagttacaacagagaccatatggtcagtaaaggctaaaatatttactatccagcccttaacagaaagcttgctgaccctggtatagactttttttttcaagaagtttttgctatgagaaaggaagaaaaatagggcaaaagatggcgtaaagggagtaatttttaaagatgagaaatgcttgcatacgtctgcttgggagtgatttagcaggagagaaatttatttgggggggcaatgggttaattacagaagaggactgttttaaacataatgttctggggggggcaatgggttaattacagaagaggactgttttaaacataatgttctggggggggcaatgggttaattacagaagaggactgttttaaacataatgttctgcggagggggcaatgggttaattacagaagaggactgttttaaacataatgttctgggggggggggcaatgggttaattacagaagaggacttttttaaacataatgttcttgaattgtttagtgcaggggaccccaagccctgggccgtgggccagcaccagtccgtggcctgttgggaactgggccgcacagcaggaggtgagcggtgggcaagtgagtgagcatgatcttctgagctccccctcctcagatcagcagcggtattagattctcataggagcgcgaaccctactgtgaactgcacacgcgagggatctaggttgcaagctccttaacagaatctaactaaggcctgattatctgaggtggaacagtttcatcctgaaaccatgtccccctccctggtccatggaaaaactgtcttccaaaaaactgctcgctggtgccaaaaaggttggggaccactggtttagtgtatgagtattagccctttagcagggttataagtatcctttagaatggggaccaaggatatgaacagcactcctatagagcccatagctgagccaatcatccatttggtttaccggggacacgctgcgtttatgattcagtatagttattaacagctccctctccttctcaaagtgactctggtgataaatcatatggtcacctcacctacagcacctaagcaaggctatggcacagtgggaccttgacaaatattgcccactgattaaaagtatcatggtgcacctgtaagagtgctggtgctgaggctaccgctctgaataagtgcgctcataaccattcctctaacttcaggcccaaccatgagcagtggttcaaaatcacagcttcatgctttctgtaagtattctctatttggcttaaacagagtctaatatccaagatgctacatgggatcagtaaattctaaaaaagtttcaatcgtggagtaaaaagtgcaacagaggcctctgtaggcaactgaccactagaaaggactgatctttttcgacacagctcacatggaattctgtgatactgcaggtcatgtcatgttatggtgacatgctaatgggaccatagctactgtgttctagacaaacaccctaaaacatatgacatgcagctaagaaaggcaaaaaaggggctaagttatacacttaggtctcacatatgaagaagtctgcatgatcctatctcagagaaagggtttctatccctttctctcttacattaaacctggcatcctaccagaactgtctctgctgaaggtatcgcttttttcttccagcaaacaaataagactcacacaatcttacatgtcacagtctccaagatagataaactatgtgccagacttttttcgggctggaatacttttgcttgttttaataaggtactgaagttggggaaatgtactataattcattttgcagagtttaaaaactcctctgaagcactggtgctatcaggcaagtccattctcaacacacaccctaatatttgacatctaacctctgatcatgagtcatatagaaagattgttttgcaactggaagaatcatgggtcctacaagaagttaaggtttttttaagaaacacaaaaataccttcactacctggctaatcagaaatgtgctgaaagaatcactctggcactgtccctagacactttttaaaataaaaacgtggttggccgggggggcagtagctcacacctataatcccagcacgctgcaaggctgacggtggattacttgaggccaggagttcaagaccagtctgaccaacatgacgaaactccgtctctactaaaaatactaaaaaaattagctgtgtgtgctagtacatgcctatagttccagctactccggaggctgaggcatgagaatcacttgagcccaggaggcggaggctgcagtgagccaagattgcgccactgcactccagcctgggtgacagagacatactctgtcttaaaaaaaaaaaaaaaattaggccaggtgcgatggctcatgcctgtaatcccagcactttgggaggctgaggcaggtggatcatgaggtcaagagatcaagaccatcctgcccaacatggtgaaaccccatctctactaaaaatacaaaaattagctgggtgtggtggcgcatgcctgtaatcccagctactcgggaggctgaggcaggagaatcacttgaaccagggagtcggaggttgcagtgagctgagatggtgccatcgcactccagcctggtgacagagcgagactccatctaaaaaaaaaaaaagaagaaaaaaaagtaataataaaaaaattaaaaggtggctactttccattccaagctgtatgtggattaaaaacagaactaatcactcccaaaaatgtctgcatttaatctaccccactagagtttctgaacggagcactggagctacagcttacgtctaaaggtgttataaagcagtgactgttgtggccctttttaggactcaaattctatacacacacagcctgcatcctaaagtgttataaagcggcgactgtgtttaatctgcccctactggagtttctgaactgggcactggtgaactgggcactggtgaactgggcactggtgaactgggcactggagccacagcctgtatctgacggtgttataaagcggtgactgccgtgctcctcttttaagactcaaattctgtaaacaggagatgaaaagcaacccactgaattagcctagaaggctcagcaaaaccaattccagcatctttgtatttctgtgcatcctaatggtaaccactactctgaattctccttgcctcctggaggagacggtgagcaggctctcaaagccacaggaggtcacgtgtggaagataaggagtatggaacctggcacagactctcctgctttcttctttctctttttcctttttttgcagaactgttgtctgccacgttagtagacagaggggctctgattcattggcagtgccttaagaaatgagcatccctctggctctcaggtccatctaattttgcagtctgcgccatcagagaatgatgctgcctttatcctgtgagtccgcaggcagcctttcagagattttaaaccgagatcccctttgtggccactgcaggaaggaggaaaggttgttcattttccgaagagctggtatggctttagactattctgtgaaaaaataaggtgctattattcacggttactggggagaaaattagatttttccactattttgctaccatttctgttttccaacttgacatctatctgctggttcccttttctattatatggaaaagcaacgtgctgggccaggtgcagtggctcacgcctgtaatcccagcactttcggaggccgaggcaggcaaatcacctaaggtcaggagttagagaccagcctagccaacatggtgaaaccccgtctcttctaaaaatacaaaaactagccagccatcatggtacacacctgtaatcccagctactggggaggatgaggcaggagaatcgcctgcacctaggaggtggaggttgcagtgagccaagattatgccactgcactccagcctgggcaacagagtgagacggagaaagaaaagaaaagaaagaagaaaggaaaaggaaaagggaagggaagggacaaaaagaaggaaggaagggagggaggaaggaaaaagaaaaaaagaaaagagagacaggaaagaaagaggaaagaaagaaagaaaagaaagaaaagagaaagagggagggagggagggagcaacatgctgtatgagttacaagcaagggattttcaactagcagactgggattcaaaccttggctctgccagttactgtgtgatttctgtcaagcctcttatcctctaggaagtagtttcataatttccagaatgcaaattctatcagctacctgaaaggtagtaaggaatgtgagagtagaaaatatgtttggaatcgtttacccaacactcttcccctccgcatgcgaaatcttcctttcaccgtgtttctacagagtctgctgtccaagagctgaccaggccctcgttggagcagttttcccatgactttttttttttttttttgagacagagtcacgcttcgtcgtggcatgatctcagctcactgcaacatccgcctcctgggttcaagtgattctcatgcctcagcctcctgagtagctgggattacaggcacccgccaccacacccagctaatttttgtatttttagtagagacggggtttcaccatgttggccaggacggtctccatctcctgacctcatgacccgcttacctcggcctcccaacatgctgggattacaggcgtgagccaccagaatgagaattgggaaaaagagtttgtctttcgcgggtggtaggagtcccaagaagtgaaactgagttagagagcagctaggttccccaggaagggcaggaggctggactacaggtagagatgatgagggtgacacacacacacacacacacacacacacacacacacacacacaatctctctctcacacaatctcaatctctctctctctctctctctctctctctctctctctgagctttactcccgtctttggcttcagctgtttgacaagcccagctgagacgctatccttctggcggtcacacttgttgaacttcttcaaacgagacacaacaggatccttccaaataatcccccttttgcctaagcccgtttgaattgggatttttgtcttctgcaaccaagagagtcttgaatgagtttataaagcactcagctcacagaaagtgctcacttaatggcaactattagtattcccacatctcctagatggagtaggatatttcagatgagactaccctctaagaatcagaggttgttactcatcttttagagctttgtaaataagatggctaagttcagtatctgcaggcagactcagaagaacggctcatggattaagaggatggaatctttgaaccatgctgaaaatgagacattctccagaaaaaaattgaagtcttttgttcattcattcaattaaaaagtgagtgcctattacatgtactgtgctagatactgagagaaaaagatcactagctagggaatgtatctttaaagggcttgtaaggaatacatgtctgaattatacacaaaatgatacaaagagcgatgaataaagaatggcagcggccgggcgcagtggctcacgcctgtaatcccagcactgtgggaggctgaggaaggtggatcacgaggtcaggagatcgagaccatcctggcgaacacggtgaaaccccgtctctactaaaaatacaaaaaattaaccgggcgtggtggcgggcgcctgtagtcccagctactcgggagacttaggcaggagaatggcgtgaacccaggaggtggagcttgcagtgagccgagattgtgccactgcactccagcctggggcacagagcaagattccgtcgcaaaaaaaaaacaaaaacaaaaacaaaaaaaaaacaacggcagcatcatttcgaaagccaggaggtcctccagagagcagaaacatggatgagtgctaccacatctgataagccctacacggaagccctcaccacatccactgagggtggacaccaagggtcaagtcgcctctctttagagaaagtctcttcttttgttactgctgaccaccccggcatcactgagagctgttgctatggaaacgaggtatccccagctgaaacagaggtgcttcagccagcctcagcaatgctaacaatgcagcccgctctccacgacggtgctcaacagcagcagaggctgcgggactctcacacacccagcctcagcaatgccaacaacgcagcccactccccatgatggtgctcaacagcagcagaggctgtcggactctcacagccacagatggctgcacgtctacagctctttgcttccctacgtgtccgagaactcaaccaggactgccctggtcaaatgccagatggcgcccatcagatgagaatcactgatgtttacacaaattcctccacaccacttaggaacctggagtataagaaggctttatttaaagcacagatttctttccaagtttgtgaaccaaaaaccaaaggactgtaaagagcaaacggagtaattctcaccttgtttgttaaaatgttctgttccatgtaagttacttttatttatgatttctgcaaaccaaagccactgaaaatgtgaaccaaagagctcatttttgttgttttcaggagacaagccagaaattaaaatcacaagacgaggctcggaaacaaattcagcagtgcccaaataagactaaacatttacattgcaaagttctgcctatatctgttatcacccctaacttaaaacaagctagccctgaaatagctgcgagtgacggatgcgttcatgcagcttcctttgacgaaaggtaaccccggaggatgagagcatttcaagcaacacctccaagtggcaaaagacaaggaaacgtttaagcaaaagtttctgctgcttttgctgaatgaaaggtaaagaaattcaatatttttggaaatggggcacattaaaaggaacaacttgtccaagtttaacaaaggactacttttcccaaatagccaggacttccagttgccaagttcgaggttattgacttcattctaattccccatatcttactattacttctcattttagtcacttcataactctcatctatatcgtaagtcttcattcaggagaaaacatccttttgcgtgacatctggatgttccctcagctgactttttgagacaccttctgtgccaaatgcccttcaggctgcgaggattcatctgtgtgatttttttctcttcctggttcgcttactctctttagggcctcactggtgtctgtattttcggcagcacaggtgtgcagaacacagagagttctcttcaacctggggttcttctctcagtccagtttcttcgtcatactgagggggaccaagctggctaatgaggccatggtcactgccattatttgaaattccttatgaatcagccttccaggctccacagcaaaacaggtggctcccaaatctgcttttaaatgtttgtcactgtttaaagataatttagtatggacaagtatgcagcatactgcgaatgagaaaatctgggtctgtgattaactcgcttcgtgtgattttgggcacgtcacagaactgatgcgggccatctcttcatctgtaaaatggggagaacagcatctacgtggcctaattcacacatctttgtaaacatgtgaatcgagtaaatcaagtaaagtaatatatgcaacaatattttgcaaggtaaacatttatagtgtaataaaacattagcattacagatcaagacaaatgactcaaaatgttatgttctgcaaaagcaactgaaaatgtgtctttgcttacagtgaatgaatcaagaacagatcagccttaaaacagtacatccttaattacagagatctggaaaattccagggctgacaaacggtcctagaacctgcccacaagacactagttaccagaaatctctaaagactagaatctctaagtcttcaatgaaaaaaaagtttaaatttctgacttattagaagtagcactttgcctagctgataattctacggttatcacggaagtaggagagggctgtctgtcgcgaccgttcccttgtgactaggaacaagaaaagctcaagtacaacaaggagacaggagttaagaattcggtctgagatggggtaaagacccctcaaatacaccttttctcctgctttaaagacagaatttgaatcatcaaacttacttggggccaggtgcagtggctcacgcctgtaatcacaacactttgggaggcagaggcgggcggatcacctcaggttgggtgttcgagaccagcctggccaacctggtgaaaacccgtctctaccgaaaatacaaaaattagccgggtgtggtggcaggcacctgtaatctcagctactcaggaggctgaggcaggagaatcacttgaacccaggaggcggaggttgcagtgagctgagatcacacctccatcctgggcgacagggcgagactcccatctcaaaaaaaaaaaaaaaaaaaaaacttacttggtagtaagtatatctccagaagaaatgcccccctccaaattgggggtcattatgaaagtggcactaatacatttttgcctaacatccatattccaggtatcacatacaatacctagaaacgaacacagcatctgttcagagtctacgatgcaatacagaaacagaaattagaaaccccggcatgggatccaataatatacggaggacgacaagtttctgatgtattttagagctttaatctagatgactacaaaacgccaagccaaaacagatgtattatctttggttttgcaaaactaatctccttccagaggagaccctggagtccaaattggagcaaaggaaattttatagttacagactcttgaaaatggagacttacacatggaaatggtgacggcacaaccacaacgctgaatctgtgctcttctaaatactgtttccgtggatgaaagagggaagaggaaaaaggaggccaagttcttccatgaagacagaaagccaaattcccatccattgtacaaacatatctcagtgacttcttgtatcaaggacctgaaatccagaaggctttgctctgttggcagtaattccgcaatttttctaatgcacagcctcaaactgaggatggaattttccttacacgatttctaactactagcaatcaaaagcaagagtgacctgggtactagccagagcagttacagtggtgatgaatggcattttcctcttgagacgcagagtctagtttaaacttgtgactgcctctaacatggaaataagcagatggtgagttacgcttgaccttctttcttggctcctgaagactgccagtttatatggagatggctcagaagaacctgccaatttatatggagatggctcagaagaacaataaacttcagtgttctttcttggcgcagtattttcctaaaactattttcaataatcatgttgcagaaaagcgggacttggcgtttctaaggtcaggaaggaaacagtccaactgctggactagttaactaaataaaagaaaaaatcagggtggttttttttttttgtgggagagaacatctccatgagtaggcactacatacaaaagcttaagattcttgctaatcagaaacatgttgtctatattaattaaatgaagacaaaacagaacgcttgtgttaatgcacctgagtctatggaaagaatgaatctatgaaagttcagaacaatatggaaaaatgtttctaaagagattaaatattgcaatgattaaaaattaccatgtgacccagcaattccactcctaggtacacagcataagggacggaagcagaaactcaaacaggtatttgtatgccaatattcatagcatcactgttcacaaaagccaaatggtggaaacaatccaagtgtccatggacagatgaatggatacacacaatgtggtggaactacaccacggaatattattcacccgtaaaagagaagaaagtgctgatacatgctacaacgtggatgaatcctgaagaccacagaagtgaaatacaccagatacaaagggtcaaatattgtagaattccacttatattaatataaagttcccagaataggcaaattcatagagacagaaagtaaaatagaggttacaagaagttgaggaaagtgggcaggggaaggaaggacttaatggttttaatgtttacagagtttctatttggggtgatgaataaatttcagaaatagtggtagtggtggttgtacattatgaatgtaattaataccactaattatacacttaaaaatgttaaaataataaattctatattatatacatattttacaaggtttaaaaaataatgtaatatcaaaaaccactgaacagtatactttaaatagatgaattatatgtgaattatagctcactaatgctgttaaaatatagccatataaaaaattgaaaaaggttatatttactaaaatgaaatttaataaaatttttaaaagcatcatcaattacaccaagctacttgccaagaaaaaaaaccaggccaggtgtggtggctcacacctgtaatcccaacatttaaaaggctgaggcaggaggtcgcttgaacccatgagttcaagaccagtctgggcaacacagcaaaacccggattccacgagaaatacaaaaaaaattagccaggcgtggtggcgagtgcctgtagtcccagctactcaggaggctgaggtgggaggattacttgagcctgggaggtcgaggctgcagtgagccatgattttatcactgcactgaagccgaggtgacacagccagaccctgtctcaagagagaaaaaaagccaggcccggtggctcacgcctgaagtcccagcactttgagaggtcaaatgaggcaggcggactgcctgaggtcaggagtttcagactagcctggccaacatagcaaaaccctatctctactaaaaatacaaaaaaattagctggacatggtggcgggcacctgtagtcccagcttcttgggaggctgaggcaggagaatcgcttgaacccgggaggtggagactgcagtgagccaagatcaagccactgcactccagactgggtgacagagtgagactctgtctcaaaataacaaaaacaaaaaacccataaaaataaaaacaataaaaattcttttttattttttttgatacagagtctcgctctgtcgcctaggctggagtgcagtggcacgatctcggctcactacaacctctgcctcctgggctccagcgattctcctgtctcagcttcccgggtagctgggattacaggcatgtgccaccactcctggctaaatatatatatatatatatttttttgagacagagtctcgctctgtcgcccaggtagagtgcagtggcatgatctcggctcactgcaagctccaccccccgggttcacgccattctcctgcctcagcctcccaagtagctgggactacaggcgcccgccatcacgcctggctaatttttttgtatttttagtagagacggggtttcaccgtgttagccaggatggtctcgatctcctgacctcgtgatctgcccgcctcggcctcccaaagtgccgggatgacaggcgtgagccaccgcgcccccgccattaaaaattcatttttaacactcaggagatgtggccaaagtggcattcagagaaaagccgtacctttaagcgctcttcttacataacaagaagtagaaggagcataaagacaacagagatgaaagcagtaaaatataaaggtacagagtaatgaactgaaacaggaaaagaggagaactgacaaatatatccaagtgcaagtcctctgagaaggcctaaagaaattctggctgttttaatctaggattgggggtgtgggaaagagaaaacataaaattaagaatgaaaagagaggccagatgcggtggctcacacctgtcatcccagcacattgggaggccgaggcgcgcagatcacgaggtcaggagattgagaccatcctggccaacacggtgaaaccccatctctactaaaaatacaaaaattagccaggcgtggtggcggccacctgtagtcccagctacttgggaggctgaggcgggagaatcgcttgaacccaggaggcggagcttgcagtgagccgagattgcgccactgcactccagcctgagcaacagagcaagactccgtctcaaaaaaccaaaacaaaacaaaaagaatggaaagagaatataaacagagaattggaaaggatgaataaacttaaacatctgagtaaaattattttcaagaacaaggacttactaaaatcaactcaagaagtggaagatgtaactataaccacagaaataacagaaaaggctgccaagaaaccaatctcccaaaaggcacttgaccttgataatgggtcaattgtttcaaagacttcagggacttcagggtatattatctatagtctgactctctgaaacagtttactatttaaatggtctctgcggttgcaaaaaatgggaagcatcccagtttgttttataaagctgacaaaggtcaggcatggtggctcacacctgtaatcccagcactttgggaggccgaggcaggtggatcacctgaggtcaggagttcgagaccagcctggccaacatggtgaaaccccgtctctactaaaaatacaaaaatttagctgggcatggctgggcgcggtggctcacgcctgtaatcccagcactttgggaggccgaagtgggtgaatcatttcaggtcaggagttcaagaccaatctggccaacatggtgaaaccccatctctactacaaatacaaaaattagccggtcatggtagcaggcgtctgttatcccagctactcgggaggctgaggcaggagaatcgcttgaacccaggaggcagaggttgcagtgagtcaagatcgcactactgcactccagcctgggtgacaaagcgagattccgtctcaaaataacaacaacaaaaactgacataaacccgatacaaaatctaacaatgataaccaaaaagaagaaaatgtcaaactaatttcattttttaacatgaatcaaaatcccagataaaaatactaggattcaacaatatatttaaaagacaatacacgatgacccagcaagcatttatgaaaggttaaatattttaaaaagaaggaaaaaaaaacttaaacaaatcaacaacatgaaaaaacccctatgactatattcagtacatgctgagagggcatatgataaaatccaacgtctattttctggcaaaagtgcttagtgaccaagattgtgaagatctctccttaacagtcaaaagaatcgggaaacaagacaacattacacttggtgtcagctccgggagagaagtgtcttttgcttttttcattgtgtaattctcaatgcttaaaatagtgccaaccacacagaaggcactcactaaatatgtactgagtgagcaaatgaacagatacactatgtaaagtgcctgtcattaaaatcaagaacaaactgcctgccattcccactcttagctgatcctaaagagcatttctaaaactttttgacctcagaatctctttatacccttggaaatttattgaaagggtttatgtaggttatatctactgacatataccaatgttggagattaaaactgaggagtttaaataaaaaatatgtatctgttaatccatttaaacatgacaatgataaatatattacatgttagcataaattacatgttttttgaaaaataactatattttccccccagacaaaacaaagttgtttttttgtttgtttgttttttgttttctgttttgagagggaatattgctctgttgcccaggctggagtgcagtggtgcaatttcggctcaccgcaacctcagcctcctgggttcaagttattcttctgcctcagcctcccgagtagctgggcctacaggtgcatgccaccacactcagctaacttttgtatttttagtagagacatggtttcaccatattggtcagggtggtctcgaactcctgacctcgtgatctgcctgcctcagcctccccaagtgctgggattccaggcgtgagccactgcgcccggcctacaaaacaaatttcttgagaagcgtggcactgctggggtgtctctgcaaaaatctttagtgtctgctctgataaacaccagctggactcccatacacgcttccatattgaatctgttgtgatctgttgttctggttgaaaatatgaagaaaatctggcttcacatagatatatgtagttagaaaaggaagaaatactttaatacccaactctttgtctatttaggctgctattaatataaccaaatactttaaactgggtaatttctaaacaacagaaattgttaacagtcctggaagctggaaagtccaagatggaggcaccaggagatctggtgcccagtgagggccctttcctcacagacggcatcttctatgtgtcctcacatggggaaaggggcaaatggccatccttcaaaagtcttttatgaggacactgatctcacagatgagggcagaccccttgtgactcagtcacctcccaaaggccctgcttttaaatcctgtcacaatagggattaagttccagcataggaatcgtgggagataccaacattcctgtgctgtgacatgctgttttggttgaaaatatgaagaaaatctggcttcacatagatatatgtaattagaaaaggaagaaatattttaatacccatttcttagtctattcagctgcaattcatagaacagaacactttaaacacagcagcccttttcaggtacttggtgataagccttttttaaactacactaaaactcaaaaagtggtagattcttgaggattagctgcagtgtgggatttgaaattgaattaatgaacttgccatactatatgctgcatgaaacccgctgatcagctgtgcttctgccgaggatgcagaaagcagaaagagtgctgctcttacactaacaaggaggaaaacggaaactgaaaaccacaacttttcttgaacctagcagagagctaaaggtaaccaagcatcctgaaatccaagaaggaaggtgctcccccaggaaagacaggacaggagaaccgtctccatgtagaagggcatgtaaggaagacgggggtgccacacaagcaggcgagagggctgaaggaaagtttttaacaagttactaaaggccaagtgtgggctggcgcaatggtagggaggcctggaaagtgtaagcacaggtgggtttgcacccactctcaggctcttttccaagaccttcactgggtgttcatgaggaaaaaatgggggcactctctcctcttctacacaaaatgcctggcattcaataaaaaattttaagacatatatacgccaaaaaagaaaaaaaagaagaaagggaagaaaggaaaagcacccattgttaagagacaaagcaaccaacagaacctgtctcaaagaggagccatttggtataaatattagataggctacagaggaggggattttaaaataacaatgaataatatgctaaagaatctggtagaaaaggtgttttacctgcacgaacagatgaagaattgcagcagagagcaggaaattataagagtcaaatggaaatgctagaaaaaaggacatggtgtcagagctgaagaattccttcaacagcctcatcacactcgacacagcaaaaaaaggattggtgaactttaaggtgggtcaatagaaagtacccaaactgaaacacaaagaggaaaaaagaaaagaaaatccaacacctgcaggacagtattaaatgttctaaaacacatgtaagtagaattctaggaggaagagagaacacaacagaaacatttgaagagataatggctgagaatttttttttaagtgaaaggcattaaaccactgatccaagaagtgctgagatcccaagaggaataagggttgacttctcagaaacaatgcaagctagaagacaaagactgacatttttaaagtactaaaaaaaaataaaacaacaaaactgccaacctagagtcctaaaccaagcaaaaatatttttaaaaaataaaagcaaaattaaaacttttcaagcaaagaaaagctgagagcatttcttgccagcagaccgtgttataagaaacactaaaggaagttcatgaggcagaacaaatatggtacagaaaaaactcagatctaaggagataaaaatgagatctatgtgaggtgacaaatgccttcatttgcttctctgcaggctattttactgtctttatgtatcctataacatgttatacaccttacatatacacaatacaatttacttcttcaaacataaaataaaatagctgggtgtggtggcacacgccaatagcctccggctactcaggaggctgaggcaggaagatcacttgagccaaggagtttgaggccagctcaggcaacatagcaagaccccatctctaaaaatataaaataaatgtagaaacttgaaaactgacaaacaataaaaatatttttaaaatttatttttaattactctaattagcaaaaatagcaacagtgatggtgttcataatacgtaaaaacaagatgtggggcagagtggaatgcagagaggatgtgaggaagaggtcagaagcctgctatgaaaagactctcacattacatgtgaagtgatacaatgtcatcactgtgacatcagtgacaatatgactgtgataaagatgcatattgtggacccaggacaaggaagtacaagaacaaacagaaaacaagcaagatgctagatttaaatccaactatatcatgggaacaaagcaaactattcactttcaccagttttattccatatcacactgtaggtcctagccagagtaataaggcaaaaaatattttattcataggtgagatgattatctactttttaaaaatcccaaaagcctacaaaaaaaaaattcctgaaactaataagtgagttcagcaaagctgcacaatataaggtcaataaataaaaatcaattacatttccacaactagcaagagacaactggaaatttaaattttaagagataccatttataatcataccaaaaaccacaaaatatttagtataaatctagcaaactatgagcaagatctatatactaaaaactaaaacacactgttgagagaaactaaagacctaaatatatgaagaaatattccatgttcatagattggaagatttaatattgtaaagatgtcaattctccttcaattgatctatagactcaacgcaatcccaatcaaagtcccagagatttcctttttttcttttcttaaatcaacaagttggccgggcgcggtggctcacacctgtaatcccagcattttgggaggccgaggcgagtgaatcaccgaggtcaggagttcgagaccagcctggccaacataattaaaccccgtccctactaaagaatacaaaaaattagccaggcatggtggctcacgcctgtaatcccagcgactcgagagattgaggcaggagaatcacttgaacctaggaggcggaggttgccgtgggccgagatcgcgccactgcactccagcctgggcaacaagagctagattctgtttccaaaaaaaggaaaaaaaaagactaataaaggaaaacagatcccaatacctgtaaaagtcctgatgatcttggcgtaaaaactgccttgctttagagatgcaatgagagacagagaaaacaaaaagacagatgtactcaacacaaacagctggagtggagaaagcgggcagctttgagtctgagagccaggaagggaagactgcagttccaagagcctgggtctggaaaccggtgttgaacaggcagcaaaggctccctgcagtgacccaggtgtcagttccttctgttcattacaatacggcatccaaaaatacttttcttctaaaataatataccaacggccctcaacttgggatggttcaacacagaattttcttactacacgatggtgcaaaggtgagaaacattctgtagaaaccatactttgggtacccatacaaccactctgtttttcactttctgtacagtattcaacagatcacatgagctattcaacactttagtataaaataggctcggtgttagatgatttgcctgactgtagcctaatgtaagtgttctgagcaaataaatttaaggcacggtaggctaagctatgatgttcagtaaattacatgtattaataaattttcaacttaggatattttcaacttacgatgggtttatcagaataagaacttattcttcattgcaagttaagaagcatgtgtatgattgagaaaaatctggaaacaggtgtggtggcttgcacctgtaattccagccactcaggaggctgaggcaggaagatcgcttgaggtaaggagtccaagaccagccagagcaataaaggaacaccccatcactacaaaaaaaaactttttaaattaaaaaattagccagacatggtgacatgcacttgtagtcctacctacttggaagtctgaggtgggaggatcgtttgaggccaggagtttgagacagtgagctatgcacgccacactccagcctggatgaccctggagcgagaccctgtctctaaaaaaaaaaacagagagagaagagaattggctggttgcagtggctcatgcctgtaattccagcactctgggaagcgtaggtgggaggatcacctgaagccaggagttctaaaccagcctgggcaacacagtgagattccatctctacaaaaagtgttttaaaacagtcaggcatagtggtgtgcacctgtagtcctagctacttgggaggctgaggtggaaggatcacgtgagcccaggagttcaaggctagagtgagctacgatcctgccattacattccagcctgaatgacagagtgagaccctgtctctaagaagaaaaaaaagaagaatttggaagttataaaaactagaaatgaaaaaaaatctatctgcagtctcaaatttcaaaaacaatacaaataataaattctgttgtcaagtggaatgtttattttaactatagggtgatattgcatgtcacgccaggcaaacatctaatggaggtcttgaagacaggacaagagaaatgaacctttgaccaccactgttgccacagcagatattctggaccataggtaagctgtgccgccatttttattcacagagaacagcacgctgaaggcagtaaggggcctgggataattcagaacaagtaaacctggagttgctttaaagcacagcagtggggctggagaggagctgatggagctgacggaaaagccacaggaactcgacaaatacctggatgcacggaactaggaaaactgaaattccagtggactgtgtatcagcagcactggtgttcctgccatttactaaacatgagtgagcccaacattgtgcaaaaaaggtgttttaaaatacatttattctaggccagatgtggtggctcatgcctgtaatcccagcactttaggaggctgaggcagaaggattgcttgaggccaggagtttgagactagcctgggcaacatagcgagacctcatctacacaatacttaaaaattacattagctgggcgcagtggctcacgcctgtaatcccagcactttgagaggccaaggtgggcagatcacctgagatcagaagttcaagaccagcctggccaacatggtgaaaccctgtctctaccaaaaatataaaaactagccaggcgtggtggtggtcgcctgtaatctcagctacttgggaggctgaggcagggagaatcacttgaacccaggagacggaggttgcagtgagcagagatcgtaacacggcactccagcctgggtgacacagcaagactccagctcaaaaaaaaaaagccaggtgcggtggctcatacctgtaatcccagcactttgggaggctgaggcacgcagatcatgaggtcagaagatcgagaccatcctggccaacatggggaaaccccatctccactaaaatacagaaaattagccgggcgtggtggcacatgcctgtagtcccagctactcaggaggctgaggcaggggaattgcttgaacccaggaggcagaagctgcagtgagccaagatcgcaccaatgcactccagcctggagagagagcaagactcagtctcaaaaaaaaaaaaaaaaagatgcgcatggtggcatgtgcctgtggtcccagctactcgggacgctgaagtgagaggatcacttgagcccacgaggttgagggcgcagcgagctgtgattgcaccactccactctagcctgggcaacaaagtaagaccctgtctcaaaaacaaataaataaataagtggataaataaaataaagtatattaattctaatcccccctaaccctgaggtacgtattattatctccatgtcacagatggaaagttaaatatcttgtccaaggtcacacagataacagcagagacaaaatttaaattcaaagctcaagtttttttcactttaccaagatgccatccaatgttacatcactgaagatatctaactacaccaatccttagagaattgaaataaaatgcccagtccttcactgtacatagaggagagaagatagctatttggattccttatagcttttctaaaaatgagggattttagaggatacgtggcaaagtgttccaaatatgccgcagacatgtctccctgccaaaaaagcgctatcaaggtgatatgatttggctgtgtccccacccaaatccctacatgtcataggagggacctggtgggaagtcactgaaccacggggtggtttctcccattctattcacgtgatagtaagttctcacaagatctgatggttttgtaagaggcttcccccttcgctcagctctcattcttcctctctcctgccaccttgtgaagaaggatgggtttgcttccctttccaccatgattgtaagtttcctgaggcatccccagccctgcagaaatgtgagtcaattaaacctctttcctttataaattaccccgtctaaggtatttcttcatagcagtgtgagaacggactaatacacaaggcttgtgtgcaataaacaggatgaagaatggtagtgaggccaaacccagttgcactacattgttaaacagttaacggacattttatgagtccccgcctcaactacaaccagtagcactctagaagcaggcaaaatgaacagtcgcccgccccgcctcaactacaaccagtagcactctagaagcaggcaaaatgaacagtcaccggattcaacttgacaaaggcaagccaaccttgacctctgcactagacgtaagaaatcctggttgggaaatgactgtgagcccgaatcaaaactctgcccctacaaaaggctgatctaacaacccgactccagggctgccccacagatcacggtgttcagggcactcccaggtcatgtccaaacctcagcaattcctgaagtttagtgttatttgcagacatgctgaaaagtacaacgcaaaaaataataacagaaaagaaacaaaaaatgtccagccaatcttggccactaatgggaaacttcgaggccatactctaaaagctcagtcgctttagctgtggtatgttttagtaggaagaagcaagtagcaattgccatttttttccaaactatttgtggtccctttaatactaataccaattactttcttcaatttttatcaatcaatgggcttcattttcctcccaagagaggatgagagaaaggatcaatttaaagtgagggaggataagaatataaagtctccttctagtgagctgacaatgacaaattcaaaatcccacataatgaagatcaatgccatgctgggaagtcagtcttggagagcagttatttttgttcttttcacttgagacagggtccccaggctgcagtgtagaggtgccatcatagactgctgtaacctcaaacccctgggctcacgcaatcctcctacctcaaactcctgagtagccaagactataggtttgtgccaccatgctggactaatttttttttttttttttttttttttttgagatggagtctcactctgtcaccaaggctggagtgcagtggcaccatctcagctcactgcaacctccacttcctaggttcaagtgattctccagcctcagcctcgtgagtagctgggactacaggcacgcaccactgcatctggctaatttttgtatttttagtaaagcccaggtttccccatgttggccaggctggtcttaaactcctgatctcaggcgatccgcccacctccgcctcccaaagtgttgggattacaggcgtaagctaccaagcccggcctattttcgttctaatgcttgaattgcataatatgctaattttgaggaagaaaagcaaggaacactttctccttggaaggcaatgtactttgctgctttagttcataatctttatgatatctctatgtaaaagtgaagaaggcaagtattaacagcctccttttttggtgaaaatcaagacatgggaagatgaagaaacagccccggacgacacacacagacaggtagaaatcctgttttttgggtctggcactttgcgctgaagtgaggaggaagaacaggaagcctctgacggcacgtcacacggctctgaatccactccattctgccttttcatctacaacttgaatgaagacacagaaggcatgtctggcaaatctgctaatgataaagtggggaggtcatcaaggctcccaaagatcttgatgggataaacaatcgagcagaactagtgggatgaaacgaaagctgagacacacacggtctgacaatttcaaagactctcttgcacaaacagaggtggagaaagtttaaatgaaagtcatatgaagaaagacctgggacagtactggcccacagatgtgttttgtttgccctttgcagtgtttgtgaaaaacactaagccaatagttaaaaattgtgagagttacatgaaaatccggatttccggctgctcttgaaaaactgatagatctggcaattccaggtctgcgttcagacgtgacaacagctgattagaattcacttgtgactatccccttaggacctggtggatgcatgtggacacacaccagcctgcttacgccgcttaggttactttcccagctctgcggacatctgtttgcgactcttgacctgggggtttcaggtgactgccaactcagtagaagccaaccatgtaatacggctgccaaaaatctcagcaaatccaaggtaatggaagaatagtgtctaaaataaaaaatctcagcaaatccaaggtaatggaagaacaatgtctacaatcaaaaatctcagcaaatccaaggtaatggaagaacagtgtctaaaatcggtggcccttaagttttgaagagtcacagactccttagaaaatctagaaaaatcaataagttttcctcccataaatatgtctagacatacaaaaatttacagttaatttcagggacttgacagacactctggacccccagtccctaagttaatgagctcggcccagaacaaagaggtcaactgtctcagtgtatatgttgacacagcatgtccactcctgggaaccacattttaagagggatgctgacaaacagctatcaagagcaaggatgataaagggtctggaaattgcattataaagatgaagaaactaagaatggttagcctagaaaagggaacacttaggaacataatatccattttcaatttcagaagctgtagtaaggaaaagggattaggcttacacccatccagctggcagaactaagatcaacaagaagttacaatgaagtctatttcactgtttcagttcagtctaagaaaggagtttctcacaactaaagctataaaactgaactagtctgtcctgtggaccaacaaagtagcaagctccccatcactgaaagtagccaagcttctgcaagataatgaaacgtcagagatgtaatacaaaggactcctgaactgggtggaagattgtactacaattacctaatccttcttccaaagcgaaggagtgagcaatacagcaccccctccttatcagcagttcactttctgaggttttagccacctgtagttgactgtggtccaaaaatattacatggaaaattccagaaacagacaattagtaaattttaaattatgcgccattctgagtagtgtgataaaatcttgcaccacccaattctgtcctgaccaggtcacgaatcattccttcacccagtatatccatgctgaatacagcacctattagtcacttagcagccatctcggctattacatacagctccaaatcacaagaggagtgatgctggcatactgtcataattgtgctattttatttttagttattgtggtgaatctcttactgtgcctaatttgcatgctaaagtttatcacaggtatgtatacataggaaaaaatacggcatatatagggtttgctactctctgggtttcaggcatccactgggggtcttggaatgtatcccccacaggtaagtggggacgacttgtaataattctcttctcctcccaaaccttactcttgttctgatcaaagaaatggctacattgcagccaggctccattgaagagacagaaactcggtggctgatcctctcctgtgagtctgagagcttactgacgaccggtcaacgttggccactcttgaaacttcccactgccggctttttcttcctctaacccgcccctctattcacctctctttcacctacgttcaagccatccattttaattcttgggaagctgcaaaaatttcatagcataccacatcatgtacttgttgaattgactcatccacaaagttttaaacgtgggcatttaattaaagcttttgactgatgatttcaacagataaaaatggggaggattccgtgccatataaactttataagagcatcatcgtctggttagaagaggtcacagactagaccagttcaagctggcccacatagaaggtggtcaaaaaacaaagactctgcaaacgtttagcagaatgttaaccaagcggctggtatttcagaaacttcaagaagctcaagaaatgacctaattatgccttcaatatttaaatcattccttacccccaaataatttttgagtcaaaaacattgcttttcaaaagcaacttttctgctaaaaatgtcatttaagacaccatgaatgtgaagtcaacactttccccttatttacagatatagaagcacacctagccgggtgcggtggctcacgcctgtcatcccagcactttgggaggccgaggcgggcggaccacaaggtcaggagtttgagaccagcctgaccaacatggtgaaaccctgtctctactaaaaatacaaaaatgagctgggcatggtggtgcgcacctgtaatcccagcactttgggaggccgaggcgggcggaccatgaagtcaggagtttgagaccagcctgaccaacatggtgaaatcccgtctctactaaaaatacaaaaattagccaggcgtggtggtgcatgcctgtaatcccagctactcaggaggctgaggcaggagagtcgcttgaacccaggaggcagaagttgcagtaagccgagatcacaccactgcactgcagcctggctgacagcgagactctgactcaaaaacaaaacaaaaaacaaagaagcaagaagcacatctaggctgggtatagcctagcagccatctcggctattacatacagctccaaatcacaagaggagtgatgctggcatactgtcataattgtgctattttattttcagttattgtggtgaatctcttactgtgcctaatttgcatgctaaaatttatcacaggtatgtatacataggaaaaaatatggcatatatagggtttgctactctctgggtttcaggcatccactgggggtcttggaatgtatcccccacaggtaagtggggacgacttgtaataataagtgtctcatgcctataatctcagcattttgggagcccaaggcaggaggatcacttcaggccaggagttcaagaccagcccgggcaacacagcaagaacccatctctaccaaaaataaaaaattaaaaattaaaaatagctgtgtgtggtggcacatgcctgtagtcctagctacttcggaggctaaggtgggaggatcacttggccccaggagttcaaggttaccgtgaaaaatgattgcactccagcctgagcaacaaggcaggaccctgtccctaacatgataataataaatacaaatttaaaagcggcacatcggttctggttaaacacaatcaagattaaatttataaaacgaaaacctccttttgtccatatgccactcccttctgagtgttcttcagaagcttaggaagcgagtgctgaaagcaaacttctcttctcttccagggaagaggggaacgtggggcctcttgacctacaaaactcagtattttggaacatccgtaattccaccaagtctgttgcagtcaaatagactccttttagcaaaccagccagccagggctggagagcaaggctttcatacctaggagttgacaaggacaggacccaagagctccttggaaaaaaaaaagcttgtacttcagtttgcattacaaagtgctggaaaagacagatggggccatgacaggaaaagcagttatttcttctgggcttcctttctgtctggattctaaggagacgaatacaaagttccatcacagattgaaatgctatctaaacattcttgaaaatgtggtcttgctctgtgaaatacgacctgctctgctgcggcaacctgtaacctattaatacgggatgggggagaacgccgacattcctgcagactgtcgaattctgggtctgactctgtaataccgctagtttgcaagagtccagaaccacaggttgaaacgtaaataactgaaagatacacatctattatgcacagcatgacccaacaaaaaatgccgatgaatcactcactattttcacattcttgaaattttaaacatctatgactcctgcactgtaagacttctagtgagccattccaaatgtaggctgaatcacactgaacaagcagtgttactattcccagtagcagcaagttgggactcttaatgcacaaagcaagttctaaatcacttttaaggaacacccacttgctgatcaaaatgatgtttttatgataaaatgtttttgtttatttataattaataaacaatcttagacagacaaaatattcaatacagttgcataaaatgttgtgggggttttgctgttgcttttggggatggggtctcgctctgtcatccgggctggagcgcggcggcaccattacagctcactgaagcttgtactaccacacccagctaattattttaccttttcgtagagacgtgtattgctatgttgccgaggctggtctcaaactcctggcctcaagtcatcctcccacctaggcatcccaaagtgttgagattacaggcatgagccattgtgcctggctcagttgaataaaatgttattgcatgtggcctatgtgtagtgaaatagaaagatgacaaagatacagttcttaccttccaggagcttacaaacatcaaagggatgagacttgttctctggtaagtcaagggagaccccaaaagccaaatgaaaagtacaagaatggggctgtgggatttatggagaaaggacatcgagggacactggaatccattttctcctctgtaaaatgaggggaggggcccagatgagtttcaaatcctttccagttcaaaattctgattccttggtgtattcagataaggtccatggaaaacatcgtcaagaaactagtatctgagctggtccttggatgggtaagattgggaaatgcggcggcttaaagaaataggaggaaaagcatttcaagcacaaaagagtctgtaagcacaggtccagaaagcacaggcatgctcgtagagcacaaagtcttcagtgtagacagaacacaagaggaggcaaaactggaattggagaccagaattttgaatgccaagcaaaggaatttggatttctttttttttttaaacagggtctcactctgtttcccaggctggagtgcagtggcgcgatgatggcttactgcagcctcgaacttcctggctcagctgatcttcctgtctcggcctcctcagtagctgggactacaggcacaggccaccaccatgcccagctaattttgtactttttgaagatgcagggttttgtcatgttgcccaggctggccttgaactcctaggctcaagtgatctccccgcctcggcctcccaaagtgttgggattgcaggtgtgggccaccatgcctggccttggatttcatttagtggccagagctgatacggtgtctgaagaggtagacaatacgatcaaacacagattaggacagctaagcagcagaatgcagctggagtgcttgaggctgccctgtccctctgtaggacccctctgaaggtcccatttacatgggcctcatctgccaaagaagccatgcttcatgaaatatacctcaacagacaaaacgaggtaacgagggctaaaaaaaatacaggagtccagaaaaccagaacagttttaggaacctaatgtgtctacacacaaattctgatgatgacaagaaggccagctactcacaaacaggccaaaggaaactggctatcaaatggaaagtgactataaagtggaaaaatggaaaaagaaagtgatataaagtagtaaaaatagacagatgggaaaactacagatgtaaaagaaagagactcctaatatctgtaagcaactggcagaaggaaacagaaatatcagagatctggaaatttcagcgtaggattatatgctcctcccactccaaatctgggcagcaggatgaacatttttagaaattagctgtcctaaaaaatgtcaaagaggagaaatcacagcattgaagcaattgcaaagaagcagtcctgacctgagttagtgctgataagggaggacaggacatggcaagagaggacggctagaaaggcaagctcagcatttctactacaacagccattctgaaatacgatgcctcaacagaagaacagaatcaaataaaaagggaaatggttcacagataacatctggcccctcaattattaaagagtatctcctccctacacacttttcccttcattgcctccaacagcctccttaactagatccagtaagacttacttcattccctccaatggcctccttaactagatccaataagacttataaaacttttttttttttttttttttgagacagtctcacccctgtcgtccatgctggagtgcagcggtgcaatctcgcctcactgcaacctctggctcctgggttcaagtgactctcatgcctcagcctcctgagtagctgggattacaggcgtgagccgctgtgcccgctgtgcccggccaacttgtaaaattttttaatgaatcttgagtcacctgcctgctggcaaagcgaggtacgaggaaatggtaactatgtcaggttactatcttttacagccacaaaatatcaaaaccccaacaactcagctgacgaatgcagcaacctcatttagccacagcccacaaaataaaagagggcacaagagatgcccgacacgaaggagaaagacaaggaagccccagtgttctcatctggcctcgggtgagcggtgccacagttcacggtcctggtccaagggacactgagggacagcacgtggctgctgtgggcgcctgccctgtcttgtcctgccatgtatgaaacggatcaatcggaaagtgctctgcaagagggcacatcgacgttttggtcatctggttgccgggagaaaccaggggagcataggtaatatggaggaatgagttacttacttgccgtccatcctgccccacgttcgtctgacctcttacaacagttcgaatattgtcatccagtctcctagcaaaacagttcaaggatacagtcattcaaataatctttattctaggttgaccaaaagaaaaaaagtaaaaagtaatttattcatcaacttctgcagactgcacctaattgtccagaaaaccaaacatgtgtgagtggcatcaggcaggaggagggcagcgacagccgtgcgggaagtcaagcccagtgcaggctgatgcatcgccttgttgttaaaaatgcctattttcacttaatagtcagagctatctgaaaggactaataaaatctgcaggatttttcatggagtacatcaggaatgacaaagttccggagcctttacgtgaacatgccagataactcaaattacctcacacacaatccctttctcggtccccttatgaggcggaaagagccagagtgatagatggaatcagtgcttccgggccctgatcatgcaatccatgcctgaggcagatctacggcttccagctcctctgcccccacggttcacaatgtttaatcatgggccaccacccaacccaccagcagatctgacatggttagctgttatgtgaccaagggatacacatataagcccatcttcatgtctaagccttgggaacacaaaaacaggtaaatccacaaaaacagggaaataaagccattaaaaagctagtcgaaggacagacagaatggctcacacctataatcctagcactttgggaggccaaggcaggcagatcacttgaggctaggagttcaagaccagcctggccaacacagtgtaaccctgtaactactaaaaacacaaaaattagctgggcatggtggtgcatgcctataattccagctacttgggtggctgaggctcaagaattgctcgaacctgggaggtggagattacagtaagccaagatcacaccactgcactctagcctgggtgacagagccagactccatctcaaaaaaaaaaaaaaaaaatctagtagatgtgggagactgaggcaggcagattgcttgagctcagcagtttgagaccagcctagccaacaaggcgaaaccccatctctacaaaaaatataaacattagcaaagtgtggtggtgcgcctgtagtcccagctactcaggaggctgaggtgggaggatcacttgagcccaggagttcgaggctgcagtgagctgtaactgcaccagtacgctccagcctgggacacagagtaagaccttgttttgaaaaaaaaacagaaaaaaagaaaaaaaaaatctatcagaaaagcttttgcctccttctataattacaaaagatgttttgagtagactctatcacagcttccttccttttgtatgaagaattgaagactggccaaagcattgagttccttgccacaaagttcatatggataaaataattatatggccgggtgcggtggctcacccctgtcatcccagcacgttgggaggcgaaggcaggtggatcacttgaggtcaggagttcgagaccagcctgaccaacatggtgaaaccccgtctctactaaaagtacaaaatttgccaggcgtggtggctcacacctgtaatcccagctactagggaggctaaggcaggagaatcacttgaacctgggaggtggaggttgcagtgagccaagatcacaccattgcactccagcctaggcaatgagcaaaaatccgtctcaaaaataaataaataaataataaaaattttaaaaggaattatattaccatctatggcaaacttgagatttcagtgctctcacagaaaaatgtgatccagaatgtgattaactaaattaacaatatacttttcattaattatgaacaatcacacagctttactcaccttattttcagcctaattttgttcacgacttcgtctatgttcgccagagactacaataaagaaggaagagtgcccagctgttagtccacttcctggaattcctctttcacaggaaaatgatgtgctataatagctacttatgaaatctcaaaaaatttaatcacatgatatgagttttgctttaaaaaaaaaaaaagtaaagcagtagttggaagctacagccacatctagcccagcccctgttttttgtaaataaagtttcactggaacacagccatgcccgttcacttacatattgcctgcggctgctcttaagctaacatggcaggtaggcagtcgtgaaagacgctgtacagccacaaagcctgaagtatttactatctggacctttacaggagagtctgctgacccatggtgtacgtgattgtgacaaattcacgtaacgaaatacagcaacaaaaatgaatgaatgcacaacaccatggataaacattttactaacggaatggggcacagaaaaagccagacacaaggggacagaggatatgatttcactaacataattctcctgttagaagctaggacagtggttatctctgggggaaggtagtgacagtgaacaggcaaggaaaggccttctgaagatttttttaaatgttttatttcttgatctgggtggcagttacatggctatgttcattttgtgaaacttcatcaagttgtacccttaagatttgtgtactcctctgtattatgttatacttcaataaatacacaaatttattttttattatatagatccactagaaaaaagtctggaaggatagataggagtaattgtaatgtattagtagttgcagcattagtagctataatctatcaactacgtattgcaatatgaaaagaagtgatttcaaatttttcttcttgggccgggtgcagtggctcacgcctgtaatcccagcactttgggaggccaaggcaggcggatcacctgaggtcaggagtttgagaccagccagaccgtcatggcgaaaccccatctctactaaaaatacaaaaaaaaaaaaattaggcaggcttggtggtgggcacctgttgtcccaactactcaagaggctgcggcaggagaatcgcttgaacccgggaggcagaggttgcagtgagctgagaatgtgccattgcactccagcctgggcaacaagagcaaaactctgtctcaaaaaaaaatattttcttctttttgtctgtattttataattattgactatgcactactactgtgattataataagcttattataacaacaattaaaacaaagggatcacttctgaccttagagatgagaaaatgtgaggaaatggtgccccctaatggacaagaggaggtacaattttatagtactattttaattcaagttttcaaaatacaatttaataaatcctcttcctctctcccttaacaaatattttatctcagaaggaattagggatattgtaggaaatatgcttataaattgcttctggctacctctgatgggaggaggaggccaggtgccttccaggagcaggtctggtaagagaaacaggccatgagtgtttgagatgtcagactgggttgtcacagctcatcctactgttctgaccaagccaacagttactcagaattttcagaaatccaagaacagcttgaggtaaaaatgaatctcaggctggacgtgatggctcatgcctgtaatcccagcactttgggaggctaaggtgggaggatcacttaaatccaggaattcaagaccagcccagacaatacagtgagatcccatctctccaaaaaataaaaaaaagttagccaggcatggtggcatgtgcttgcagtcccaggtactcaggaggctgaggtgggaggatcacctgagcccagaaggtcgaggctgcagtaagtcatgtttgcaccactgcactccagcctgggctaaacagccctgtctcaaaaaaaaagaaaaacgaatctcagaaaaattactttaatttatatataattatatatatacatatatttttgtgtgtgatggagactagctctgtcaccaggctggagtgcaatggcgcgatctcggctcactgcaacctccgactccctggttcaagcgattctcctgcctcagcctcccgagtagctgggattacaggcacatgccaccacgcccagctaatttttgtatttttagtagagacggggtttcaccacgttggccaggatggtctcgatctcttgacctcgtgatctgcccgccttggcctcccaaagtgctaggattacaggtatgagccaccgcgcctggccaagaggaaaacatttctaatatcattttatgatagcaagtatttttataatatcaaatagcctacctttaagatggcggctcactctgtcaccaaggctggagtgcagtggtgcaatcatagctcactgtaacctcaaactcctgggctcaagcaatcctcccaccccagcctcctgagtggctaggaacaaaaaggtacatgcactgagcctggctaattttattattttgttataaacacagggtcttgctatgctgtccaagctgatcttgaattcctggcttcaagcaatgctcccgccttggcctcccaaagcactgggattacaggcatgaggcagtgcacccggccctataatatcatttttataatataatgaatgtagcttttaaaaagaacagaggccgggtgtggaggcttatgtctgtcctttgggaggctgaggtgggtggactgctagagcccaagagttagagaccaacctggacaacgtggtgaaactccgtctctacaaaaaaatagaaaaattagccgggtatggtagcacacgcctgtagtacaatctgcttattaggctgaggaaagaagactgattgagtctgtaaattccagggcacagtgagctgtgatggagccactgaactgtagcctgggtgatgggtgacaatctcaaaaagaaaaaataaataaaaataaaataaaaataggctgggcgcggtggctcatgcctgtaatcccagcactttgaggccgaggtgggcggatcacaaggtcaggagttcgagaccagccaggccaatatggtgaaaccccgtctctactaaaaatacaaaaaaaaattagccgggcgtggtggcaggtgcctgtaatcccagctactcgggaggctgaggcaggagaactgcttgaacccaggaagcagaggttgcggtgagccgagatcgcgccactgcactccagcctggataacagaaggagactctgtctcaataaataaataaatagaagagaaagaaatatcctaaagttacactatttgatagtcaggtggcctttgggtgactgttttcccttcatttccaggctttctgctggaggggaaagggaaaggctgctagcatttaatgtggatctcctaggcaacaattgcaggcacttcacagaaattatttcccttaatcccctctgccaggcgaggcacacttttctcctcttcaacgttaagattgggaactatggaggcggaggccgggcatggtggctcatgcctgtaatcccaacactttgggaggccaaggtacgtgggtttcctaagctcagcagttcaagaccagtctctgggcaacctggcaaaaccctgtctctaccaaaaatacaaaaaactacctgggcttgctggtgcacacctgtggtcccagctactcaggaggctgaggtgggaggatcgcttgagcctgggaggcagaggttgcagcgagccgagatcacaccactgcattccaacctaggtgacagagtgggaacccacctcaaataaaaaacagatgggaaacgtgctctgcaggacaggtgctttgcctgaagctgcagagatcccacctcaaataaaaaacagatgggaaacgtgctctgcaggacaggtgctttgcctgaagctgcagagatcctctttcttactctagcatctacctctaacgcaatgattcttgacctaattttcctgcaccccaagacaccggacagctatgacacacccactctcatcagttagttcagtgtctggctatggcagtgatcctcaccagggtcgagggcctctcctggagttggggaaaagccctgtgggaatccacattggctgggcagaggggtttatcctgctttgagaatcactcatctcgtttagttataatgtggttgtacagttttgtttactttttaaatgttttagttattgcaaaatatttcctgattctaatggtaattcttgacaattacagaaaataggtagtcatctgcacacccaggacagtatgaccacaatcagaatttttgcgtattgccttctactacgaaactgtatagctgtacaaaaataaactgggatgataagcaatttggcatcttttttttttttttttaaggcaggatctcattctgtcacccaggctgcagtgcagtggcacgatctcagctgactgcaacttccacctcccaggctcaagcgatcctcctgcctcagtgatccacccgccttggtctcccaaagtgctgggattagagaatacagccatgagctggatcttgggtttttttttctcttaacaatacagatccagagcatttttggggtcaccagaaactctttagaaacatccccatataactcttttctcaaagttcctaattatgttagttttgtattagttttccataaatttcatttagtttcctctaatcaaactttcaaatgattatcttcagtttactattaggaggctaaaacgattttctagaccactgcgaccaaacctggctactatttaaaccccacaggcactctgctgcatggaaaatcccaagctcctctcaggcctggctgggtgaaatagtaagaggcatccattccaggccactcaacaggctccagacaaccgcagacacacaagtacttccactcaacagaaacatattctcaccctcctcctcacagtaacactaaattcactctggaaatactgaaatctactttaaacaatctaaactcataatgtacaagtgtttactggaggtccatgaggtatacagatggtttttgcccaatatctgacaatagttaaatttcaagctatgccactactttctactaccttttcattaagatccacaggaatctggcttagatttcactcagatgacctgctaagtgaaactctgagactagagaagtaaagataaccctgtgtcataaatgttctgagttactctaagaaacgtgactgtacattatcatatacctggggcataattagacaagacacagaactgaatctgtggaacaacaaagatcttgagttttcagtagtttaaaaaaaaatacagcacatacacacacaccacaagaggtgagaacctggtggtttcctacaaaattttcaaatctaacacttctttttgttttggtgaatcagcaattactatctttatcctagctattcccaaatgtctatctccagctaattcctaaaattcccctttcatacaaaatgatgagctataaaggcttttcgtgaaatctcaaaaaagacaatcacacagtatatcatcttttaaactttattttaaaaatcagtatatccattaaaaaaagtttggaaggatctgccaaaatattcacaatgatggggatcaagagctctgcactcaaatacccaacaacttatttccacctggatgacctgagtatgttcaaacttgggctcaccttacagcccactccagccctacctgccactgaaacctgctctttctccttacactcagtaattgggtaaagtggaaagctgccattacccatccagtcagccaaatctggctacctagaaaccagttcaaaattcttaacttagggccaggcacagtggctcaaatctgtaatcccagcactcggagaggctgaggcaggagggtggcttgaggccaggagttccagaccagcctgggcaacacagcaaggcccagtctgtaaaaaaaaaaaaaaaattaaaaatcagctggggctgggcgcggtggctcactcctgtaatcccagcactttgggaggctggggcagatggatcatgaggtcaggagatcgagaccatcctatcctggccaacatggtgaaaccccatctctactaaaaatacagaaattggctgggcgtggtggcgcgtgcctataatctcagctactcgggaggctaagacaggggaattgcttgaaccagggagtgggaggttgcagtgagccgagatggcaccaccccaccccaacctggtgacaaagcaagactccatctcaaaataataataatactcagctgggtgtggtggcacacacctgtagtgctagctactgaggaggctgaagtgggaggagtgcttgagtccaggaatttgaggttgcagtgagctatgattgtgccactgcactctagcccgggcaagagagtgagaccccatctcaaaaaaaaattattaacttggcctgtagtattcagctaaaacaccatttcctcaagggagtaagccttttcaatccatcttgagcaagtaaggccctgggttctgctgtcactgtatttggcatgcttccttcatggcaacgctatcacatttaagccgagtgttatctttccgtgcctcgtgattcttactctaaaataagaaggataacaaagtggagtttatcactgtttagtgcctagagtgctgtcgggtacacaggaagtatctaataaagattactattacagttgtagtaaaggttatataagagcaagtgacaaataatatttaaaaattatatgagcaagtcaggccaggcgtggtggctcacgcctgtaatcccagcactttgggaggtcaaggtgggcagatcacaaggtcaagagattgaaaccatcctggccaacatggtgaaaccccgtctctactaaaaatacaaaaattagccaggcttggtggcgcgtgtctgtaaactcagctactcaggaggctgaggcgggagaatcgcttgaacccaggagttggaggttgcagtgagccgggattgtgctactgcattccatcctggcaacagagtgagactcagtctcaaaaaaaaaaaaaaaaaattacacaagcaagtcattgtaacatcataatttacctataatctgttactgtgagattaactatcaagatagactatgaagtctgtgttggtagactatatctgtcttgctcacttctctaccccagatttcttataaagctaggtagagtgggtgtttttttaactgaataaacgaatgagtgaattttggattctccatgaccctctactttcatgccctcaggtaccaaactgcatgactttggtcccctcaatagctctcagatctggttctctctatcccacagcttttctccaggtctcaccatctctttccagtgatctactgcgtgagtctcctgcctgtagtctctccccacctccatcccttgctcgtcctccacatggctgccagacggaattttaaaaacgtgaatgtgctccagtcattatcctgccaaaagtccttcaatgaatactcactgcctacagcagcaacctccagagcagggtgcgaacgtccccacggggtctgccacactgccccctggggtgtgaggagcaaacactgaagcctctatgtttattttctatttatatagcaaatactactgaagcctaacatttaaaattggtactcacatatgtatataatattctggggatacaggcttaaaaattatccaagtgaaaatcagctctgtgggtcgggcgcggtggctcacgcctgtcatcccagcactttgggaggccgaggcgggcggatcacctgaggtcaggaatttgagaccagcctggccaacatggtgaaaccccatctctactaaaaatacaaaaattagccgcgtagtggcaggcccctgtaatcccagctgctcaggaggctgacacaggagaatcacttgaacccaggaggcagaggttgcagtgagccgagatcatgccattgcactccagcctgggggacaagaatgagactttgtctcaaaaaaaaaaaaaaaaaaagaaaatcagttctgtgaaaaatatttgggccaggtgcagtggctcatgcctgtaatcccaacattttgggaggctgaggcgggaggatcacattagctcaggagttcgagaccagcctgggcttcgtagtgagatctcgtctctactaaaaaaattttaaaacttagctgtgtgtggtggcatgcgcctgtagtcgcagctactcagaaggccgatgtagtgggagcgctagagttcgggagttcacagttactgtgattgtgccactgcactccaacctgggcaacagagtaaaactctctttcaaaaaaaaaaaaaaaaggaagaaagaaaaaaagcatttcactgaaaggcatgtggtctccaaaaaaactggcaacgataagcctagaggacagagatcctccaggatccttgctctccctcctcagcctcatctcctgtgagtctctgctcactgtgcacatcttatgtctcctgtttctgtgccttggtcctgtgtttagaagggccttctgtagggtccagccctacggggccttgtgggttttctcttcgtgtgcggagacgagagattgtagaaagacacgaaactaagaagtagtaggaaagacagctgggcccggggcaccactaccaccaatgcacagagtccaatagtggccccgaatgcctggacccactgctatttattgtatacaaggcaaggaggcagggtaaggagtgtgggtcatctcaaatgattgacaaggtcaagcaagtcacatgtccacgtgacagggggcccttccctttgtggtagccgaagcagagagggaggacagcagacgtcagcattttttctttgcacttatcagaaagatcaaagactttaacactttcactaattctgctactgctatcttctaagaacttaaaggaggagccaggtgtacaggtggaacatgaaagtggaccaggagcatgaccactgaagcacagcaccacagggagatgctgaagcctccggatgactgtgggcaggcctggggaatgtcaggccccccacgagagctggtggagcagagtgttctctaactcccccagggaaagggagactccctttcacagtccgctaagtaacgggtgccttcccaggcactggcactaccgcaagaccaaggtgccttcaagcagcccttatccaggcatgacagaggttctcactgttgtcttctggtctcctgactctgtatggcctggtttttccttggtcgtaataatgaaacaaagattaatactaaagactaatgattgataatatccatatacaatcatctctatatcctatttctattataactctacttatttaactattttctttattatattggaacaggttgtgccttcagtctcttgcctcggcacctgggtttctttccgcccacgccttccttccctcatcatcctggaagagatacctagctgctggctctgtctagaatactgttctgccagactgctgcaagcttgactccttcctgtccatcaggtctcagcttagagggaaccacctcacagagaacttcccgttaagcccctttatttaaaggaccctccgcagcacgctctgtcacggaacctgcctggtatcacggcgcatcacgctctgtcacggaacctgcctggtatcacggcgcagcacgctctgtcacggaacctgcctggtatcacggccaccatgtttgatcatctctagtgtatttgttggtttatttcttgtctttctccctacactagactccataagaccaagaccagatttgtcatgtttacatttctccctagtttctaaaaataatacctgacacttagcagacatttaataaacgactgctacgttttactaaatgaatacatgaatgaatccctcaagctcggcagacaggctacctcctctctgaagttgtgattttccttggaagaactggtctttgtttccttaccgcactgtcccactgtcactgacggcattcgccagggtctcccaccacttgatcctgcacacctcaagggcatggactggaccttatcatctctgcaccctcagcacctagcacagtgactgacaacacatgacaggcacctactgaacaactgctgactgaaaaaatggaaacgaagcgggactctcactgcccttctcccaactctgctacttccagttctggtctacttctcacccaaacacccaaaaaccaattttgtaagaaaatccatctccacaggaaaatcaccggacaaaaaataataaaacgtgaagtctaaaaatctgtatcttgaggccgggcgcagtggctcacgcctgtaatcccagcactttagggggccaaggcaggtggatcacgaggtcaggagtttgagaccagcctggccaacatgctgaaaccccgtctctactaaaatcacaaaaattagccaggcgtgatggtgggtacctatagtgccagctactcaggaggctgaggcagaagaatcgcctgaacccaggaggcagacgttgcagtgagccgagaccgcgccattgcactccagcctgaacgacaacagcaaaactccgtctcaaaaaaactaataaatagaaataaaaatttacatcttgaaatagaggtgaaagtggctttatgattctgggcttatcctgcctgcctcacccccacttgtccctactacattataaaaatcctttccactttcaatttacagcagaaaatttgggaggactctcacaacctaagagtacaattattaataatatgttcactatacaatgaattccattccaacacagtgtagctcactgccccagctggtgatgatggagtttgatttgaatttaactctcccttgtgtatcaagggcccgtagatgatctagtgtaacacacgaagcataacacccaagatgtgccaaaagctgctgaaaggaaggaaacctgaaactctacttacttgctcggttgggaacagggtattgatatactcaacagcattgaaatctgctcgatctagagggtcctggcttggaaacacctatatagaaagagaggagtatatataaaaacatgtagtataccgtaaatatatataattttaatttgtcaattaaaaggaaagggccgggcacggtggctcatgcctgtaatcacagcactttgggaggccaaagcagatggatcacctgaggtcaggtctctactaaaaataaaaacttggctgggtgtggtgttggcgcacacctgtaatcccaactactcaggaggctgaggcaggagaattgcttgaacccgggaggcggaggttacagtgagccgagatcacaccactacactccagtctgggcgaaagagcaagactctgtctcaaaattaaattaattaattaattaattaaaataaggctgcgcggatcgcttgagctcaggagttggagactggcctgggcaacatggtgaaaccacatctctacaaaaaaaaattagctgggtgccatggcacatgcctgtcatagtcccagctacgtgggaggctgagatgggaggatcaccagagcccaggaggttgaggttgcagtgagccgagattctatcactgaactccagcctgggcgacagagtgagatcctctctcaaaaacagtccacctctaagacatacagctaactccctaacaacctgaagaacacgcaacaaggtggatgatacaagcagccaaattatccactggacactgggtctcacccagcttgatagagttacaactgtgggaagcaacttcatctctgaagaagccttccaaagaaatatagagtcaaaaaatcaaaatatcttcaagacaactgttagaaaagctgaagccttctaccacatcaagaggaggtggatgagaagaaagtgaagatgttttctttttaaaatgttcagcattgctgtttccataatgcacatatacacaggttatttacacagtctcaatgatacgtgctcaccagagggaaagtataacccacagagagcaggatacaagagatacaaactatttcctcaagttgctctcagtttctgtattcctctcacgactcctaggttttagtgctgtcctaggttttaaattgttttcatgtaacaaggctcctaacaaaagccagctgaaaaaagaatgactggttccaatgatggaggaaaaaaactaacagccctagacttatcagagatgcatacgtggtacttcatgggcaatttttttttttttttttgacacggagtctcgcgctgtcacccaggctggagtgcagtagcgcgatcttggttcactacaagctccacctcccaggttcatgccattctcctgtctcagcctcttgagaaggtgggactacaggcgctcgccaccatacccggcttattttttgtgtttttagtagagaaggggtttcaccgtgttggccaggatggtctcaatctcctgaacttgtgatccacccgcctcggcctcccaaagtgctgggattacaggcgtgagcctccacacccggccttcatgggcaatttaaagaacttcagggcagagtgattttcatgtctagagtgactttcgccttttttttttttttttttttcgagatggagtctcactctgtcgctcaggctggaaggcagtggcaccatctcagctcactgcaacctctgcctcccgggttcaagcagttctttgcctcaacctcccgagtagctgagattacgggcacctgccaccatgcccagctaaatttttgtatttttaggagagacggggtttcaccatgttggccaggctggtcttgaactcctgacatcgtgatccacccgccctggcctcccaaagtgctgggattacaggtgtgagccaccgagcccagccaattttcaccttatgcaatgactctgggacttcatcttggagtaaaatgtgattccattttatcaacccttcctgactcctcacacatcactactctttacaagtatgctactacagaatttcattcagagtgctaaagtaagaaaaaattctgaattcatcttgacataatgatgtctgaattctgcttgacataaagatgtctgctatactatcactcaaacttattcttacaaaataggaaaaatgtcagaattcaccgctatgtaattcatccatgtaatcaaaaaccacctgtaccccaaaagctgttgaaacaaacaaaagaaatagcaaaaatgtgcttttctgatacctgtcaaccaaacagtaactgactgcattattcttttcttccatgagagcccactagtccaaagagcaacagaaatgttatgtctttttctggcaaaaggaggtaagtggtggagccgtgtggccggaacactaaaagcttcctgcccaatggtttggcgttctcaggctaggacaaagttggttgtataagtaatccaaccactactggaaaaacacacatcgaagcgtcaatgaatgcacctgtagtcccagctactcgggaggctgaggcagggttatcacttgagccccaggagttcgaggctgcagtgagctacgattatgccactgtactccagcctggacaacagagcaagaccctatctcaaaaaaaaaaagtttcccaggggtcattaaataaggcataatggaattgtccatttcctcaatcataaatccctttcttaaatcatataacttcatgacaattcctttaagggagattttctccgtttatcaggagcaataccctgcagtattagaaatcactatttctgaccgggtgcagtggctcacacctgtaatcccagcactttgggaggccgaggcgggcggatagcctgaggtcaggagttcaagaccagcctggccaacatggtgaaacccggtctctactaaaaatacaaaaattagctaggcatggtagcggttgcctgtagtcccagctactcaggaggctgaggcaggagaatcacttgaacctggaagcggaggttgcagtgagccgagatggcacccctacactccaacctgggcgaaagagcgagactccgtctcagaaaacaaaaaaaaagaaaaaaagaaaagaaaaaaatcactatttctaatatcattagccttaaaaactcaataaacttgcaaaggcaagagttcctgcaggcagggccgcgcgtggtggctcacgcctgtaatcccagcactttgggaggccaaggcgggcgggttacttgagctcaggagttcgagaccatcctggccaaaacggtgaaacccccgtctttaccccaaaaaaaaaaaaaaattagccgggtgtggtggcgtgcgcctgtaatcacagctactcaggaggctgagacaggagaatcgcttgaactcgggaggcggaggtcgcagtgagccgagatcgtgccgttgcactccagcccgggcgacagagcgagaatccgtctcaaaaaaaaaaaaaaaaaaaagttcctgaagggaaaagaggccccttgggagtattctccaacctcacccaaactattcaacggtaggaattctcaaccttttaagaatggtaacgatgtcatttttcaacactttctctcttctctgccgtccgcttcagaaattaaagtcattcccttcccccagttccaagccactcacgaggtgccagcttgcaaaaccggggcgttggcacgagtctggtaaatgcatgaagcccccacagtccccagaatctgaggatggcacccaaggcctgcattctcctagcgtcgtcctctctaagcgcacaattcctttccccaaaaccaccagaacccccagccctcgccaaagacaatcaaagcctagaaagggttctctttcctttccttctgattcagaaaccgcttctcacccgcaccacctccccacctccactttcccttctgccgcgagcccccggccctccgtccacccgccgcggcctccccagcgcccggagctgccgtctcccctcccgcactcccgtttcccctcctgaggggcggaacgcttacctgctcgatggccagctgcacctcgggcgtgagctgcagcacggcttccagctcctccacgaactccagttcctcctcctccatcattccgccacccggccccctgccgacccccgccgcgagcccaactcaggcctccagccgccacccaggccccagcacagcaactccctcgcggcagcgacctggtgagcccggctccgtcagccgctctgtcagccgctccggcacttccggcaggccagggcacttccgggaccggggaactgtgggatcacggcggactgagactggcggcgttcctgtcacgtcaggtgtctcccgggcaacgcagtatcccggcggccccgcgtggcctcagcgcgtccttaggatgggcggggcctcttccctccccaaggcgcgccccgcactgaggaccccgaggttggggtagggtctggcctccagcaggacgcccggatgaaagtcagccctgcggcgtcgccaaccgcagcccacagcctccgcgggcagcgcagcggcgacctctcagctcccggggccccctcggtcagtggcagcgggtgtccccggccacgggggcgacgtgatcccagctggcgagtggcgatgtcgccaaggacattcgtaggacgggacagtgcccactcgatagaaattccccgtgcgccgggctctgcgcagaagcttttcgaggtgactgcagcctccttatggggagaaacgtcttttttttttttttttttttttttgagacggagtcttacttgttgcccaggctggagtgcaacggcgcgatctcggctcactgcaaccccgcctgctgggttcaagcgattctcctgtctcagcctcccgagtagctgggattacaggcgcccgccaccacgcccagctaatttttgtatttttagtggagacgaggtttcaccatgttggccaggctggtctcgaactcttgacctcgtgatccgcccgcctcggcctcccaaagtgctgggatgacaggcgtgagctactgcgcccggccagaaacgtttttttaaagccagatgacgcagcgccctggagctggggagacgtttactgaggttgaatatccgggatctaagtcctgaatagtccaccattgataagttgtgtgacttggaacaaattactaccccgcgtcgatgtggagaggattaaacattaacagcgcgatgtaaattcaagctggtaatacaggaaatagtgaggtgcccagcccttacccccacaaaggaacaaataagccagatcaccgatcaccctgtgaaaccacctttcctgcagacactgaaaagaaggagggaattgcagcccaaggaggacccgctccaccaggtgaaccgggaaactccaggagggaaacgcgttggccccactgaacttttttttgttgttgttatcagagttgctcaaagtaaaaaataggagcagtatgattttttcttttatttttaattgacaaataataattatataaacaatgtaatttctaacaacaaaggaatgctaaaaaatatacattaaaaaaagaaaaaaaagacaaaataaaatatacattgaacctggtgcagtggcacaggcctgcagccccagctactcaggaggctgaggcagggaattattgactttctgagattgaatatcaggggtctagatctcatcccaccactgaggatcgcttgagcccaggagtttgaggctgcagtgaggaatgattcctttgcgccactgcactccagcctgggccacaaagggagactctgtctcttaagtaaacatagaatattattgattcataaaatcatgattttgaaaattaatgacatgaaaaatatgcacaatatatttcagaaagcaaaatgtataatttcatttaaaaaatgcatagcatggtcccagctttgtgtgtattctgtgccaataaagctcacagcaaggaaatattacttttctgcacgtgatgaatgtacatcctttgtacattttcccaaatgtctacaatgagcctgtagttctctcatgctcagaaaatatgaatgcctttttctaaaaggaaaaggtaattatagctacttattttggactttttttttcctttaaaaaattaagatatttacatacagtaaaatttactcttgcaatttatgatgcagtgagttttgataaatgtgtataaacgactgggcatggtgactcacgcctataatcccagcacgtggggaggccgaggctgccagatcacttgaggtcaggggttcgagaccagcctggccaacatggtaaaacccgtctctatctactaaaaatacaaaacgtagctggccgtggtggtgcacagaatcacttgaacccgagaggtggaggttgcagtgagccaagattgcaccattgcactccagcctgggtgacagagcaagactccatctcaaaacaaacaaacaaataataagaaaacaataataaaacaaaataaataaatgtatataaccatgtaactactaccacaatctagttataggacaatttcattcccccaaattccctcttgcctcaccccatccactggcaaccactgacttgatttctgtccctatagtttttgtttttgtttttgtttttttgagacggagtctcgctctatcacccaggctggagtgcagtggtgcaatctcagctcactgcaacctccgcctcccgggttcaagcgattctcctgcctcagcctcctgagtagctgggatgacaggcacgtgccaccacacctggctaatttttgtatttttagtagagacagggtttcatcatgttgcccaggatggtctcaaactcctgacctcaggtgatctgccagcatcaggctcccaaagtgctggggttacaggcatgagccaccacgcctggcctgtccctatagttttgatatttccagaatatcatatagatggaatcatacagtatgacaccttttcagtctggcttctttcatctgtcataaagtatctaaaattcatccatgttgttgcatgtatctgtggttcatgtcttcttgctggtattccactagatgaatacaccactatttgtttatctagtccctggttgaaggacatatgggtttttccagtttttggcaattatgaataaagctgctataaacattcatgtacagatttttgtgtgaacataagttttcatgtcacttgggtaaatatgtagatgtgggattgctgtgttatatgatatgtctgtgtttaactttctaagaaactggtaaactgttttccaaagtggctgtatcactttcacattgctaccagcaatgtatgagagttctgtttgctcagagagcttatttttaatgatgataataagaaggaaaatttcctagcccttactatatgacaggtaccattcgaagcatgttacatgcattgtctcttttaattcacacagcaattctgaggttgttagtttttattactatacccatctaacagataggagatgaagatctagttaaaacaagcaacaaaataaaaatttgcctaaggccgtatacctaagtcttcctgccgttcattaagctagtcaatacatttattgaacacctgttcctgttagcgacaggtactcaagctaggtgccgggaattcagcagtgaacaaaatagaccccatgcttgcctctacagagctatttctatgtatgaaaagggcatttgtacaaataaacatataattgtgatagatccgataaaagagaagtaaagcacatgttgagagactatatggttagagttctgattggattaggggtcaggaaagccttttctttctttttctttttctttttttcttttttttttttttttttgagacagagtttctctcttgttgcccaggctggagtgcaatggcgcgacctcggctcaccgcaacctccgcctcctggattcaagtgattcgcctgcctcagcctcctgagtagctgggattacaggcatacgccaccacacccggctaatttttgtatttttagtagagacggggtttctccatgttggccatgctggtcttgaactcctgacctcaggtgatccgcctgccttgacctccctaactgctgggattacgggtgtgagccatcaagcccggccaggaaaggcttttctgaggaagtgatttttaagctgaagccaagggttggaagtgaagataacacatagataaaaggaacagaatgtgcaaaagccatgagtatgaaaagagtcggccagggtgatggaagtttgaaagcccaagggagagtgatacacgaggaagctggagaaatgggcactgccggacggtgaaggatctggaaggtcttcttgaaggaatgggaagcctctgacggactgtaagcagaggaggggcatgaccaggtttaccatgcctgccatcagccctggtctctctgttttttgttttttgtttttttctttgcctctgagcttcccatattgttgtggagaatcatgaaaccagggtgaccatgttcagcacaaattcctgttgccttatttccactgattctcattgtccttctcagcatccattgtccgttctcaatggcactctcccgtgacccaaaacctttgcctcctctggagctcccaactccatgataccccttctccctctttgcagataagctactaataatataagtttgagtttaggagagttatgcagtacaaagaagtaaaggaagttaaaagagcagagagataggttgacacactgggttttaaaaaacttctttaagtaataacagactagattgattcatttatgtcaaacaaaagaaggaaatacctttgacaggaggtggaaatctagaaagagattgtatacttctgacagaaataaaatgtggaagtttatggatatgagaaatttgggtatgaaaataaggagcacgtgatattttcacaaatgagctgggctcaaaaaaaacaacttccaggctgggcacggtggctcacgcctgtaatcccagcactctgggaggccgaggtgggtggatcacctgaggtggggagttcgagaccagcctgaccaacatggacaaaccctgtctctactaaaaatacaaaattagtctggcatggtggcgcatgctggcgcatgcctgtaatcccaactactcaggaggctgaggcaggagaatcacttgaacccgggaggtggaggttgcagtgagccaagattgtgtcactgcactacagctttggtgacaaagcaagtctccatctcaataaataaataaaatacatacatacatacatacatacatacatacatacatacaaaaaattagctgggtgtggtggtgggcacctgtaatcccagctactcaggaggctgagacaggacaatctcttgaacctgggaggcagaggttgcagtgagccaagatcgtgccattgcactccagcctgggtgacacagaaagattctgtctcaaaaacaaacaaaaaccaacttcctattttgctgtaggatagggtatagtgatgacaaagtttcacagaaaacatttttctaccttgaaatttcaccgtctgaggcagaaattcagtctctaatactttaaaagtaaaacaaaacgaaaccttggagactgtggcctttagtaggcgatgggggaggatggattggaagggagtatacagtaggctgtgagagagatgggggaggagggattggaagggagtatacagtaggatgtgagggagttgggggaggatggattgggagggagtatacagtaggctgtgtaggagatggggagaggaattggaagggagtatacagtaggctgtgagggaggtggggaggatggattgggagggagtatacagtaggctgtgtaggagatggggaggatggattggaagggagtatacagtaggctgtgagggaggtggagaggatggattggaagggagtatacagtcggctgtgagggagttgggggaggatggattgggagtatacagtaggctgcgtaggagatggggaggatggattgggagtatacagtcggctgtgagggagttgggggaggatggattgaaagggagtatgcagtaggctgtgtaggagatggggaggatggattggaagggagtatacagcaggctgtgtaggagatggggaggatggattggaagggagtatacagcaggctgtgtaggagatggggaggatggattggaagggagtatacagtcggctgagggagttgggggaggatggattggaagggagtatacagtaggctgtgtaggagttgggggagcatggattggaagggagtatacagtaggctgtgagggggttgtgtggcaccccttgaggaaacgtcagactaagatggaaacataacaccaaacctcacatgaggagtttccataacgtttctcaccttgccaaaaaatgctttacgtatactgtctagaaataggaattttaaaacagcctttgttaatgaaattcagtgagatctctaaatgtcatgtgtctgtgtcaatgtagcgttaataactctgtggaaaggaatctccaatatccggttatatttgcaaccttgttgtcagagcgcagaggtaactgccccgtcatatacggagtagacactgtgcaaagtgtgttcttccataagatcaagacggtatctttccacataagcttccctctctgtaaggaccttctccaaaatagctgagccttctgtaaaactgcttgtgaaaaaagaattgcaggacgtctcaattacctggtccatgcccactaaatgccagtcaagcagtacctttcctcaacagtgacagaagcagcaatacctcccacacatctccaaaatgccccctaggcttcccaagcaatcacctttagatcctatcgtcactctgggtggcacaaggtcccaggccaacttgtagtggaggaatagggtataatttccccttgaaatcagctcaaaatgttctcttggtgcttctttatggactgtttctagtacgtggcttttcacgatgactggttctttcactgtccttgattcctgaatttcctgaatctcctggagcctggcatttgttcttgattgacattcggatggttctgaaccctccctgtatcctggacaccagttttgtttaggttggtactctggttctctgcatgcccattcttgctaagccggtcatgatttccagctagtttcagcagctcccctgttcccacggccattttcacatgatatctcccaaaggcttttaaaatgaaaaccttttacactggctacgttgggttcatattaaagcaatcctttcccttactcaaggaagtaataattatataggccaaattaataaaccctcttgtgcaagttttatatatgccaacaactataaaaacactttttacaaaactgacattaactagtacaatcattataatgtagctaacattaattcatcgtatctaaaacccttaagcatcttccataacctgttttttcgactccacttcttcctgcattcccagagctggatcttcagctgccacgcttcttcctcgtgtacaacagtagttcttaatctgttttgagtctggaccccttggaggagctgaagaactctacacagatcctttccctggaaaaatacacatttgcttagcattttgcatgcagttttaatgaagggtgtttcatagaatatacatacatatatatatattttatatatatataatatataatatatatatatatatatatttttttttttttgagacaggatcttgctctgtcgcccaggctggagtgcagtggcgggatctcggctcactgcaagttctgcctcccaggttcacgccattctccggcctcagcctcccgagtagctgggattacaggcacctgccaccacgcccggctaattttttgtatttttagtagagatggggtttcaccgtgtcagccaggatggtctcaatctcctgaccttgtgatctcccgcctcggcctcccaaagtgctgggattacaggcgtgagccaccgcgccctgccgtttcatggattatttatttatttatttatttagagacggagtctcgctctttcgcccaggctggagtgcagtggcgcgatctcggctcactgcaagccatggaatattttttaacctttttttttttttagcccacgcttctttctgctaaacctaaaaatgttgtgaacaaacctcccacatgcagtattttgacaagaggtatgatcttcatcactgtaatttgacaatcactgatatgtaaattacattctcccttcaccagcccagaatattttgctcagctaaccttattttagctttccttcaggaaatcagtagaaagtttatatttcctggggccaggcgcagtggctcatgcctgtcatcccagcactttggaaggctgaggcgggtggatcacgaggtcaggagttcgagaccatcctggccaacatggtgaaaccccgaaaaaaagaaaaaaaaatacaaaaattagttgggtgtggtggtgcatgcacctgtaatcccagctacttgggaggctgaagcaggagaatcgcttgaacccgggaggcggaggttgcagtgagccgagatcgtgccactgcactccagcctgggcaacagagcaagactccatctcaaaaaaaaaagaagaaagtttatatttcctaaatataatgttgttcaaggccaggtgtgatggcttattgggaggccaaggcggcgagaggatcacttgaacccaggagttcaagactagcctgggaaacagagggaaacctcctctctaccaaaaaaataaaataaaataaacaggtgtggtggaccgcatctgtagtcctagctgcttgggaggatcccttaagcccaggaattctaggctgcagccacccatgaccatgtcagtgcactccagcctgggtgacaaagcaagatcttgtctctaaaatatatttaaactcctgattggacacggtggctcacgcctgtaatcccagcactttgggaggctgaggcaggtggatcacctgaggtcaggagttcgagaccagcctgaccaacacggtgaaaccccatctctactaaaaatacaaaaaattagctgggcgtggtggctcacgcctgtaatcccagcaccttgggaggccgaggtgggtggatcacctgaggtcaggagtttgagaccagcctgaccaacctggtgaaaccccgtctctactaaaactacaaaaaattagctgggtgtggtggcacatgtctgtaatcccagctactcaggaggcttgtctatatgttggtctgtttctcctttttttttttttttttttttttttaaatacagggtctcacttagccctccaggctggagtgcagtggtacaatcatagctcacttcaaccttgacctcctgggctcctaagtagctgggactacaggtgcacaccaccacgcccggctatatttcttcttttaatggctacagagtattccatagttggaacatactgtaaattacttattctattcctttttttattttttgggacagagtctcactctgtcacccaggctggcgtgcagtggcgctatctcggctaactgcaacctctgcctcccaggttcaagcgattctcctgtctcagcctcctgagtagctgggattacaggtgcgtgccatcacacctggctaatttttgtgtttttagtagagttggggtttcgccatgttggccaggctggtctcgaactcctgacgtcaagtgatccacccacctcggcctcccaaagtgctgggattacaggtgtgagccaccacacccagccctatttattctattcctaaatatttgggttgtttctaattttttgctattataaacaatattatatatatatatatatatatatatatatttttttttttttttttttttttgagacggagtctcgttctgttgcccaggctggagtgcagtggcacactctcagctcactgcaacctccacctctgggttcaagcgattctcctgcctcagcctcctgagtagctgggattacaggcgcacggcaccacacccagctaatttttgtatcccaaagtgctaggattacaggcgtaagccactgcgcctggcctaatcctatattactttaattctaccagcactgtaaaaaagtgcttacgtccttatatacttaggcacagtggatattttccgtcttttccatattcactgataaagttgtgtgtgtgtgtgttattttgagagacagggtctcgctctgtcacccaggctggagtgcaatggcaggatcatggctcactgaagcctccaactcctgggctcaagggatcctcccacctctgcttcccatgtagccaggactgcaggcacatgctaccgcacctggataatttttaaatgtttttgtagagggtcttgttacgctgcccaggctggtctcgaattcctggtctcaagtgatcctcgtgcctcatctccgaaagcactgggattacaggcatcgcgctcggcctacttataaagttttcaatgggcctttttatatttcttctgtgtatttctagtttgtatcatttgaaaaattcttttggatcatttttttttcttttttcttttttcttttttttttttttgaggcggagtctctctctgtccgccaggctggagtgcagcggcgcgatctcggctcactgcaagctctgcctcccgggttcacaccattctcctgcctcagcctcccgagtagctgagacgacaggcgcccgccacctcacccagctaatttttttgtatttttagtagagacagggtttcaccgtgttagccaggatggtctcgatctcctgacctcgtgatccacccgcctcggcctcccaaagtgctggctaatcatttctgcggttttccttgtccttgttttcctcacaagtgtgacatgcttgccacagacaaaatgtagtaggtctgaagcccagcgtggtggctcatgcctgtaatctcagcatttgaggaggcaaggtgggaggctcgcttgaggccaggagtttgagaccagcccgggcaacagagtgaggaacacacccccacctttgttcttctgacacagtgtctccgtctgccactcaggctggagtgcctggtacagtcacagctcactacaggctcaacctgaggtgatctcgcacctcagcctcctaagtgcctggggctacgggcacgcaacatcacaacaagtttttttttgtttttttttttttttgtagagacgggatttcaccacgttgcccaggctggtctggaactcctggcctcaagcgatccgcccaccttggcctcccgaggtgctggatttacaggagtgagccactgtgcccagccagcccttaaatatttttgaaacctgagtttagaaatgtttgcttttagataggtgtgactatctgcaaacaagccagattttgcatttttagcaaaagaaacatgtatgtgaaagtgctttgaaaaatacacagcaatacataaaagcagcactccatcatcggttccttgtgtaaattacggtttttaccggcaggaatcagagcggagtctcccgtgtagcatgcagctgcggtcgctgtttgtagaaaccatgggtttggggtgtggctgtgcttcccggcctcacagtttgctcttgcaaagaatcttaagataaaaccaaggaagctgccgtctggagtcgggctaaggccacctagggaatctgtaatccagcaggtgcttgttgagaagtttaacagcagggggctatgccttgaggatccggtataaagaacaagaatcccctgcctgtgccgagcacacagtttaacgttttgaaaataggatgtcatttaattctcccagccatcctggagggtagaggcaggaaccgccattttactggggaaggaggcaaagtgttttctccaggtcacacagcttccaggtggtggagcgtggactggaactcaggttctcggatcccaactccaatgcgctatgcagtggctgcctcccaggcagacggcccctaccgtcaggggcatgtggtctgccagagaaacgcacacacacatatcagctcagggctacactgatcaggcaaacaaagtgaaggagaaatgaagagcagggtgattgacttctttctggccacactcaaagtcctaagagcaagtcagctcattctctgaaccgtatttcttcagacgcagtgtggcttttgttgccaaagagaatgaagttccgcagaaggctgttgttctcctctttggacacctccttcctttctttccgtgtctgaccttttcctcgtgttctgttgttgtgccaatctttagatcttcatctctatgtctatcttcctgtatcaaagtgtatactggcgttgtgtgtgtgtgtgtgtgtgtgtgtgtgtgtgtgtgtgtgtgtgtgtgttgagacaggatctcactctgttacccaggctggagtacagtgctgtgatgatggcccactgcagcctcaacctcccgggctcaagcaatcttcccacttcagcctcccgagtagctgggactacagccacacgccaccacacccggctaattagtgtatttttttgttttaccatgtcgcccaggctggtctctaactctcgggctcgagtaatcctccggcctcagcctcctaaagtgctgggataataggcaggagccaactccggggctcaagtgatcctcccgcctcggcctcctaaagtgccgggataataggcaggagccacctcctgggctcaagtgatcctcccgcctcggcctcctaaagtgccgggataataggcaggagccacctcctgggctcaagtgatcctcccgcctcggcctcctaaagtgccgggataataggcaggagccaactccggggctcaagtgatcctcccgcctcggcctcctaaagtgccgggataataggcaggagccacctcctgggctcaagtgatcctcccgcctcggcctcctaaagtgccgggataataggcaggagccaactccggggctcaagtgatcctcccgcctcggcctcctaaagtgccgggataataggcaggagccacctcctgggctcaagtgatcctcccgcctcggcctcctaaagtgccgggataataggcaggagccaactccggggctcaagtgatcctcccgcctcggcctcctaaagtgctgggataataggcaggagccaccgtgcccacgtgcccaccccctgtgccgtatctttctatgtctcttcctatttcttcattctccttttgtccttcctgccctctctctgcttcaatggtccctactgtggaaatgaagtatgggtctacacaaagtaacttttacttcagaacagatgtccattttctctgttagggtatttatttatttatttgagacaggttcttgctctgtcgcccagactgcagtacagtggcacaatctgggatcattgcaacctctgtctcccaggctcaagcagtcctcccatctcggcctcctgcgtaactgggactacagttactggggtgggttccacccatctggctttttttttttttttttttgagagacagggttttgccatgttgtccaggctggtctccaactcctgggctcaagtgatccacccaccttggacggatcccaaagtgctgggattaccgttgtgagctgctgtgcccaggctgtgttaggatttttaaagtggatgagcggacagagacccctaagttcccttttggttcgggagctcactacgtggaggcgcttcacgtgtgatctcacttctttctcatgtacatgattttcccagataggaggaaaaggtcctcgatcaagggtagttgcccacacatcacatatcttaatggcattcacttgagaactcacaaagtattttacaagtaaatacggtattttccatttaaggctgaagaaaccaggaaacagatatggggagagtccctgtgtcctattccttaatgatagcgagtggggtccagaggaatgggggagaggagatggaaaggcaggcccacatgctttcatggcagaaaaatccctccgtagccctttagaatggggagctttataaattctctgttcaagggggcgacagtctacatttggtaagtgagttttacgttggcattaagtagcccaaatttcactctggaaacccacacaagcagtgtaatgacaaactggtgaaacccagccccacagcctggagtagtggaaattaccctggaacaggttctaacctgagccttgtcccttcacagggtggtgagtcagcggcccatcctgcacttcgctttcttcatgtgtaacatggaaataacaggtttagccaacctcactgggttattttgagacccaggtgagctactacacgtgaaagtgctttgaaaatttgtaaagttacatataaacagagaatactgttcatggcagcatcagagcccatcaattcaccatacaaatttatgagtaaataattaggaacagtattcatcagaaactatattgtgaaagattattattccctccttgcttatcaggcttgaaggcagtatagtcatccggcacatggaactaaaggcagaaagtactgagtttgaatcccagctcgccaccagcagtgtgacctggggcgatttttaaattgctctggtctgagtctcattttgctgatacacacaaacacacacacacacacacacacacagagtgagaataacatctgttgtgaggatttaatgagacaatgtagacaaaacatctgacataggacctagcaaacagtaagtactcaacaggtatgagctttggaaagtatgaaacatgtattgcaccctcagaatgtgccagcctcacttggggtacaaaatgaaaagacacagtccttgtttctaggacctaacagtctggtggagaaacatacaaatgagaaaacaacagcctcgttacccaaacccaaaggcagacctggaaaccttcttagagaaggaaacagctgattcgagacttttgaaggatgaggggaagtttgtgtaaaccaggccccgtgtttttcatttggccttaccatttgccgacaggggtttgatcgcttgaaaagctaaggttcatgtttctgcttgttagctttatggtgattcaacataaacagtctggtgacttcactgagcatggtgttgaaactgatcttacttgctattttcttttttcttttttttttttttatttgagacagagtcttgctctgttgcccaggatggagtgcagtggcacgatcttggctcactgcaaccttcgcctcccgggttcatgccattctcctgcctcagcctcccgagtagctgggactacaggcgcccgccaccacgcccggctaactttttgtatttttagtagaggccgggtttcaccatgttagccaggatggtttcgatctcctgacctcgtgatccgcccgcctcggcctcccaaagtgctgggatgacaggcatgagccactgcgcccggcctttacttgctattttctatacatgaaacatcggttgttttgttttcaactcataaagatgccttacagcttcttgtgtaggggagactggttcccaccactcaaaggtgccagcatactcactgccaagctgctgctccctttaaggagggaaggcagggaggacttgtaaccacctgtcactctctggaaacactggcgctggaggtcactgtgataaatgcttaggaaagagacagtggactgcacagagtcgttttcctggagagaatggagagttcacaggtagctggttttgtccacaagcgaatgtgaaaataaagagagcgtcgcatttgtcagatatcttgggaccaacctgaagtggctttctcctttcactgagtatgtcagcagtgaatttgggagttagagatgttgccctaagtggacgaagtttgaggcttttcttgaggctgtctgccaccgtcctgttggctaagtcccttttcttaaccacatataggaagatgttagaggctacattcattccaaaaggtcacagcctagtaactgatactaccactgaaggaaaactatcttttaaacctgagaaacatcttcagactccatcatgaatgaatccaaattgaaaaaaacaaaagctgtgctcactctacaccagttcctacatcactaactgccgtgttaaagtaatttaactggcacctaacagaaatcatctgccactttgtaaaagtcatagactcataagaatctagagctggaagaccgttaaagagctagtgatccagcctccctctcatttcacggaccagcaaatcgtggcccagagagccgagcccagctgttccgaagtcctcatacgggattttggtcagcattttgcatgacggtgatctgaggagacccgtcatacctttcatttgtagtaacataaatgaactgtatttcccaccccctacgtttgttagctgaggaagatacagaccaaagcaaaataaagctggtagttcctaaaggacagaagccaatgatactgaaattcctgtcttcatccatgtgattggtgcttggcacaaatgaaatgtattccaattcattcaagtttagacgcctgtcccgataactgtttttttgtttgtttgtttgtttgttttttgagacagagtcctgctctgtggcccaggctggagtgcagtggcgtgatctcggctcactgcaacctctgcctcccaggttcaagcgattctcctgcctcagcctccagagtagctgggactacagacaggcaccaccacacctggctaattttgtatttttagtagagacggggtttcaccgtggtggtcaggctggtctcgaactcctgacgtcaagtgatctgcccgcctcggcctccccaagtgctggggttacaggcgcgcccgaccccgatacttttaaataacgacacgttgtgaacaacaccacagtccctacgcctctggatggtgtctccggatagatccaaagccgagaggcagtaagagcctgcagcctccacagtccgcctcctggtgcaggtggagaggggctgctggaggcccccggacctcacgcttcctgagggccaccccggagcggctgcagccgctggcggcaccgggaaaagcatctcggccgtgcggggagaggccacatcctgaggcctcccaccgagaagcaccagggcttggtggacggggcccgcgaacccagggccacacgccgcctccctccttccttccccgcgggcctcgccccaccccggagggggttcctacctggcttcctcggccccgcgcccaccccgccccttcgcccggggccggcgagaagagcaggtcggggaggggcgcgtccgctgacggaacagaagccgggagccgcggcccttcccgcctccgcctgggccccgcggccgctcgggagggagcggcggactcggaacgcgcgcgcgccgcggccccggccacagccgccgcctcggtccccgcctccgcccccgcccacccgcccgccggggacgccggggaaccctccgggcccagggaccgcgagagaccccgccccgccctatcgcagccgccgggcctggtcacgcgcagagccgcgccgcgggatcggggccagcgccgggcggaggcgggacggggacgggggcggagggttgaaatcgcgcggccgggccggggcgcgccgagccgaacccagccacgcggcgccagcgaggcggccggacccgcagccccgatgctgctgacgctggccgggggcgcgctcttcttcccggggctcttcgcgctctgcacctgggcgctgcgccgctcccagcccggatggagccgcaccgactgcgtgatgatcagcaccaggtaccggcgccgccgagacgccccccgaggcccggggcgctgcccaccgcaccccacccggccgcggggcccagggcggaaaaggggggcggcaggaagcccgggggctgctccctccgcgtcccggcggcccgagtttccgaagcccctccgcgtcctcccctggcgggagcggggccggggcgggcgggaatggccgatgagcctccggagcccgctccccacatctgcctgcggctggggagagtcaggccgaagggccgggccgggctccctgcggtcctcggaccggactgagcgcgcgcgctgttctctccgcccgcgctaggctggtttcctcggtgcacgccgtgctggccaccggctcggggatcgtcatcattcgctcctgcgacgacgtgatcaccggcaggtaagagcccgggccggggccttgttgcaaatgtcacatttcagtagctcgcaggctctggctctcgcagcacacgcgctcagaaagctgactaatgggaaaagctggcaccacaatgggctccttcttcctctccggagtcttcgggcacccccagcttaggagaaagtccacggaaatgagggaggacgacagagtcggagtctgatttcaggtggtgtgagccagggatccaggtccttcatggaagagataagcgtggaagcatttacgactgggagtgtggcttgattcttgcagttggcttcactgggttctcactctggagcatcactggctaacagacgtccagtgtggttagcagagccccctccatggaaaggaaccaacccaccacccccttccacgcaaacgccgctcttgcttttcctgcagatttgctaaaggtgattgagaggttcccagcgcttagaacacggacttgtacgtctatcagaggtcagtccagaggcaggtcaggaaatgtgcacctatctgcagttccagtgaaacaaatcataaattaagaccagaatagtcgactttgtacagtagttagacctggacaatggtggtgcttttattatttcaagccttttttttccccaccggtcttgctggaatcacactcactttctcccaagttgaaggaccacagtcggatgtgcaggaagttgaacggcctttccaggccctgctctcctgtgggctctgccaagtcctgcttctcacctgctgagactgaactgcgaggggcctgagcaagctgtccgtctcactctagcctgcggtcttacctgggatcaatcctgctgtcatgatttttgtgcttttcttctgcctttttaaaaacaaaactggctattggcgatgaataagtagatgctacgatagatcaagtgacatcgattgtagacaccaaaggttaatattggtgtggctgggtacaatttttcttcttcttcttcttcttttttttttaaagacagggtctcactatgttgcccaggctggtcttgaactcctgggctcaagtcatttttctgcctcaccctcacaaagtgctgggattacaggcatgagccaccacacccagcaaattttttactttttttttttcctgtcgagacctcaggctgaggtgcagtggcataatgacagctgactgtagtcttgaactccagggttcaagccacccgtcttccttagcctcccaagcttggactacaggcacacactactacacctggctaacttttttttgttgttgttggtagagacaggggtctccctgcgttgcccaggctggtcttgaactcctgggctccaacgatcctcctgcctgggcctcccaaagtgttgggattataggcgtgagccactgcacccagccaaaaaaggcctttcagggttcatatactatatactgaatatttttctattatatgccttctcattttatgccttcacatagaatgcgattagatagaaggagttaaaaatccccccaaattataggcagaaggtggtatggggccaaggatttagtcagattcttaaaggattcagacactaaaatgacaaagtcacagctccaggtggttttctcaatttaagtacttaattcagatagtacgttgttgttttagacagggtctggctctgtcacccacgctggtctgaactcctgggctcaagccattctcccactcaggcctcccaaagtgcagggatcataggtgtgagccaccgtgcccagcctgtatagtaccttttaacatttaaaaggactccccctccccgccgcctttctttttattgagatggagtctcactctgtcactcagactggagtgcagtggtgaggtctcggctcactgcaacctccacctcccaggttcaagtgattctcctgcctcagcctcctgagtagctgaggttacaggcatgtgtcaccacgtctggctaatttttgtatatttagtaaagccatgttggccaggctggtcttgaactcctgacctcaggtgatccatccgcctcggcctcccaaaatgctgggattacaggcatgagccaccgtgcccggccgactttcccacatttaattatttaatcttcactgcagttttgacaggtaagacagacaaggattatcatcttcattttacaaagaaagttaaatcacaggctagtgatagtgaagattataatccagatctcttgctaataaatcttcagaggattctactcatgagtcacaatttcagatctcttctctgaattggtgaaaacatgaaaaccctaggttcccttcaaggggagaggccagttatatttcagctaaattttagtagctgtttataggtattttacttgaaattgcttgaagaaagcacctgagaccatagatgggcattggaataagtatggcatctttttggccaaaagaaacctagctaggtcgggtgcggtggctcctgcctgtaatcccaacactttgggaggccgaggtgggcggatcacttgaggtcaggagcttgagaccagtctggccaacatggtgaaacccccatcgctacttaaaaagaaaaaaaaaaagaaaatagccggacgtggcggcaggtacctgtaatcccagctactcgggaggctgcggcaggagaatcgtttgaacccacgagtcagaggttgcagtgagctgagatcgcgccactacatccagcctgggcgacagagcaagattttgtctcaaaaaccaaaaccaaaaaaaaaaaaaaaaaaaaggaacctggctaatgaattcacctacaagtgtgttatacttgccattacttgcttgccttatttgtttattcattatttacgccgtggtaagtgtggagttgctcaagagcacaaattcagatggcgcctccgtagactgtatttccagtgttgcagttcagcggactggctgcgtccgaaatcagagacaaagttaatacagatttcagggccctcggcttacaatttagaatctctggggactggagcgcttaacaagcactgcaggtgattctgatgttcaggtagtttgagaaccataaaacgaaatggttttctacctaatacgtggatgcgcatcaaacgtttgctgaccatgtgaatggaatcctcaaatagtacatgatttcaatttagatgtttcttcacagaaaacatctgtggaatgcttatcactgggaaccacattgtatgaattgtagaggcttcccttctaatctgctctaggacggtgatcaactatgatttccattcagcaaatactgattcagcccctttggataagtaaatgggaaaactgtcttttgacctagcctctctcctggtacctaaccgctgtaatgtggcccttgagctccaggctcatttccagacctgcttttttttgttgtgttttgtgtgttttttgagacggagtctcactcttttgcccaggctggagtgcagtggcgcgatctcggctcactgcaacctctgcctcccagattcaatcgattctcctgcctcagcctcccaagtagctgggagtacaggtgcacaccaccatgcccagctaatttttgtatttttagtagaaacggggtttcacaatgttgataaggcgagtatcgaactgctgaccttgtgattcacctgccttggcctcccaaagtgctgggattacaggtgtgagccaccacgcccagcctccagacctgtttttcttaatggaattgagattatctctagaattgctttttgggtttttttgtttttgttttttttagatggaatctcactctgtcgcccaggctggagtgcagtggcgcaatatcggctcactgcaacctccgcctcccgggttcaagtgattctcctgcctcagcctcccaagtagctgggactacaggtgtgcgccaccacatctgactaatttttgtatttttagtagagacggggtttcgccatgttggccaggctgatcttgaactcctgacctcaagtgatccacccgcctcagcctcccaaagtgctgagattacaggtgtgagccaccgaacccggccagctctagaattgtaaagaaaatggccagggttgcctcccagaaactccatagagtggggttgcatgcagacaagagaaaactcacaggttccaggatttaagttagtaaaacccccaactgttgagcagctaaggagttaaactagaaatgttggatttgtgatttgggacactttccaaaccagcttcttggtggggccgttgaatcatttgtatatctatctatatcaaaatcagttttatcacaaaatgccagaacatctactacaaattagtagctaagtcaggcaagtagtgacagcaagctgcttcaacaggcagggctgagtgaatgcctgctttttgcctttgacactcacgaattggccctgaaactgagagcaagtggtctactctccctgtttatcagtttcaacatctttattgtaaagtatttggaataataatagctgatcaagcaccaagcttggctgtgagccttcataatggatatccacaatgatttcacgggccattcatatgctttctttcaggcactggcttgcccgggaatatgtgtggtttctgattccatacatgatctatgactcgtacgccatgtacctctgtgaatggtgccgaaccagagaccagaaccgtgcgccctccctcactcttcgaaacttcctaagtcgaaaccgcctcatgatcacacatcatgcggtcattctctttgtccttgtgccagtcgcacaggtatggccttccaggacagcagaccagcagctgggttgagctgggtgtctttttttttttttttttctgagacagtctcactctgccgccccagctggagtgcagtggtgtgatctcagctcactgcaacctccgcctcccgggttcaagcgattctcctgcctcagcctcctgagtagctgggattgcaggtgcccaccaccacgcccggctaatgtttgtatttttagtagagatggggttttgccatgttggccaggctgatttcaaactcctgaactcaagtgatccgcccgcctcggcctcccaaagttctgggattacaggcatgagccactgcgcccggcctgagctggatgtcttgaccgttacttaggagtcgggattgcccctcttttctttgccactcataggcacccattctccttgtgcctgctgcttcagagccacctcccccaggtgaatagtggaggaacaccattacacatgaaacgttcatgatcctccttaccaacatcaacatcaacatactttttcttttttgagacagggtttcactctgtcaccccgggtggagtgcagttgttggatcacagctcactgtagcctcaaactactggcctcaagtgatcctcctgcctctgcttcccaggaagctgggaacacaggcacacactacaacgtccagctaattcctgtaatttttgtagagtttctccatgttgcccaggctggtctcaaactcttggactcaagtgatcctcctgcctaggcctcccaaagtgctgggattacaggcgcgagccactgcacccggccccaacattctttttaacaaacccccagcgctctgtgattccctagcgtttgtcagaggttctatccttagttcaatacaagataaaaacaatataaaatacaaatataatacaaagcaacataacagtgccagagagcactgtgtggattattcttaggtcacaaaacacagattctcaaagcaaatagcctcctactttctccccagatccatttccccataaaagcccacccaacaaagaaaagcaatgggaaagctgaggggaaattcctcactcttgagtgcctggccaggggaaggcatgcgtttttttttttaattattcatttatttagttattcatttttttgagatggcgttttgctcttgttgcccaggctggagtgcaatggctcactgcaacctctgcctcccgggttcaagtgattctcctgcctcagccttccaagcagctgggtttacagatgcacgccaccatgcctggctaatttttatatttttattagagacggggtttcaccatattggtcaggctgatttcaaactcctgacctcaggtgatccacctgcctcagcctcccaaagtgctgggattacaggcgtgagccactgctcttggccggcatgtagttttattttattttttaaataaagagatgggggtctccttatgaggcccaggctgatcttgaactcctgggctcaagggatcctcccgtctcagcctcccaaagtgctgggattataggcgtgagccaccgcgccctgccaggcatgtgatttaaaagttcatagcttgctaaatattagaagctattagtcttatgctgtagatgaagaaactggggctctaagagtattcttatatctctcagtggtactaagtggcagagctgatattttaccatgcttactgctttcttgaaaaaagaggccgggcgaggtggctcatgcctgtaatcccagtcagaagttcgagaccagcctggccaacatggtgaaaccccatctctactaaaaatacaaaaattagccgggtgtgatgctgtacatctgtagttccaggtactcaggagcctgaggcaggagagtcatttgaacccgggaggcagaggttgcagtgagctgagatcacgccattgctctccagcctgggcaacaagaacaaaactccgtctcaaaaaataaaaataaaataaataaataagggtaacgtgcattaaattctttaagaagtgtctgggacctaccatctaggaaccagaacatctagggtgctttgagaccctaacatctagcacagggcctggcacattttgttgaaccaaacaggctgagtgtcttggcatgactaagttcgatacacaaaagtaggcttgcagccttccttccggctgtcatcaaaattcagagcttggtgtgggacgccgtcatcctgtctgaatttgcctctggatcctagggcttggaccatcaaagtgctgttgccacggaagcagcggtacagtagtctgcgcttgcctattgagcgtcctttgcccgtcacagttacccttttcagtagccctcgttggaattttccttctggtggtttcttaacctccacttacttccccttttcgtttcgtcatccgcagaggctccggggagaccttggggacttctttgtcggctgcatcttcacggcagaactgagcactccgtttgtgtcgctgggcagggttctgattcaggcatgtatgaatgaaatgacagagagtgtgagggttctgattcaggcatgtatgaatgaaatgacagagagagtgagggttctgattcaggcatgtatgaatgaatggcagagagagtgaaggttctgattcaggcatgtatgaatgaatggcagagagagtgagggttctgattcaggcatgcatgaatgaaatggcagaaagagtgtgggagggagtggattctgcttttccttcggagatggtgggtgtggagaaatccctagtgccaggagagtgggatgagagatccttcaacagccttaaaggtcagctggtcatctcagccagtgggggtgaaattgtaggtttgatctaagtttgatagtttgatacagctcattctattttttccctggttacacacatactttaatccacggttcctgtactcctgtcagctgggtggcctgggtcaaattcaaaatcactattggagaaaatgaggttatttgcacatctcaatatgatagtgttcaagaatgtcttctccaagtgttagaaaactagacaaacgtctgggcgccagggaatctgacagccaaggtcttgatgagcacctgcacctgtgtggcatttactgtggtgggacttgggcccgtcgctccctgatgcccagcttcttggtgaccttacctttttccttcctcttctattgcagctaaagcagcagcacacccttctgtacaaggtgaatggaatcctcacgctggccaccttcctttcctgccggatccttctcttccccttcatgtactggtcctatggccgccagcagggactaagcctgctccaagtacccttcagcatcccattctactgcaacgtggccaatgccttcctcgtagctcctcagatctactggttctgtctgctgtgcaggaaggcagtccggctctttgacactccccaagccaaaaaggatggctaaatgctcctgggagtcaggcgcagcctcacaccagctgcctcctccactcagcattccatggaccaaattgtgccctgggtagcctcagactttgggtattgataagccgatggatttgagtttttctaaagaatattcatattacctccttcttctaacttgccctatttgcaaaagcacttttgtagtaacaactattgggtcctgtcagacctccacggacagcaaagtggttttaatgcaagcccaaggatccttcttaaggtcttatctcaagagctctgggaggtggaagcatggggtgggatcggtggaccagggtggtaagtgtctgcacatctgcctgtccctgtatcagcggctacccaccttccaaaccactcaggacagtacccgtggcactgggcccgcagaagcaagggatgacttggttcttggaagtaatgtcgtcttgtgacattggcctgggacaatcattgtgggtaggtagttattgatcgtttactagataacccattggttctttgcctcatcctctcatccatgggtcagagttgaattcttatgtctatagacttccaatcagaagtctcactggtggggctgggggtgggggcaggcaggaggcatggatgggaacctgagtaggtagtgtggccaagagatcagcacaacctttgcaggctgacttgctaagtctgacagtgacaaacttgtgagcttactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaacctacttctgtcctccaaaccatgaaatgtgtcatctagactgcagagtacttgagtgctttgcctcccgatatgccagagcttgtggtccaaagcccattcctgtgtgtccgtcctgccatttagccacagaaggctgcggagtgaggcggcagctagcctggccagtggctgtcccgtggaccgacacctgcgcccccttctgcaagcaggattttctggtgccaacactcattcatcattcccgatcaactaggatgaatttaagactgtgctaccatgtgttctcaagtggtagtttaaaaagtggatttttaaagtgcctttcaattgtctgtgaacgtctaaaggactgatttgtctcattttgactgttgagtctttaatgggtgccatttaaaaaacaaaatgctattttttaattgtcttttttttttaactatcagtgtatctttaaaagtcacccttacggtgattaaattgcactaacattcccaacttattctcatttgtgaaatacatcaatatcagtgtcctgtaagaatcatcctgtgacctagctcgactggctgccgtgtgctgtggctcaaggtctgtgtccatgtaactagcagaggggtgtgtgtgtgaatgctttcagcctccagaaaggtctagctcacacctcactcaaacctatttttgtggttcatggtctcagtaatacattgaaggttcccagagttcaagcgtagtggtcacacgtaacttgagaccgtttcttctcttcataagtgaatcttactaggaattgggagagtggaagaccgattattggtcagggagccaagcctactttacctgaggagaacctgagtaatgccccattgtgaaggagggtgtggatatggagggagtgatgggacatattttttccccctttcatctcacacattaaacatgtccccagccaattttcatagtttcctcatacctcagacaccttaaactcatttttttttctttttgtagagacaggttatctctgttgcccaggctggtctcaaactcctggcctcaagtgatcctcctgcctcagcctcccaaagcactgggattattacaggtgtgagccaccatgcctagcccactctcaattttttttttttttgttttagacagggtctcactctgtcaccaaggctggagtgcagtggtctgatctcagcttactgcagcctctacctcccaggatcaagtgagcctcctgctttagaaccctgagtagctgggactacagctgtgtgtcaccacacctagctaatttttgtggttttttttttgtagagacagggcttccatatgttggctggtctcaagtgatcctcccgcctcggcctcccaaagtgctgagattacaggtgtgagtcaccgcacctggcccaaactcattttttatgttcctgcacacatcattcccttatccaaaccattcattcatccaaatcttgacaacccctcctgaggcaaaagctaacgtgacccatccattcagcacatctctgctgggtttgccaggtctcgtcttcacagtagcccctttgggggtgactgaatagatggagttaagactgtatgggaagtgggtgtgcttattgtcccagctactcaggaggctgaggtgggaggatcacttgagtccaggggttcaaggctagtctgagcaacaaagactgtacacactcctcaattcagaggggacccattttcttgaggtcactaacctagcccctcgccactgagtttatcttggtcctccaatcctctcattttagaattgtgcaggcctctcgggcacagcagtctcatggccagaggcagagccagggctggactggattcttttccaagctgctgtcctttccaagatacctcaagaaaaaaacattaaaagacgaaataactcttgaagggggttatacgtaccatgtaatgctttttccactcacatggtttcaactttgggcttatttgccaaaatctaggatggaaaagtccagttatgaacatgttcctcctggctggatttgatcttgaagacactaaacccaatttcagagcatatttaatcctgggctattgctgaggccgacttagaagagacaaagtgagatgcgaaagaggagaatttttatgatagtttgtacgttacaaatacccaagaaactattttctttacaccattattgccatgactttttgtggacagtttcacataactgtaaagtccaggctgctcgggtctgacccctacagacctgccatgttgaagcccagctttttcgctcccgcacaggtaagaagctgctgatcttctgcagacccgccatgttggggcccagctccccacgccaagtcagaagctgctcatcttctgcaacagggtttggcgccgttcttcagggccgatgccctcagcaatggactttaagaagcgctgctcgtgtgccctctggagcaaggagctgacagaagggttggtcttgctcaaagtctcatagcaggtgagggtttccaaggctaaaacgtagagtggctcacagacctccgggtggagcatggccatgatgtgcagagcatggcagaacacctgggtgtaaacaaacagggcttcctgggtcaggtcctgctctggtccttgaacccaagggccagctgcctgtatcgccctgactgagtccaggaggcgggtcagactgccacagaggagtttgaccacgtggttccagccttccagaggaagccaatcacgacagctatggctgcagagaaactggaaagtcctcaggaagaggacggagagttgcaactcctgggcaaagggcttcaggttgagcaggggaacaaactgaatatattccaggctataagggacatggaggagctgcttctccagcagtctcctggtcagctggtgaaggcgctgccactcctgagggctgcaccaaggcatgacttgcaccagggccaccagaaagcctttgctgaacagtctgacctcctcaggattgcccacgtccaccaccaagagagacagcatcctctccgagatgccgctggagacgcagcagcactccatccaggccaggagccccgtgccagccccgtaccctgggtgggcctgggaggtccactcgtcttctgaaagcttacagatctcaaaaagtgtggctggcacttcacacttgaagtgcccctcgaagaagctcttcagcctcaggcccacagtccagtctagctgttctaacttgcggtggagccaggacagggacttgatccagacatccggggagaaggtctcagcattggctgatacaatctcacacaggagctccaggatatggatcgctagatccttcctatccaaagagaggcaccgcttctccttgggaagctgccagtatttgctgaagcggtccaagagctggcacaagctgaagaggagtggaaacggggagcaggtctggagccagtattcctctcggcacgcgtttgcctctagagtctggatgaagatcctcagactgaggtctacctcttcaacatctaacctcaagaaaggcaggacaaattccttcagcacctcgtctggctcaagaagagcagccactggaatcccttggggtttcacgggactcatcaggcagttcaggagctctaaaaattgcttttcttccttgggtgtagagaacttcatccagacggtttctttgaggcatgacaccatgaaagtggcagatgaattgggaccctgctcttccacaaacctaagggcagggaaggcagtgagaatctgggccaggaacttgtgggtgccgagattgaccacagccaggctgcacattttcttcaccgtgacttccgggtgcactatgaccaggcgggccacggaggccacagcttttgccaagccctgttcggaggcactctgagtgagctggttaaaagttgtattgaggtcttcctgaaaaccctccacataagccagcaacttttcagagaggccctttcgcccccaggaacgcaggatacctgcaaggactttatttttacctggcagggagaggtctgcgtaacattccaggatcaggtggatcacctgccggatctgagactcagggatggctctgtcagctgtgctgacgtctatcactgtttccagcagcctcaacaccaagtctggctgtcggaagagggccctgttactccccaggcaggctacccactcgtccgagaaggcccacttcttctcagaggcaaaaatgtagcacacttccatatggcggtccatcttctgctggatgacggccatggcaatggaagctgtgatatcctccaaggccctgttcttcagcaccgtgctcgttttcctcaggaagtccctgacacactccgccagctcagagaccacctgcctgtcctccttggacaggctggtgcggttcaggtagagcgtcgcgttctggctgaaggaagtcagactgtcgcacagccggtagctgtcgtaacttgtcccctggctgctgcggagcacggcctgcaactcctccccccactcccgcagcaggtggtgcaggaactcgcagcccacgaaaatggtctcactggggagtttggccagcgaggtcaggctgacatcccgttctgcctccttcaccttctctgccagcgcctgctggtggtagggattctgggtgtccgagttccacacagagatcaccgtggccagtttgtccagatacacggttgcagacacctcctgggggtcgtcctctgtcagcgcaaacacagtcagcatgtcagccaggttggccagcgcacagcacttcctccccgggcccaggatccgactctggatctgtgtcagcccgcggagcagcatggccaacaggggcatggtggggcacgcgtctgggtctgacctaagcctctttggaggatgggggaactcatctaaggcaggcaggtacttatgggccattgcactaaactgggagagcagggggtcctgcgggtgacccttgtgcttcatcacctcccaccagacgtccaggaagaaggccacgtcttcggcagaagtgtcaacggtcacatgttccagaaagcgctctagttctgcatggcagatggtggtgggcagggccatcaggagctggataaagagtccagaagcttccagggatttgagcagctcgaagaggatggtgtggttgatggtggggatcatgttgcccaccgagaagaacaggtcttcctgccaccgtgtctctgtgtcggacggggtcacggggtgcggctgcagaaccttggcccagatgatgatcagggctttcttcttccaggcaaagggctgggagtgtgctgcagccgaggagatctcccttaaggcctccacgatgggccgtccaacacgttcccagtcagactttgttaattctgccagtgccttagggtggaacagctgctcggccagcaagaagcctccatgcagaatagtcatttcttcacagatgttcaagggtcctgcacacagacaagccaaataagacagtatagtgaaaatgtttccagatggccactgctgttagtaggctgtcatggtttgagatgacaagggttttaaaggacatcagcggacggggagaagggatgactacaagagccactgcacagctggagtcagaaggacttggccgaggaatccagaatggcttccgagctctccagcctgggaactgggaggccaccaggtgacatcacatacagggaatggaggagaatcagagcaggtgtgaggaaagatgagttcagctttggccatcaaggtacagatgtcctccagcaacggaaatgccaggtggaagttcaggagggaagtaagctgggaaatgtgattctgagaggtatctgcccagaggggatcaccggaaccaagacggtgaatgagatccttcaggaaaagtgtgtgaaaagaaaaagctgggctgctgaggcgagaccctccagcaaaggctgggccagcagaggatgtggggagaggggtttagaaataggaggacagtacaaactacaggggccactgagcatgtaccacaggacatgacagctgagcttctcatgacagatgaagggagcatagccacagggtaatgggcacagagcaatcacacagccacagggtaacaggcacagcagcaatcacacggccacaggataatgggcacagagcaatcacacagccacagggtaatgggcacagagcaatcacacagccacagggtaatgggcacagcagcaatcacacagccacaggataatgggcacagcagcaatcacacagccacagggtaatgggcacagaagcaatcacacggctacaggataatgggcacagagcaatcacacagccacaggataatgggcacagagcaatcacacggccacaggataatgggcacagagcaatcacacggccacagggtaatgggcacagcagcaatcacacggccacagggtaatgggcacagagcaatcacacggccacaggataatgggcacagagcaatcacacggccacaggataatgggcacagagcaatcacacggccacaggataatgggcacagagcaatcacacggccacagggtaatgggcacagagcaatcacacggccacagggtaatgggcacagagcaatcacacggccacaggataatgggcacagagcaatcacacggccacagggtaatgggcacagcagcaatcacacggccacagggtaatgggcacagcagcagtcacacggccacagggtaatgggcacagagcaatcacacggccacagggtaatgggcacagcagcaatcacacggccacaggataatgggcacagcagcaatcacacagccacagggtaatgggcacagaagcaatcacacggctacaggataatgggcacagagcaatcacacagccacaggataatgggcacagagcaatcacacagccacaggataatgggcacagcagcaatcacacagccacaaggtaatgggcacagcagcaatcacacggctacagggtaatgggcacagagcgatcacacggccacaggataatgggcacagagcaatcacacagccacagggtaatgggcacagcagcaatcacgcagccacagggtaacgggcacagcagcagtcacacagccacagggtaatgggcacagagcaatcacatagccacagagcaatgggcacagaaggaatcagacaagccctgccttcactctttataaacttgccttgggaacaggcttcaaacattcttctagctttcagggaaacggtccaccccacagctccttccagtcaaaaacaaggtactcatggccctagctctgtgggagaaaccagggagtagatacagaaaatactgtgctagattaagccttccttcagggaactaacgattgacacagacttaccatggaaaacatcttgggatgtttaatcagacatgggtttaaatcctagttcagccatttaaaaatgatgtgattctggccaggttcagtggctagcacttgtaatcccagctacttggggggctgaggcaggtggatccctgaggccaggagttcaagactagctggggtaacacagtgagactccccctccatctccgaaaaaaaaaaagggatgtgatcttggtcagattgcttctccaagccttccttctgcatatgtggggataatacagacttcatgttatgcctttggggatcatgtgatatataccagtcaagcccttgctagtgggttggcactgctatctcctgaccccatctccccgggacgctatgatggataaatgagatagagctacagtaagaatccagttacagagtctaattaggtgctcagtaaatgttggtttccccaaaccttttcatggttggcaagaccagaatcttgtcactattctttgcctcccccagctcagaaacatcaaaggatgtaggtctttatcaggtatgtttcctttggcccagaaactaaaacgagggtgcaaacactgctccctattcctcattcctgagtcatctcccctttcccaggagtgagagatgctactccttcctcagtctgtcatgcccccaagagctcatattccccattttcacaggccagacaccagcagagaaaacactgactccaggagactaaggaccatcttacccctcccaccatttatgggagcggcagcaggccaagggctcagcactatgtaacccacttgtggaggcaatccatctcatctcacagtggctgagaccgactcccagggagggttacgctgcgaaggggacctccctgggggttaccgcccttctttctggctcaggaggctctcccagggtcccaaaatatagtccctcctgacgctgtaaatttaattttattgcattattggcttagttgagcagatgtttggccctaaacacctgccttccaggcgcattaagtacgcacagtttgaagtagtaagtcccagggcggttactagctggaaaatactccggtactctatcatggatggttaactagtgcttgccacagcccgcttcttaggtttattaagcacctactccatgccagacactgtgctaggtggtacacaggtaagatctcttctattcacaatcaccttttgaggactagtattcctgctctagagataaggacactgaggcgcagaaacgatttgctgagggtgtcccagcctgaatgtggtggggctgggaagcaattacggctgaggggctccaagcccttagagctctgccattccgctcctgaaaagctgtctgggggcggggaccagaccatttccccccagcctactactgctgacacatctcggggtgcctcacccccagctctcccagaacagcctcctggtcttagcagcgtgtgccaagatttagcagggagcatctagttcctatgggctccctcccagaccttgcctgtaagattctgaatccggacgcacgcaggttcacaaagtgatacctcaggagcgcagccgcccccaccgcgggtgtgacccgcgcaaccccacaagggacactgtacctcggcgatctcaatgcaaagtcgcccaaaactcagtggggagacacacttccattctccccgctctgtcgatgaggaaacgtcatgagcgtaagacacttggagcgttaagacacttgctcaagaacgcagctgccgttcaggaaatgaggccgtcggggcgcccaggggtgctcggagggagcccgtttcccaaagcacgtgcgcgagccccgggcgcttccaagggctctaacttcacgtctgctccgtgttttcaagcgcagggggccggaggcggcaagacgcggcccaacgcgcggcgggacccggaccaccccccgccaaggccaccccgggacccctagacccgccccgacgcgggggacgtttcggtccgggcccgcgcgagcgtgcgcgacaggaggagacgcgacggggcagcaccgctctggtggcgcattgctggacgcagcccggggccggggagccgcggcacccacctaggtccatggcggcgacgccggcggctgcgcggggctaacgccccctcccctccgagaactcgaacgcggcgcgggacgcacggcacgatgggagacgcaggagccacggcggccgcgcttaggcctgctcacaacctccgcccggccccgcccacagcctccgccgcgcacgcgcagtcctcacgaacgagcgcgccaagcgcacagcgccgccttccggcagagccctcccaccagccctcaggtacccggacgtcgctcactagacccctccgcaccgtcccctgcccggcccctcttccggggtcccagcgggtcgggctcatgattccccggccccgcattcaccctcacccggtaaccccgggcgtgccccgcacacagttcacccccaccgagcgcctcccccgggacgcccaccacccagcgcggccgcaccacgcgaggcttccactcccacccgcccagctcgcgccacatacagtccctcaacgcgctcctgccgcgccgccccctccagacagcagcgttccggatcctagacgctttttgacggctggtcctccccagaaaatgcgccgtgtgagcccaaacatggtggggtttacgctggaccccgagcttgcaatctgtgcttgacaaaacacaaacatcgcgtgcctgtctcctccccctgagatcgagtagtaacagccactccaactctccacctccagcttctagcaccagggaccgcctccaccaccccatgtgccaagtggagttcgagctgcgcggccctcaagcagctgaagggtcccgtgagcgatcaggagaagctgctggtctacggcttgtacaaacaggccacccagggcgactgcgacatccccggccctccggcctcagacgtgagagccagggccaagtgggaggcttggagcgcgaaaaaaggggcgtccaagatggacgccatgaggggctacgcggccaaagtggaggagctgacgaagaaggaagtggggggcgtggagcgcgaacaaaggggcgtgcaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccaaagtggaggagctgacgaagaaggaagtggggggcgtggagcgcgaacaaaggggcgtccaagatggacgccatgaggggctacgcggccagagtgaggagatgaggaagaaggaggctggctgagggctcctcgggaatggaaagggcttcttagaccttgatggctgaaatgtcctgaaactgtcgcaagcttagccgagacatcaataaatcacttaaactgcatgagagtgactgctgttggaaaggagaaactcggtgactgagtgctggggaggcgtccaaatacacagactaactttttgtatggttttgggtggagttcccagctctcctattacaagagcgtatgtaggtatttggaaggacgagggggacagtgtgctgtggaaatgcccaagatctgagggcaggagaccattctccagtgacagcctcttgggaggttgaggccccagccccttatctcttcaaggctgatttactaataccccagcaccacagaggggagagggactctgtcctcctaaacactaaagtcaagtccaaaagcccccactggaacacagggcctacccggttcatgttttgagggagaccaagctttccgtgatgataatgtgatgaaacaattgatgcgccagaacacagcagtttagaaacaatggagcagatggtgtcaaaatcccagccccagaaaggctcacctaaggccgggcaaccaaaatgttcccgggactattctgtacttaaccctggtttctgcttaggggacggtgggacaatatgcatatggatgtctatgtgggatttgttgcaagagcacaacacaccccttgacctatgcaagtgccagagtgtctgagcccagcttctactcctgttaatgatcacaggagcctcatacacaaccattgtgcatggcggctggagtatggagtagtaaatggtatccagaaaggcaggtctacggtggcatatgggatttcctggtacttcttctttaatagaaactatcttcacagatcatgacatcaggtcagctgcagttctcactgggaccaataaacaatagaagcaacaaccataaagacttaagaggacaaaggaaaccaaacctcactgtgtgtcttcaagatctgttcacatagttgcaggaagttgctgtagacaaagtacattactaaagaatgaagcccacccaggacatcacagcaacgaaagaactatttctggtaactgtggaccaggtgagagccacactgtagaacagcagtgctgccctctcttctttggcgaatgttatgaagacattctgatgcacttaggatcatgattcatgttaaatgtaaattaattgtaaaaataatacatcttgctccaaaatgtggtgacaatttagaagctgtccacatagccagaccactctgtaaatcacagaacctagaaagtaaaaatgtgccataattaggacagcagaaagtaacagtaaaataaagttttaaaaaaaaaaacagaaaataaggatttatctatttgtatttgcttaagaagaggttacctataggatgcagggggaatgggattgatgggcatggggtatactgtgaaaggaaaataaaatcttgggaccaaattcactaagcgaaaaggaaaagttaagcttggaaattgagtcatggaatatgcaaaaaacttccttttgttcctaaacagataagctacaagacagaaggccacatatctccccaggtggtctccctcacctgacaatataaattaacagcttatcttcataggtaagggacaaagacaacaccagaaaccatccctcaccagccgagacaaaacatagatgtactgagctgaatgcataactgttcctctgcctgctgctttcactgtaacatatagatttggtgagcagtaaatgtagatttactgagctgaatgcataactgttcctctgcccgctcctttcactgtaacatgtagatttggtgagcgctaaatgtagatttactgagctgaatgcataactgactgttcgtctgcccgctcctttcactgtaacatgtagatttggtgagcactaaatgtagatttactgagctgaatgcataactgagtgttcctctgcccgctcctttcactgtaacatgtagagttggtgagcgctaaatgtagatttactgagctgaatgcaaaactgactgttcctctgcctgctcctttcactgtaacatgtagatttggtgagtgctaaatgtagacttactgagctgaatgcgtaactgttcctctgcccgctcctttcactgtaacatgtagatttggtgagcactaaatgtagatttactgagctgaatgcaaaactgactgttcctctgcctgctcctttcactgtaacatgtagatttggtgagtgctaaatgtagatttactgagctgaatgcaaaactgactgttcctctaccccctcctttcactgtgacatgtagatttggtgagcgctgatcaaagcctaataagaatgtaaccacttatctccctacctaccctcctgtatttttcctttccctcttccctcccttcctgctctttcccttttaaatacttgttaggaataatgctcaaaatcctaaggaaatagaacactcgaacaaaggattcttagcaaagcaattttacttctgtgcagaggggtgcctccttggccagttgtcatgagagcacacctgaacaaaggggcacgagagcctttgttcctgacacaagtcctgcccctctaccctttccccattggccggggtcaggtcgtacaatctaaactaatcgcgcttggctaaacatttgatttttttagatagggtgggcccgtaaaagaaagcggagaggaaggggaaggggtgtctgtaatgagctagaaagttagtcctctttccaaataaggaaaggaatgtgagctggtactgataacgcctggtgctgtggcgtgcctgggcatctcacaaaggcaaaaagggaaaaggagaaaaagggggcggggcgctatgaattaaagaataaaagattgatcagattatttgaagagaaacgtcgtcatatcccacatactgaggccctaaaaatcctctctggaaagtgtgcgggggccacagatctgtggttgtgtctcaggcacatcctcagccttggcaaaataaacctctaaatgggcgagacttgtctcagacacttacccggtttacaataccttttcatattgttttcatttttgaaccatgtggctctattgctttatataaagaggatgaggcaagggcacttctttattatcattgaagtcagagtaaatttactattgatttcccctgaggttggggtaagaactcttagaacaaacagggaaacttctcaactcttaccctgaatttcaacggacacgttggaggtctcctgaaaactctggctgctaagtcacagcggcactgagtggcaggtgagagagccagaaagccacatgaaggagcactcaccgtccctaggtttgttaattccggtaacatgtcagacggacacggacttcagacagtcctgcaggctaactaggagagctctggcaacacggccgttctaagtcttcccggagatttaactcaaggcacacttgtatttacatgtaggctccacaaccccttgattcaaaaaaacaactctggagaagctgaagaactttccaacttcatctgtttgaaacaacagcttgcagcctgaacaacgcagtgagacggtcgctacaaaagatcaaaacgttggctgggtgtggtggcacgtggctgtgggcccagccattcgggaggctgaggtgggaggatctcttgagccccagaggtcaaggctgcagaaagccacgatggtgccccactgcactccaccctgcgtgatagagcaatgtctcaaaaaccaaaaatgaaacaccagcttgggcaaagctatcttcctcatgccattttctaattgatcatatcccccagatgtgggaaactaatcacttttgtttaaaattagtttttgcggatctaatgggcgtctaaataatttttttttttttgagacggagtttcgctcttggtgcccagctggagtgcgacagcgtgatctcgcttcaccgcgacctccgcctcccaggttcaagggattctcctgccttggcctcctgagtagctgggattacaggcaggtaccaccacacccatctaattttgtatttttagtagagatggggtttctccgtgttggtcaggctggtctcgagctcccgacctcaggtgatccgcctgcctcagcctcccaacgtgctggcattataggcttgagccgccgcgcccggcctaaataataatttttaaaaattactcttttttggtttagaattacttagctgaactgtgcagaagcaagcttctggatgccttgataaaaagccaaagttgtacactagagggctttaggatgaataaaatgttaaaaaacgccaacaggacgaggtggctgatcacctgaggtcagaagttcaagaccagcctgaccaacatggagaaaacccgtctctactaaaaatacaaaattagccatgtgtggtggcacatgcctgtaatcccagctacttgggaggctgaggcaggagaatcgctcaaactcgggaggcagaggttgcggtgagccgaggttgcgccattgcactccagcctgggcaacaagagtgaaactccgtcttaaaaaaaaacaaaaacaaaagcaaaaacaaaacgcaacaaagcgagacatgacaggcaatgaaataaataaaaggaggcagatctcctaaagccaaaatgtcctatgcagacaaacagcattactgttcaccctgcatggtgcccactatcatgcacagttgtatatttaggagaaaaacgttttggtacgccaaaatacaagataagcagataaaagggaaacctgtgtgtgttatttagttattcggtacttatataaaccacttattttactacaacaaacttcgagggccacattatagcagcccaatacactgggaaaaggagtttcttttcacaaggacaatattactagagatgaacattaaaaattacttaataatctaatagaaaattggaaaattaacatacattctaaagagaagcagaagtttacctggttattcaaagttcatataataatttccacatgtataaaaaaaaagagaagggcacggtggctcacacctgtaatcccaggctgaggcaggtggatcacctgaggtcgggagttcgagaccaacctaaccaacacggagaaagcccatctctactaaaaatacaaaattagccagacgtggtggcgcatgcctgtaatcccagctacttgggaggctgaggcaggagaatcgcttgaaaccgggaggcggaggttgcagtgagccaagatcacgccattgcactccagcctgggcaacaagagcgaaactctgtctcaaaaaaaaaaaataaaaaataaaaagaaccaattacctagaggagggccatatatataacttggtttgctttgaaactcaagactgcttccctaggatatggaattcaagctgaatgaaaagttgtagagctggatgagaatttatttctctccgtgaaggtataatagcatcacccctataagaagataagctcaaatacaaccaaaatttcgatgccctacgccctgccagtaagggaggaaagcagaggttacgatttacaagtaattctctatgtgttctttgggaaccaggatcctctgagtcaatcccttccaatctcctaagtttatttttaaaaatctgaacctggccaccactttacatgatgagacttagagactggtatcacagcttgatttcagaagcttactttcaaaaaaaatttattcaatgaatacacaatataattccatttcgagtgattaaaacctatttgttgtttagaaccaaacaaaactacaagaaaacattttcaaaaccttttttttcaggctgaagaaatcgtttaatccattttaaagaaatctcacatgatgttctgtcgggattaaaaatatacacggaaaaaaataaaacaaaatatatacacagaaagaagctcgcacagagtcaggcgtgcagcaacgtcacacactcattcctttctgtttcctctggacactcaaaatgtgaaagcaagtaagaggggggtggttaaccaaaccttttggtccaaggaataaaatttctttaaaaaatttaaaacgtcaaaacctgccagaataagacaatagaagagcgtatcgtcaggcgctgggaatggcaccacgacaaggcattaatgtggattcacttgcacagctgctctcataaaagctacacgattcagaggtaaccctaactatccgcaatcccaaccaaagtcatgttcatgccgctgtcctagtctggacaatcatctgtcactcatccaacacagttatatacagaatgcgcagtcccagcaacagtgtagattacagcaggcgttctctacctggactcatgattggatttcatttctaaattacatcagagctttcaaagattgaaatacacaaatctgcactacccaagcctccttgcctgtacgggaaacaaatcagaagagcatttattgggaactgacacgtcaggcctcacaggtgctgggcaggaatcacagaggcttgctctgcatcatgtcttccgttaacctgaagctttgggtttattgtgtttggcaaaccactcgtcacttttatctgctgccattgcctgtaaaatagaaatagaatatacactgactccaagcctgaaaaacaaaagacatagcccactttatatctcactgtactgaccacaataaaaaaaattaacattaaaaaaaggacccaaacccccgctccaaaaaaaagagaagagaaataaaaaaaattttttaacatttaaagagtattaatccagtacagagtgttatgttcaataaggcaagagatactggtgataatgagcaactgtggatcctcactcggcagagtcaagggcaaaccaagcctgtagccaggaagtgtggctggcggaccaacgaggtcagggacccgcatgccaggcggtaggatctctggtaaaagagcaagtcctgccactcacagcatctgggcagacgctcaagaatctttagtgtcatgaaactcagtctgatagtgaggccaaatatgaaactctacgtgatgttttagtgatgaagcctggaatgattcctttttcgtaagtctcctcccggcctactcttctgatgttggttctgtttagtttgggcatcttaattaaaaaggaagccttaagccgtgcccagtggtcacacctatagtcacagccacttggaggctgaggccagaggatcacgtgagctcaggaattcgagttcagcctgtgtaacagagtgggaccccgtctcatatacatacatacagatacaaataaaaataaatgaataatacaaagccttaacaataatgttttggttccacaagcatccctttcgttgtttagtaaggacaaacactcatttatgtagtcaaaaagagccaggtaccacgctgggttcagatgtggcagcagagacagtcggaagctttgaggagtgtgcagaacagctgagaactcagatatggaaacaagtattttgcatgacagagtgtgtgtacgcatgtgtgtgtcttgaagcatttgctataatatctacctcagcaggaagtcacaagatgaggtggcaattgaaaaagaagaaacaaatatatttattatttagaaacagtgaaggtgaaagtggctgtcctaggtagtgtgactcagagttggaccgtttcatttctaaaaaatcttagtactatctgatttattatcttgatgaaaataagaatttaaaaatcaaagatatgcttaaaaaaaccacaagtcacaaatatgcacgtttctgtcttttaggagccataaaaagtgggaggaaagaacaactaaattatttggagaacctaagaaagctttttttcttttttgaaatggagttttgctcttgtcgcccaggctggagtgcaacggcgccatctcggctcactgcaacctctgccttctgggttcaagtgattctcctgcctcagcctcccaagtagctgggattacaggcgtacaccaccgtgcctggctaattttttgtgtttagtagagacagggtttcaccatgttggtcaggctggtctgggactcctgacctcaggtgagccacccgccttggtcccccaaggtgctgggattacaggggtgagccatcgcgcccggctgaacctaagaaagcttttaagtgttgaaggacaagtaaaagaggagagggaaaaaaccctttgggttggatgcaagaagaagtatcttagctaatataaccagttcagtgggactggaatagggatgagttaggggacttagggaggcaggtgggaaagaaggtcagagggtagagaatgtccaaaaatgtcacatgctctgtcagagagtttgaaatttatctcagaggcaagagagagctatcggattaaacggttttaaaaattactggctgtttgctttgggacagaccgtaagttgacaatgaggcctttcaaagggaaagctgataggcagaagacatttcagaggtagaactcacagctcttggtgactaatagctaaaataattta

SEQ ID NO: 602 - DNA, 250150 bp, Homo sapiens
ttcttcaatgttaggaaaatggttcatagcgctattgctaatataggtaaaatggctgctaaaaaaaaaaaaagcaaacactttctgtttcagaagcagccaaataatcaatgatttgatttctaatagtcatgtttgccataaggattcttataataagattaggtagccaagttggtttccctgttgactttatcagtaagtcatcaagtacttctgaacctcccctccagaatgcccaaaaatgtcctacaataatctccccagaaaactattttctggattttattatttttcatagttctacctacagctttgattattgctgttgtaaataaggcaagaattgtaattaagaaagatatgaatatgatataatatcatagtatacacagttgtatgtaattaattaccttattgcccctttgcttgattttatattcacattgtaagctcttaactgtgcatgtataattgattcactatggtaaatgtggttgttttaacaaaaagtttcaattaaggttttattcaacagtgtaattcccttatccaattgtttctgtaggaaaatcaaattcaacttatgttatatcatttttgggactatatcctgttataggtaactgccctgctagaataatggaagatgagtcagaatttctttcttccttcctttattttccctgtgtccttttcccagaagctagctttctatggaataaacttgcctgggcaccatttgtcccattctttcacttgagtactcaaagactagtagacttttgtagctgttatatatgaatatatatgaatatatatatatataaatgcaaaccccctagcacctctcttaccattgttctttttcttaaagaactagaatcaaatttctagaagctctggtaggctttgatagcatgaaaggccttctgggatgttctgaaactaagactgcaagttttgtcccatgattgaagaagagaaaatatctgattgttggcctcatagaaattttgtgtagctaaagtatttgcatgctaaatctttcaaatggagaaattgaggttaagcaaaaataggtgatgggatataatataaatacctttccagatttagcaagcttgctatagtgaagctatcttcacaaaaaatgacacccccccctcaacccccagaatggcttctgtgttgggatcagttagcatgcttgttttggatgtccccagtatggtaagaatgtcataggaaatcctgctatgtgtctatgatgagcagcaggcgagtgcacactgttctatcagggccatcaaacatggactcacgtttcagcgtctgtcatcaatcactcatagacttcataccttaatatacccttcattcctttttgttccttctcaacctacctacctattcatgtgtgaaagaacacttttttccctaaccactaacaggttcaacaggttatttcacctcctagcttcctctttatccctcccacatcctctttgtgctctaagagcaggggaacacactatcagataattatagtctctccttttcaatataaaaactttatgttgctgtttctcaaagcatatcaaagtaaagccatggggtgaatggtacacttaatatagattattttactgagcttttaaaaaaattaaattacccccataccagtaagtgagaggtacaggcagaatggctaaaggcagaggtatttctcaaatctgttcaaattagtctggcatagcatgggctagagacaaaatcagtagatttacattgctagacagtatgacatatcatacatttagatcattttaaataaagtcattactgaatagatcctcctaaaacaaatactattaccacaaaaagtttcttatttaagagacatcagggaccctcatgctcagcctctgttcagtgccgttttaacacagccatgtccacatccatgtgaccattgcagatctgtttgggtggcttagctcttaccaaagacaaccaacagggtctgggccagatggtggaaattttatccctagatttgtttaatgagagaaacaagaagtatgagcaattttctgtaaaacagaaagccagagtaagaggagcagatgatgtcaataaggaaaaaaaaaatctggcaggaatttgatatcatgccctcaattatctgtgttttaaaaagttgcatatcctgattgtttcttagatggtgtttgtctagagttagcttaaaaacctagattgtttcttagatgatgtgtgtctggagttagtttaaaaaccttaggcctttttaattattgttaagacatttgaaatttttaagtaacagtctaaagattctagtacagaggaagaatgtgaacaaatccttggaggtgatgataaagaagtgaattgaaggacaccaaaaaacaaaatgtacctttggatttatgagccagtgaaacaacaaagccactgaattttttcccattaaagtagaaagaagctcttaagtacagatacaaaaaccaacaacaaaacttccatgaaccaagaaaggatagtaaactgaagtgtggtacctgaggttccagtgtgatatcttagttgataaagggtcttgatagtttatgcctgaacagaaaggttctaggatgggaagactacaaatgttaatatgaaaagcatattttgtgcatcataaagattctagacactacagggcctctaaagacagcttattctgaatggttttctatctccttcctggagaacccattagttccttctataaagattcctcttcgatctctagctgtagaggcacaggaccatttcatgattttttaagagtgtaacggtgtgaaaagcaagcttgtaaaatgaactgctttcctccccttcctacctaatttctttctccctctgctctaaagaataggatatctctttctgactccagagctcatgtttaactcagaaagtatactttgcaaatgtcctgcatgttctaatttgtatggtagaaggagaaaatagctcgtctgagcattagtttgacatcattttatcccaacagtctttggaagccaatccctcttcccccttttttgactgtctgaaatgcccttgctagccagacccctttgctagctacagtgtttgcacatttccttgttaatcagctgcgtcggctcggagactgtgtgttttggtgttgtttgtgtgtgcaatctcgtgccgcttcctgaacgcatgtgtcccttcccttcacagcctactcgacacccagcacctcccccgcaaaccgattcgtcagtgttggaccacgggatccaagctttgtaaatatccctcaacagacacaggtgggccgctctcatcttttctgtatgtggtgcagcttgtattattcatcaggtgcattttaacttgtcttttgcacaaaaggccacattttccagaccctgtccagtcttccctttcctcctgatcccaccagccacatttccatgtgttctcagaaatcacagaaaattttgcctgcaatttttgcttcttgtattgagtgggtagaagaagaactgttttagctatggcacaaaaaggtttcccagtgttagctagtgtgtgttccctcttataggaattcatggtcctctaaatgcaagcagacagaagcaggcccctacagaacctgaaagtaatatctggttgccagtgacatcagagtgcatgctgggcatggagggaccagccactcctctgtattcattagagggtccccaggcacctggcaagctttctaaaagaaagagggagaaaagggtatatgagccctattaagttgctggtgttggtccagaaataagacgtgtttattagtggttactgctgaccactggggagcaaggtgcggtgggtggcaaggggtgtgtatgagtcatatctgaagcaggtgattgagagaagaggactgctcagacatccagagcttgtctgcccatagacagttgtgttttgtgctagtctaggtcaaggagaagaaatatttttgaaaagttttggaatggctgctgtatattgagaaacagtaaaaggctttttaagttcaaagttagtataggtagaggcatttagaggtttgtgaaatagaattagattcacgttttgaaataaactctctgatttcctaattagaacatggcgatattttatcataattaacataaggaaagtattttctctgtaaggttcttagcgcggtgtttgaaaacattcttggagcaattttgtgcacatgcctgtgtgtggaatctccagatgcctaatttataactatttgcctctgtttgtaaaactatggccaggtgctatatgaatgggatagatttgccttcctgggtccatttgccccctctgtaaagggctttggtttattgctatgtcgacagcacaggttaaactgcattgtatctgaagccttcctcacactgaagcagggtcacagaaagtacagcatcagcagagaaggcagctgggaggacagggggagctaaaaggggagggagaaggttaactcttgaatttcccacctctgctgtttcttcttaaactggcctgcatatggcgtctgatattaaaatctcctattcagtacctctcacaaaattctttcagttatttgcttattctcccataccttcaaatattcaaacacttttctggtgaatttgaagttgcataattacctgtaaagcattaaaacagaagaacataatttaattttgtacatttggcgtaagtgtccaagttcaatgagagggggaaaactggagatggtggctctatattggatgattgcttttcccaaagcacgaatgtcctcaagttgcttcattaagagcctttaaaatgcagctttgaaatgtcctgtttgtattttacatagtattttttatataagctgtgattcacagccctgaaattgtatgctgtgttcttttcaatttatttctttataatcaaaatgtattatatgccactgtggctttccttcacaaatgccttacttaacccagaatctgagttttcataatgctgaccacaaaaattcaattcttaaaaatccagattttccacgcatctggatgaatgatgtcatgtaggcccagtattggcatctggaactgaattttttttttttttttttggtttctgttaaatatttggcgtcatggggacaacagcttaaatgtttcttaccatagtgacacctgccacatttggcttgaagaaagtcattcccaattgtctaatgagaaactatgttaatggagttgtcatttttcccccaaaaaaagatatcttgaggtaaaaattatgtgttctaaatattttaattttaaggtatatatattaactcttcccttaaatgaggaactattttctgggaccacttaaagtgttagatatacgtagatatagataataaaaataataatataccttaaaaaataagttccctttcaagaggacatcagttcagaagaggaatttttgacaagaatttttaaaaacataattagaacatggtcggcagatttcctaggcaaacttgtgtttttctatattgatacccttgttacaaagcatgacatttatattaattgaattacaggaaaagttatctgggaaaacaaaattttgctttctacctatggagaaataagaattgaagagtcacccaagcagatacttaagctttctaaatgtagaagcagtatcttgtacataaatctataaacagatgcaaaataaaatgggctttctgctcccaaaggccagtgtccagtggaaatctcttaaaatgcctgaagcatcatcctgtagaagatggaactgatggggtctctgttttttcaagtgggtagaaattgaaccaatgcagacattataagtaggcagcttcagactatcataagatcttttttaagaaaaagagttatttgattgtatatagcttctactgggcattttctatgtactaaatccatcaagtatgtgatgcacctaatctttatagtcacctaataggatagagctctactttatagatgtggaagctgagactaaggagattgttgattttcccaaggccatacaatatagtcaggagtggagcaagaatttgcacccagttctgtctgacagcaaggcctgtgctctctaaccactgtattatgttactgccttatgagctggtgagctcttttccctggggatattccaacagcaactgatgctcacttctcagggatactactggtggagtccctgcttttgtccctaagactgcattaaaatataatctttagcgtatacccccaaaaatggcaagcaaagtttcaaagagatatttgttcacttgtggttgtagcagcattctccacaatagccaaaaggtggaagcaacccaagtgtccattgacagatgaattggttaaacaaaatgtggtctatacatagaatggaatattactcagcctttaaaaggaaggaaattctgacatatgccacaacgtggatgaatcttgaagacattctgctcagtgaaataagccagtcacaacaaaataaatactgtatgattctacggatgtgaggtacctagagtagtcaaattcatagaaatgcaaagtagagtagtggctgccaggggttaggggcagggcagaatggtgagttagtgttaaaggggtacagagtttcagctttgcgagatgaaaagagttctggagatggatgttggtgatgtttgcacaacaatgtgaacataccaaatcccactgaactgtacactcaaaaatggttaagatggtaaatgttacattgtgtgtatttcaccacaatttttaaaacgtgatcattaaaaaagttctaaagtccttttcacctcttaggagtaaaaaattctgtaaaacagtcagagcaagtggactgttgatcagagtaattgtgtgctgactgctcagaaaagcactaattatcatgcccagcacatagtgggtactctgcatacattggctgagtctaaatggttcagaaagaactttaaaaatatgactttttcttattatattcataatacatgttaattgtggaaaatacagttgagaaaaataataaaaatcacttgtagtcctactgttaacatttctgtataaatccatccagagtgtttctgtgcatacaaatatattgcaaaaagtgagatcatattatatacgctgtttggtagcctgctgtttcttccccttaacaatatattatggccttctttccatgtaaattggaaaaattgaatattggcttttattgcatctattcatcatctgtaatgattggtggggaaagataacgtggataattgaaagccatttttcctcctctttcccttgtagtctgtttttttctccagagaattcctcccttgactgaagcagaattgccttctctttagccttgccttgagctagttttctttcaaactgccttccaattgcattgtatatctggccctggctttcggctttgttcgaacattcctgccgagttatctgtcccattcttccacctcacttgtctgctacctctgctaccatcatttgcccctcatttttttcctccttctccatattgtaactgatcactgagatgagaggtggccacctccctacagcctttagaacacccatcaatactgagaaactgtggccacttgtcccaccttgaatctcttatttttcaacgttgtcccgtgacagctgatattaacatatagaaaggtctctggggcatacagtatttacttcactttagacactattaacgtgccctgcatgcccaccgaatggtataatgtaatgatagggaacctgccattgtttcaaatagcagaaagccaatggccatttcaattgcatcccataacttaatctgatccctgaaaatgagaaccattaagaggaggcgtttacttaaagaaaaaaaagttaatatttcatcatcaggtagtaaatagaaataccagtttccacacaaggggactgagcaaagaactcattttgatacaggttctagtttaatcaaaaggtttaaataaaatgcttaatctacagaactccaatgaggactaattctttaaaatgaaaaatgggtgcaaacaatattaaaaacaggcatttcctccttaccacccaaatctatcactgttttgcatcaacagtatcatggtacccaaaatgctatttaaaaccaaattaccatttggactattagaagaatcacttggcatggcatgggcctgatttgttgacaaaaaggcacaggtgctataacctttgcttaataaatcatttagctgcctgacttgcaagcagtgtgattgcctttgcctcatgaaatttacaaatgtatgcacaagccacacacttcactgtgctggaagctggctgatctggagaggtccctgcatagccaaattatgggcatgacacccgttgtctgcctctggtgggggtgcacccagaatgggagaggtggagatcatggagagcattttgagctgttgccattccgtgtgtcatattcctgaagctctacctgagaaaccaaagcttagaccatctgtggaactcttcataagttcctttcttcagtcatttagtgtttacttaattgcttaatagagcctcaacacctacaaagtacagggaataaaaactctcctcgagttgttcaaagtctagcagaggaaacaaatgtgaagaaataatggtaatgacaacaccaacatcaaaacagtgtaatcgcagtactataaagatttgtctaagaggctttaagacaacagagttgggtataggaactttccaaagagtggaagcagcagaagaggctggatagtttttctgtccttgtccttgtctagcttgggcctaatgatatggttcttgtacacttttccctatttttttttttttttttgccaatcagatggtagatcgtgttctaacccatcccaataagagacatgttcagttctgtcttccctggaccagataaaattagactcctttactgctgcacaaggctcagccagaaaccccttcacccctcatttccaagaaacacctcctcctggtggtacatcctcacttgcccacccaagctcacttgagattgcatttcagttagctgacgccattcccgggctcctgcccaccctgacaggagctgcctgagtgtagaaggttagttaccacacagaagttcaaggagcagctggagagttacaaagacaagaaactcagatttccttagagggaaaaatatatatgtgtgtatatatatatatatatacacacacacacacgtacacacatatatatacacatatatatacatatatatacagagatatatatacacatgtatatatcccaccctgcaaccctacctcatcttctaattagaagtggatttgagcatttcagtttcaagccctcacagctgcaaactcccaagattagagaggaatggcagataaaattccactttctcctgactttgagccaagttaaaagtcttattggccaaatgaatattctacagcacccgtgcatgctaggttctgtgcctacactcgctgcagtactcgagagccctctaaggtgctacatctccattttacagatgaggaaaccgaagtttcagaagagtacatttgtcccatggtaattgaagtagctgagatttgaaccagtctccagaacttctgtttttcacaaatacttatctgcatccccagttgtttgtagtgataggttactgaccattttctctttaaaagagtctaagattgactcacactcttatatcaaggaatcagaagccttgaagttagtcccagtgctccctggctccagtgggactgtgctgaacttcgttcttctgaagatctgccccggtctcctgttagttcatgtctctgtaaaaccaagactgaattcattctctcatcctgcctgggaagaagacctttactaatgatattagtctgcatctgtgggaacagctagcctttgtccagagaccagatagcagagcagctaagataactcctttattttcagattttagttgaagctttattccatcacttagaagcattctgtgtgttttatttttgttgttgttggtttcttttttttttcacagtaattcaatttatctagcctagttttttaactgtaaaatagtgaaaatagtgagaaataaatatgtgtgtgtatatatactcacacacacacacacacccttatggttttgggtcttaaattctgttagtgtaaaaaaagtgtttaacacctaatgaatacctaacaaatgatagctttcattgtttggttaataactaaactcttattttctggattacaaagtattttctcatttgattataagagttacactttgaagtaggcagagctattgttattattgttatccccactgtataggttaaaaaaaactgaggtttaaagaggggaagtgactttcccagaaccacatatccagaggtcagtagagtcaggacacaaacccacttctgattccacgtgtcctatgaaggaaggacttgtgtataagccattcagcacctgctgctctatggtcagaacctacttaccaaaagcaaccgtctagcaaattaggaagcctcctactacccactgcaaaatcctaaccctgtaggttgttccactgagcatcaaccttacaggtgcccaaaagcctgtttaaattgggcacagctattcttcccttgtacaggcagcagtctaagtgtaccattgcttctcttacgctaaattgtgcctgagaagggccttcccaaggggagacaatgtctctgagagtggtaaggactggcaggaagtgaatgcacccctcagaatctaaagggaaaggaggtacctaaatcgaggtggtgcctggtcattttttctcgtatgttctcagctccagtagcaggtgttgaatagtaagcaacacctcgcagagatgagttactcatgcaatctgcttcccctccctccatactactgtgggcaggagtgaatcgtcccagcttccccagctcccacaccaacctgtaagttcttgacacattctcttcacatacacttggcggctgactcactgacaggctatgagacactcttaaaataaatttttcaataaacagagtctttgtctttcaagttttaatttggcagcatgtcgtagacatccttggccacaaacttcacttctggacaaagttcgagccattaattctagatactggtcaccttttctctcagttcctgttcttcctgtcacctttgctccacaaagatttgggggatcttcttagttgaaacaaattgatgattattgtaataattaaggtctctgccatagtatctggcacacaataggtgctcagtaaatattgcttctcttcttgcttccttttttttaatattaaagtgagaacagtggcaatagagaaggggaaggtaaaaaagagatttcacaggaaattttacattgtatgggagaggaagggaatagaccaaaaatctgctatccattaaattagcacttggaactgtgggaaaagggggacagaaaatgatgtcaggaaaagggttggaaaaaggagttgtgagttggtggacagaactgacaggaactagatcaaaagttgatgatagccatgcatggaacttagaaaaccatagtgccaagtgcagaaatgccatcaacatttctagcttttaggtgggtctccataacaatgcttctgatcagtgacattccagggtactaagggaaatgtactgggtactcaccaggtttctctgggggaacaggaggaaaagtcatgattcaaggagtaggacagacctgttctgacatcctggctgtgccatttatctcagtgatcttgtgtatcttaccctttaaaattcagcttcctcatctgtgaaatgaaggcaataatagtatctacctcatagaagaaaccccaattaagtgtggtttaagccagtcaggattattttcctcccgtaacaagaaatctgtgagtgagtggttgttggcattgtttcagcgctgcacgaggccaacaggaacccatgccgttcctaacattctgctctgtcttcctcagtatgctgcctcttcagcctcatgcttagagcctctgacggcaagatggctgctgcagctccaaatagcatagtcatatcataccttatttttcctctaatatcagggaaaaggccctgctattcctcctgtgcaccctgctagcaaatttctttgtaggtctcattggctaaatctgggtcacattttaatctctagctgcaaaggatgctgagaaaaccagcagaagattatcttgattggctcaaatcatgaccgtcacctaggaccagtcacatttgcctctctaagcaaaattgtcccaaggaagaaggcgcaataggtagtggatagactgttaataggatctgccatattcttttttcctattccctgataggtttcatgcacttttcaactccagtagttgcacttgaccctcttgtctctgaatgcttggcttattattctgcctttcctccacacactccctatgtgtttaggagatgtagatgctatgtgcgtgactgtgcagaggtcatttcttttcagcctctgtttgaggtccaggatttgggcagaagtcctggcgttttgtgcagacctgctcccatggggctgggtcaccgtgtgctggttaaacatggactctgaaaaggctgagttggaggatatgtgcctttgtggttgcaggggagctctgtgaaacagtgccccctgggtgccctccagagtgcttaccaaacaggcagcaataggttctgggtttctcttttatgacttggaaccagatgcttcctttgcaaaggaaaagagcctggttttgcagagcttgagtcaacacaagttcagagaacaggaaaatgagttgactggccctgctgcatgaactttgaggagagaactcaatacaggtggtgttctcgctgtccacaaagtccttgcttgtgaaaatcctatgcccaagaaattggccttaccgaatatttctacactctaaataatgactgttcacatgaggaaaggattcagcattaggaatccttttggacctaggctttcccagggcttctaatgagtctaaggccttgaaagttccactgacacacacagtttcaagcccagagcttgctgtctaatgtgagatccatcgaagatctcacgtgaggtctcagtgattcttcctgccacttttctcacacccacctgcttaccttcctgtttgtttattgaggacttaggcacattctttgatctgtgccctgtctttttgggatatagcctttctattgagtctgttcattgagttacattccacagcacacacctcccccaaaatatttgcatgagaatttttcttaaggtctcacattgcttcctttacagcagagatgaaataacttagcacttctaattggcttttcactttccaaacgctttacacatttaactaatgagtcacatgagcttgtgataagccggatcccttgtcttggagcagggacactgggttaggacaggctgttctggccctgtgtttctcaccctcaacaccctccttcctcagagtctgaatgtgttgagataatggggatgccaccaggcacagttgttctcagcacagggcaacctcggaccctcacagtgctgccttaataatgtgggaagcaccctttgctgccctccagggctggactatgctgcatatctcctgttgccttgactagtgaagggaagcataaggccagccctcatgacatacagcttctgcccctctcaagcgcagtcttccttccattggtccctggcagtgtgtctgtgcatatatggggaaggagtggtactagggggatagaagaataacatagtaggtctaataagggaactgaccataggagggacctatggtcttggtacacagagaaaccctggactaggagtttttctacatcttggtacacagagaaaccctggactaggagtcaaaatacctggattcctagctcatctctcccacccgccagctgcatgattgatcttagagaggagaaagaagccagaatttattgagcacctactatgttcctggcaccatactaagctggaagggaggctaaagatgtacattattcaatccctgccgtacatagctcacagaaagaaaagtaaataaactaagatgtgatcgatgaagtaattgaaataggtataatccatacagaagagtcagtaactaactctggggagaagcatggagctcatggaagatatgccagaggagaagacacatgagtggttttgaaggagacagatatacttggtggggagaacattccagaccaggcaggaggaacagtgcatgcaaaggaacagcagtgtgtgtctgaagaaccctattctgtttggtgtatctgtcagtttacagtagacggcagaaacattagatcagagtctagtcgtgaataaatacatacctttttccaagggtagtaaagcacttggactttattctgtgggagatgggaagcaggtgatgggcacagtgggatctctatatgtgaagaaacctctgccttgcttggttcaatcctcctgagatacaggattttataggcaatagtagcattgagacctgtggtcatgaggtaccttcctcttctgggcagcataatgtagtggaaaaaatagaagctttggagggagacagacctgagtttgatctcagtatgtgaccttggaataatttttagcctttctgaccctcagatgtcacatctataaaattataaatgaatgcctgcattccacttagagttatgtaaagactcagtctagttaggatgaaaagccctcagcaccctgcccagccagtgtgtggtgctgccttttcagccctcaggagggaacctctgtgagcactggaggcagggtgctgctcatttatctttaggacaaggggcctgtgaccacaaagaagaaacagaaatggtaatatgatgagcaccccggaggtaatctggtaatgttctccctgagctaaatctcttctcaccgcatcctcccgtgtccattttccttaagttgtgccattaattctctcattacccagtggaatgatatttatgtattaagatcatacttagcatactcccaaggagcaagttaaagttcaactaacgtcgccagtttctcgttgtaaggataaatacactgaggaatccatacggagagcttctgtgtgtcttataatttcatattaaaaaaagattaaattttatactggataagagagggaaggaaaaaaaaatcccagtgcaaaaacaagttgtgaacctaggagcacagtttctgaatgtttattttgtcagatacacagctgacatgattagttctaatggggtggtgatcctcattgaattgcagattggtatgagtgactgaaataccgcagggacttaaataagtggtgcatatggtattacttaggctgcatcctttagccaaggtgaaggcttcgttttctgtccattcctaacatgcatgcagacacacacacacacacacacacacacacacacacacacacacctgctacatatgcgtccatctagtccagaagctccacactgaacatcaattacctatctagagtaaggctggctggcctttacttccttccctttgccctgtgttacctgagtgcacccccaagcccccacactctccagtgtagataatggtgtatcagattagtctgccttgctgctgcatcaagacccagatcaatttattgactctgccagagtggctggtacagtaattgttacaagagaagaatagaaagtgagaacgtgtacacatgaaaaataaaaatgacgttttgttctctcctgccccctcccccgccttttttttcctcatagatctttatgtgtttacacagcagagagcactttacttaagttaatcagctccttctacattattaattgtgacagggtgccacatgacaggacgagtattatgggaaacattgatctcactccgatggtgtggacctgagcaggtttggtattcctctccctatctcgctgctttggggtcccatcaaatcacatttccctgattgacaacacggaatgcctcccatcaatacgattgattttgtgaaaaggacaaggaacatttttcaactggagagagatgaattgtggttatgggaaagagagcatctcagaaatctttcaggttagaagcctaaattgggaactaaggtattcttgtcatcccaaacacaagcataatttgtaccccctgaaaaatggtattaggagaaacttattacaagtgaaaaatagacttagtggaggccagcaatgaacctgaggacataatggctgtttttaaaaggccacctgctaatttttttgtgaggaatttttggttaagtgcacatctttgaaagacatttcattaaagttcagctttcatggcttatacctgtagaccctaacataaatcctgtgtgaacggacaaaactgagtgggtgtcatttgtgacctggaaataaaaggtcaaccattgaatttatagcttttttagtgaaaagaacataaagattcctgccaactggagtcaatccatattttaatgtttcctagttaagattataaaatcaagggattaggatcgtgctgctcaatgaaggtcaaaaattaaatgtgatgggctaagtgtcattcccatggggcagaagttaatatttcaaaaaccatttctaccactggcagtcaagaaatgaattgtccatgatcattaaccaagttaaggggaatcccactatcattactaaatttaatgatgattattatactaatcaactatattattaaattactctgctgttctgtaatgtccccaaacagtaatagtgaattgattgctaccaagtaattctcatatacagttgagaacaagttgagatgcaggatcatggatgaaggcctccttttgaagaaagaagttgtggctattttatggataacagtgataacgtagaacgttcttttaagatgaagagtgagtggcactacagacctgttattaactataattcattagtacatgttttttaagtacaaaaaaagaacacgtatttctctttattgtgtttttttttctctttcagatttttgtatcctcctcccgatgcttttttttttcttttcttttctttgggaaaaagaacatctattttgccagattcctttttccacaaatttttagagctctggatactgtctactttggatttttatgaagagggaagaaaggatatttaaatgtctttatatgatgactcagacacatgtgccctgtaccattttcaaatccattttaagatgccagtatttttcaaaagttttagaaatttccttaaagctggtaatttccttaaagattatctactccagactcccatcatttttcagatacaactttaagaatattttggaataaagttcatatcattttaataaagtagcacctccaaataagaggggccaaagcctggggaactgaaacaacttgcaaggccccaaagctaatcagagacagagcaggactgaaatgcagggacctgttatgagtgaaggaagggactaatggtttaatatgtggcttagaaaatgggtgcatggtttccattttacaaaggtgttttataaaagcccaatatcattagactgactcaaacgcattgcaattccaaggaacaaatgcatgtaattcagaagttcactttgcaggatttactttcatagactgccgtgcaggggtgtgtgtgtgtgtgtgtgtgtgtgtgtgtgtgtgtgtgtgtctgtctgtctgtctgtctgtgtaacctgtgcttccgtctatgctcctggacagcttttttttgcatattttcctatcttctgatcttcacagtgcagacaaaggtcaaaattcccatctaccttcacaggcaaacactttaaagtgcttctacatgaggcaggttgtagggaggacctttgatttaaagttcagcatttacatttgtaattttgactaatttctgtgctagcattaattaaattgaaattatttaattagaataaaactgaaattgatcattaggattaatttaacctgatagactttgtgtgcctttctagacaaatattatgaaatatagtgataatgaagtagtgagaggtataatttcacatcttataatgattttagtatccagttgttctctctgatatctagatagtgctgaatattgctctttgttacatcattaccatttagctagggccatgctgtatctcttatttggcctcttcccaaacatttttttcctgtcttgaagtctgaagatgtaccaaactcccttcacaccacccccctgttaacgtcattgttccctttcccccacccccaccgtcttccaggaaggcggtttgcttggctcatcccttgggtcttgcattgcagtgacctttgtaagccaagaactgccggatgaaactcattatggaattcgctaatgctcctcagccctggggtcaatactgtcaaatctggactatcccctcgcaccccttcctggctgcttgctttgagtcagaagcaggcacggaatgaagccctgacgagggatgccaggcactgagtaggtaactccaagggagtacaggagagaagcgttactcctcccggtgccagattcgcttccaggaaatagtttcccctcttcatcccacaccttccacatagtttgatcaagcaaacacgcttccaaagttggtgccctctgtttcttaaagaaaattataggtgaatgaaactactattttaccagaagaatcagtataaatgaaatgagattagatctgaatctacctacccacacatgaacaagtataaaacactttgaactatcaactattaaatcaactatcaaattattttgtcttcaaaaccattaggatccacatgaataaattaaatcctcaggaaaatgtgcaaaccattttaagtttcaaatttctcccattcaccattttgtcagagttgcttaaaaaaaaaaaaaagtaacattagcagttatgtttaataggcttcctgtagcagcccttattggcaggggtccaaaggacagtggaaaatgaaccaaagtttgatagatatttatgaaaaagaaagaagaaaaaatacacaaaagaaagaacacatgattttcagtcatttggaattgactgaccaatgagaaattatctcttatgcaaattatcttctttctggaaatcaaccaatcagtcctggctaaaggctgagaaacttaagattgtaagcccaaattccacccaatcactgtaactaaactgctgctcccaaagaaaccagttttatcatccatttctgcagaacgtcatctaaatggattccgctttcattcatgtccttatccagtaagaggaagcttctgatttttccagcagagggttttatttagaagcatattcacatttaatttggttttagaaaacccttaatgttttttaatattgagctaggttgagttcaggggattgagaaaaaagactaaaagctttgcatatagctagcatgctcgtgctattattgaacatgcaagaaaagtgacggctcaatattgcactaggttaagaaaaggccatgatctagcacatgaagatgaggtttctgtcttccgccagacagagaggaatccccttcccccaccccaacaactccaaagataaaaaagcatcagttacagtcctgttaggagacaaaacacaaatattagttcatttcatcctcacaagcaccatgctagctagcaaggtggtcttcatcctttcttagcagaggtgcaaactgagatccagattcaccacacactcctagtccatccacccccagccatgcaattgcttctctgaaccccaccacccccacagcagtgcttactcttgaactatttatctgacgcatcacatgtcactctgcagggatgcagctgctgaatctgggtactgggaatgccacaacctgcagttttgccaggtatgctcacctatcaggaaaggactgctccagtatgaaaagatgctataaagtaactcttgagcattgccctgaggttacagttactattagtatcattgatttattactgctgtacccacttgcttgctgttatagataaactccaattcagagagaagttgagaaggagagtccttggtgctctttctcctgtgccctttccatttctgcccatgaagatgatggctgctttctctgaactccttgacccttgcttagcaacaagattgagtcttaatttcaataagccaggaaatcagctctctccagattggttccctgtgggcatctgagaaccccttcaactcttcctgcttctaaatgaaaaatagccatttcttcctctctgatgcacctttattggctggaaaatccctgagatctttttgacctcaaaaacctcttaggtttaggatctcttttgggctgggtacatttctcttcataacttaatcttcaaggcagaaaaaccatttaagcaaacccttgttttaatatttgaagagaatcaacgtgcattgaccatttccacagaaagctgaaactcattgcacagaaattttaagtcatggccatgagattctagaatctacatctagaagccattttcaactataatgttaactagaatgccttttagggaaaattaagaagcaaagttctcctggcccctgccctgcctttctctctgtccttctttgcctctggagtagacctgaggaaatttttaatactaacgagaacttggtgctgcgtagcctctgagtctgaaatgcctgagaaagcagtccagattccaactgtaaaacattccttcaccaagccttggaaactaacatacagaggccggcagagttcagagggagcacatgtaaatgaggctccgttataaactcctgaggagtgttttatttagtttaaacctgaacttgaacttgtaaacggtgttccttgagaacaatacagaaaggttgatgcagtagaacaggaagtcacattttagctcagacattttactcctttaaaagaaggaaactatcttaaagtatttcttaattgaactgtcttctagaatagcacaaattggcatgtctgcaagatttttgggattgcagaatcagaatggaagtgtatatgtatatatatcatttgaacttaccaccattcttgcaaaataaacaatagaatttcctatccatatggcgatttaacaagaggatatttaaagagcctgtccacatataacagtcatgccatctgtaattgattttattaattgataataaagtgacagtagaggtgtgggaccgtttcaaactagcactgtgtgtgtgtattgagagtttgttcccaaatctcagttgctggtagagcactaccaagtggaatttatccgaaaacaaagtgagaatgattttgtacgcatgctcaattttataaaacacattcttgaatcagtcttcaataatctttgcttgcgagatctccatctcagaagtcactactaaaaaggtaaaaaataaattaaattgtctgtgttagaatgatattacctctctccaagaagcatagatccctgacagggaagccaagcagctctgccaatcacgtatgctatgtacatgtccaggttgttggtaaggcccttcacggagactgtcaatgctataggatcttcaccttgcacaaatcccaaccgcagccccatcaagaagcctccccctcatatcccctggaaatatttgggaggaatctaattgtttgtagcaacgaatattgcttagttgtaaatttaatctacaaatttagaaggaaataaatctgaacataaaaagcatttgctgtttcagcattaaaaaaaaaatgctatcatttgaaactgcaaactctcccatgtgggtttgttttgcaagtcacgtcttaacaaagacaagttttgttgccataaaaccctaaatcctaccacatcctcagaaggaggagaaaagtattgttcactggttccgggtttgggctttcaggataacacagagctatgaccgcgcacagggaaattgtttggtatttatccagagttgttggttcaggtgaaaccctgacacacacatacctcccatctagattatatcagtgcctcatgtaattatgctccttacattttaggcctgtgtctgaaagtcgttttgtatttttaactttattttttccctcaaatgatgtgataactagtatcctgaggcctgttttgcagaaaagttaaagttggacccctgactccctacaaactaggatttagatctctgactccatgatctgactttttccatagccaagctcattctgacctcaatgaaagataggaacagttttacctctcccaatatcccatctaccctgtgaacgattagaaaaaaaaaatgattcctggcaccagtgatatctaaaagcaggtgttcctagaaggtaaagaaaggcatagcaacaggatcttgtagtatccttagagagatctggtgaagttcaggcccctcagcaagccagtgactgaactgggacttgaaccaggccaccagacccgcagtccagtgcttaactatcttttctcatgaatctgaaaacgcagatgccacagtttcctttgcattctctccaaatgctgcctgtatgtcttgtttctttggctcacaacagaagccttccaggggttgtggtttgcagctcaaggccttcttcacttcatcttaatccttagggactgttggtctgcatggcctgggagagagtaggggtctgtcatgattcctgcacagggattaaacacaggtggagagggagggagacactaacttgaggggtgggaggagatagagaatggaactagaaagaccaggaacagtggacaggggagaattaaagaggtaacgagcagacctgtgccagggcttgagcgtggaagtgcctgctggggtggagaagtccaaaggtggcagatgctatccagtgtctgaagggcttcttggctggaaaggttggtttgggaattcatttctggcaaaaggccagatcttctggcatactgttgcaggatgtatctgggagaatttttgaaataactggactttttacttcaatgttattttctctcttactggactttatcttcctgcacaatccacactaaggtctccttgattgattggctctcaacctgagtcatgtttgggaagagcaagagcgaggaggcacggagtagaatgattattacaatgtggccacgctctgctgagctccggcctccactcccacgcctctctttttaaacaagaaaggttacctccctgggccaccattgggccaaccccaagtgtttctgtctgcacttgttagacaacaggcatttaattaaaattggaatccgatgtgtagaaaacatacattttttcatttcatagctccccaggaagtcatattcccttccttccccactctcctcaactctccccctgccaaaaaaatttaaaaaaaaattgtgaaggaaaagattattttaatgtgaaaatcaaaaattacaaagggctaggctgcttcttcattttttgcctttgggggagacattagccaatcataaagcctgtattgtgtcttcagaccaggagccagcttttttatggctaacttcccatatggaaaagggtttgtcccatttcagggcattaaaatacagcctttaatgaatttgtaacttaaatcttttatcttgctcttatgcgatagaaagtgtggcctgtcttctgatatttgttggactttgtggaatcaacaaatacaaagaaacagataataaacatgaggcccaagttgaaaaataaagccgcgaaaccccgtcgccactgcattttccgcagcagagccatccactgcactgtctgggctccacccagaaaatccggcagtgccatcatgaccaaatagataggaactctggacaatttcatcgggtcattgtccccttaatctccacgctgcacctcagatctcaagcagcttccgtggcgcaggctcaatttaatggatagaatctatttttcatgaaaaagcaggaaataagctgtctctttcataaaaagatttacaaaatgtaatcattgttgaaatattccctttgaactgccgtgtccacgggggtctccggctcccagagtcgtgcttcattagaaccccgtcataagcggctccagaagggcaggtacgctggtggtgcccggctttgatgtcttgaatgaatgaaagaaaagcacaataaaaaagagctgttgatcaagcataaaatactctttaagctgacagaatagcagcgttaacacaccctaagctgcttttagtttttcccttttttcctcacattttcctgtgctttgtgtacagtgggggtttgtattttataagaagtctctgatctatgtagtatgccattcgctaacaaaaaccaaaataggattgtttctgtcccacttggttgcctgactaccccctcccttcctccccttttctcctcacccccaacctccaaggcgtgcagtttagccttgcaaggcaagggcccaaatgcctttcataaacttgagccaattccttttgtgttgtgggtttcaccgctctgattttaatatcgcaattaaagacagatttttattttctcaagaactttctcttgcaactggggaaatggaattgacgcagctgctacttttaactaagaaattatatcattaaataagagaaagccgccttgtagagtgatttgctttcctggggacgttgggtctcacgtggaccctaaggccccagaaaccgttcacagtgagagaacccagctacccctggctttctggctttctgtagtagcccctagccaggcatttaatccccacaaaaactgatacagttgttacctccatttcatggagtctaaaactgagacctagtgatgctaacttgcctaagattatctaactagttcataatggtgccaggatttttgtcattcggaccccagagtcctggctcttacggctatgcacacagctctctagtaggatcttggagcaaatgcggtgggccggagtgcagtttttaatccagcagtctttgatttcatgaggtaaaaggttacgtgatgaaaaatggaaaggaagggagaccaaaagaaaaatgtacttggtggtaagagagacactagggcaagctggaatctcgtgaaagattcagactttggatgaacagtcagaataattggattgtgtatgcactctcaaggtttggaggtactggatggcttattgggtaaaaagattagtgttttcccgtcttgaggtctgaaccaaacggaggtcttggctgggagcagcacagtcattctccagggattggtggtttggacaacttctctgagcttgtagtaagtaggcagcagtccatgttacaaaactattgcacatgctactgacgcagttggccgcaactggccccgctgcaacaactctcccgtcggaactgcctggagtggcttgtggagacttgtgtccctcgagggagagtgtctgtcatttggggagacatggtcatgtggcacgagcatgctagaagtcatccatccagatgccttgctttgccctcattggggtgactgacaccaggctttggtaacctcggatacagcttgttcttccttccctcctttatttatttaacagtatttattacatgcccaccctggcatcccttagatagccagcttgcctgggatgaaaacaggtaattaaagtttagcaactgtgacagaggagaatcctgagggtaaaggccccaagaaagacccctctgaagaagggacatctaatcttagaacccaaggactagtaagcattagcaaagccaaggagtgggacagcctgtgcccaggcctggcagggagaaagcatttggctttgggggatccggaagaagtttaaggcaacaaaagtgttgaggacaagtggtgaaaagataaggccacaaaggtgccggggccaatcccggcccattacggttttaatagttttctgtacaataaacaagtcttggttcggagttactgaaaacagactttctttaattaagaaaataaaatcaggcaagaaaaatgattacagagatcaaagcccaaggctggcagtaccagtaactaacacctgtgtacagcatgacacccttttcagaagaaaccagtgtaaatcactgctgcctctcatgaatacagactggtcctcacaagactctgagggtcccaggacagggactggcttgcttgaagtcacactgctggtcagtggaaaaagtgacaccaatcctgagtcctttggacactggatactgggcatcgttcattgccagaagtttataaaatcctattgggagaaaagcaggctatctggtatcatgaagggtctagaatctagccactgcttcctgatagacaagaaagtcctacagggcagggactatattttactcattatatccccagagccagcatacatagcacctagcacatagaaggcccttagtgcttgttggatgagtgaataaatgctcccaaatggtttatgcgaatgtgagaaactcagagtccactgagagacctcatccatttctatcatattgagatgggcagaagagactactgggcttttggctgatttgccaaggacaactcatttgggctaaacagtaggctttagtccatccacagaagtgcgggaagccaaaaatgacccactggagtagtgtgaagtagtagtgcaaagctaacacctccccaagagagaatgcacaacagcgacagcagctcctggagtcttggcttattggttggctgagtcctctttgggggctgatgaggagctgggcctgcagggtgcggggaggccagcctgtgtttgcacatttccgttttatgtgtgtgaatgtcctcaaataacccaccttgcctgcagaagaaagccaagtgtcacacccagttctggattccacattaacaacctccttccgcagtgttaaactttgcccttgttgaggccttttgtttaagtttttaatctgaaaaacagattctgctgcatcacagtccactctgccctctgcccctgccaccccagcactctctgctccttttaggggttaaagtaaaatacaaaatacaaaaaatgtttctcagacatttttctttttcctctagaatgtgcatcctgccctcttagtaaaaagaggatgtaaaaagccttttaaaaagttgttgcacacattagagcatttgttgctaacgcaggggttgaggccatggcccgcatcagctgtgtcttcagcagccccatgaccacattttggaagacggcccctgtgttctgattgctctctgtgaggcgtacgaaatggaagagattggcaccgtcagaggtaccttctgccatttcaggcttcctgtttaggatgcagtcggatagatattgtttatggttcataaaacctgactactgtgagtattccagaatcccagcggaatgggattcgaactttcatggagctgtaaattaacgggcggcaagtgtgataaaactccttagagaactgtgaggggaaaaagtcgtgctgcaatggttaaatgaaattttataagcacattcagtgtggagctgttttgcattacatgagttgaataccttagagacgccacatctgcaggcactttattaaatccttagtcagcacttttccaacctgatgagattacttcttcatttgactggagaaaaggaaagctgagctcttgtcctggactgcagatttcttttgatgtttcaccttgaacattgaaagaggacagtcaccccacttccctccccactcccgctcagcacatcccaaactctagacattgtgaatgttaccgactaattttacgtaactggagccttggtgggagtgtggatttgtggacctccacaacaactatagctgaaagtttctgaggaaaaaatagatcaaagctctgtgtttacttaatgtaaatgtatcaagataacatcatcctatattgcattgtaataatgccactcactgcacatagggagggagattcctttgtagtccatttggatacagtagggtagattaaggggctataaagtacgaaggcagaaagcatatgaaacctaagcttatgtcactaaatgtctgaggatagtttttgtttaatgtgttaccattttcccagtgatttgctgctcaaccccaacgatcgaataagctcagatttcttttatgtttttcctatatgacccaagaagaaaatatgcagaatcattcttcaattaatgttctaaaacttgtactgcttgcataatagaaattataagaaaatatcacaagagaaaagtaggcttttacaaacattatattgtccatctggtgttactagcagctcatggaagtttctaggaattgactggcttacacatgtgtgactgtcacactcatcccaatgggattatgagtgtctttacaaactgattaggagaaaattcagggagatgtatgaattattattattattattattattattagaactatctgccatctctgcaaataaatgatttaatcagagacttcaaaaaagaaaaattccctgtgtggttcccctaaccaacttcctgttctggaaaaccttggtcaagtagctgggttaattgtcatgaagattagtgtgatgttgaaataagtactaatggtcaaattataggagtgaacaagtttaagaataggttttggtttgggcctgaaagggttaattaaggttttttcacgggttattaaagacccccaacctctgccttcaggagtcatattgacaccccaccacagggcagctcagcccctctgttgacatgttgctggtcagagcacaatagccttctgtgtctgcaaatcattgctaaaatcatctcaaggaaaaaaaagtttgaaagctttaacgttagacaaaagcccaagagttgcagcgtgcagcccaaaaacctggagtcagcaacttctattgattaaaaactaacctttaaagtaactctgagagtgtgtggttagcatttaaatttaaacatgtcatgagttgatttgtgttactgaataccaactcagaaggagtaacattcacatcgcattttttttttctaattcccttaagcagctaaagtatttcatgaaatgtcaatagggcaaaaagaaaaagaggtggggggctgatgctgggccttgtagttttctttcccatgcaaatatccaccccccaaaagaaaagtgtgcagagtgaaacacaataattagtcctttgtctaactttcccaagtgccagagaaagacagattaattaaatatacaacaatgttggtttttggagtgggggtcttgcttgctgtgtaggtcataaattaggcagaataaatacttcaatgtgtttgcagtgggcctgctacgtcagaaccactggaaggttggtgggaggagagcagagggtttcttgctaatgatagtcacgtctgggtctgtctggttgctcttagcaaccagacatgatgtaacaccaggatgaacttgaacttgggggacttgaaaagagaacaatagaccagagcaatcaataaagcctatttcagtgaaggattacagagctgctctggggtaaccttgtcggcaaggcacatactgaatagtaagatgtgtgaagaaacttttttttttttttttttttttttgctttgctttttaagagaagtgcagaggcactgcagatttttgtagtgccctgaggtctcgtccagaaactgtggtgtggagaactgctccccctgctgactcactgggtgccaggcctttgcttcaagaactaccttagtgtcagattgaagaagtctggaatttcacaaccgacttagaaagtgtgaaaacagaaatagtaagcattattccccgcacccaaagtttgaacctgttttgtagaagggaggaagcggctctaacgtggatgagagtcagctgttaggtagaggcctactagaaacacagtttggggtttgctttctctctcctttctctccccctcttctttcttttgtccagctagatttaggccatgtgtatttgccaggctgatttcctttcaggacacaagaggctttattgtgttcctcaaagcatgtggtcaaagaataacatctgaaagtctacaggatgcgtagtttttcggtctgggcttaagttttttaaactcctctggaaatcaaaggtggcttgtgtgactaggaaatcttataccaaactccatgtagctatcacttagccattcatccctggggaccaaatgagtccttacattacctaatggaatctcttccacagggatgatccttcacctgcctgaagcaacccaattagaaccctttctgataccgtcaacttaaagaattcagaagcattggtttttgttaggccttggtaatttttctgtaaataatgataaatgtagtgaatttgtcaaggtatctctagagaaaagtcggcaaaagccacatacttttttatttcactggagaaactaactctgatgttagtccataattgctcattctgtctagctaacagaaaaagaaatgccagcagataaagtgatatatgaccagacaattgctcaaagctaaccacctaaggatttacgaaaggaaaaggtaaccagtaactgggcctggcaggcacacagaaggctctaaataaatgctgcatggacgcaagcatgaatgaagggtacgcagtggcctcatttttcctttggacaatgtggtacttaatagagtaaaatcttgatcctacttagttattatgtttcatgtttgaaaataccattttagatatattgggctgaaaggagcatcttccctcataaaatcctacatatgtaaggaaggaaaaatactgtgacttgctcaaaatcacccaggaagactgggtccagcactttttccaccttacctccacttattcttgtgtcgctattgaccatctgggcctgttaggagagtgtcacaatcatggcttcagtgcctgcacctcatttgaaaggagatgttgaaaatcatcagagtagccattcattgccacatgaaacccctccctttacccattctccattcattcaactcttcttcattaagaacgttctgtattccaggcactgggctaggcactgaggattgaatgataaacaagatggtcaagtttcctgccctcctataactgcccccatcagttaacaaaacccttatttgtatttcaagtgaacagaaatacctcattctgtaagatatactcagaatgttggaaaaccccaatgaagacaatgaattataatttcagaagaataagatcagtttcagtgtcacaggattttttattgtctgtcgtgcctttacttttcccagcgaatccctcccgcatccctaacgtagatcctgatttcgtggttgaaaaggcaacttctaaaacacacgtttttacaaattgtgattttaattgtatttttccttttgtcttccagtcctggtacctgggataaaagttgcagcgtcccaccatccaccagacagaccacctgaccccttctcaactctgtaacatggacgcaacctcaacccagcgcagttacaacttcactatcagcggaaggggagaaaaaccgattcaaatcaacttgtacatggaaacagcaagcattatggtcaaacagcaaaggccataaccttttgggatttttttttttttaaaatactttagggactgttgtaatttctcatatggtgctggaaatggttgggctttgtaacatttgaagtgtttccatggtagcgtgagcattaggtgacgtggctagcggaggactacccttgctcactgacttcctgttgtaacacactttccttacggagcctggctgtttcacagtatttcatgaatttacccacacaggtgtgatcctccttgagcattgaggaggcacatggagaactaaatcttttgtagtagctgagatctgcaatatataacgggacagtcaaagggcaatgtttttctgtaacatattggaaaaagaaaatgcagttatattccttttttatttgttcctttagtttgttttggttcagcagtcagcagttaagtatataacatggcccgcaaggacaatgaatccactcacattgcagaacaattccgaaaatggcaaactactactactactgttcagttttttaaaagttttgaaatgctgcacttacatttaaaaaaacaacaacaacattttttcaacaatttcaacaatgacacaaaaattcacatggaaatggggaagatggtctgttttgacagaaactgacaggaatcaatcaaaacaatcgaattttgaattgagtaaagtgcaatttcattggatagctaaatatctttgtaagatagagattgttgaaaattctatttttgtttttctagtcctttcaccccaggactctaaattattggggtaaaaaacagccttgcaagaaaaaggggagctatttttgctttttatgttttttattgttaaacttgtatccctttaaaaactgaaggaaattaaaaaaaaaaaacaaaaaaacaaatctaatggtgcttttaccacaatatgttaactacattaaatgctaattaattattttctgttatcaaagcacatgactaaaatgaaatcatggtatctgttaattttataagctagaagtcactataatggattacgccaattctaaaaaattttacacctatctggcatcataggatttatcagttatcagacacctcattgtaccagagattgtccagaagttttaaagacctttgcatccctgaactgggctatgggaaataataatagtaataataataataataataatgatgaaaccaatactgacacaaatgctggtgcccattcagatcaagggtacttgttagggaaaaaaaaaaaagtttgcacccccaaacgtcctgtatcttatgaaaaaaaaaacaaaaaacaaaaacaaaaaaaaaacacaaaaaaccacagaaacaaaaacaaaaaaaagtgcaagtgatttttctaccagacagcgaagcacccctttgcttcccatgcgacttcaagaaggtttcctatactatacatatatatacgttctggttggcaagccctgctgatcagagaaagtctctgcatgttctagtgttagtaactaatttttatatagttaatgtaggataaagtagagtgcattaagacacaatattgtaatccctactctaggcacttgcctttaaactatgtttttcagcccttcagaagggttctactactgtcctatacaatcaagtaactgaaattcttgggaagacactttgctcctcatctttctccccgaaacaatgttgttttgttttgttttttttccttaatttgcacgaaaacaaaaattccatatcaatgtgccttgccctggatagcgattatttgtggaattgttgcacatgctcctctattgaaaggggtttttccctagtcaagcatttggagacactttttgtaaatgtgacttttatgtcagccatcgtcagtttcaacatctagaactaaatagaaagctagttgttccgcagataggagtagtctttattgtcctgtacggtcggtggcagtgctattctgagatctgtagatgcttagaatatcagtattttggatgttgctgcattttacaatttatttggagtcttcctttattttcccccagatatatgaaaatatgcaatacctgcttatatcatgtagaaaagcttagcaattattaatttttcttttatttttttttatttgaccaaagtcggtgctgcacttgacgcagtgtgttttaggtgtttgtctttgtacttttttgtgatttttgaatgcacgtgcgcaggaagggctcctcttagagaagcagtcaaactgtgaagcactaagctgaccctgcttcaagcaattttgtttttacaactgttcctttcacaagcaagccttaaaaaaaaaaaagacaacttcctttttcttcagctcccacaccccatttttcttagcagactgcagtcaatccacattcaataaaaagtatataatgcccatttttatatgcacgtttttaaacttccaagttctgaaaattgtttactggttatctctatttaaggaaaaaaaaataaaataaaacattttggattttcatatgtgtctgataagtggttgaatagtcgtttggcgctgttgtatggtgtgattgtcagtgtatggtgtcacttcctatagccagccagcatactttgccttcccctatagcacttagctgggcattactttattatgacatatgtgcactaaaaaatgaaaaaaaggaaaaaaagaaaaaaaaaaagaaaaaatagcagctttcagtgcttcacagtgaagggaaaaaagcctagacaaacattttgtcagaaccttgcaataagccaaggtattaccagtaaattggttgtatatacaataaaattgcacccttttttaaacaaaacaaactaagcaatagtttgggcagttttagttgtttttagtgagcatgttgtagtcatgactgcaaagagagagaataaactgcccgctcagaagatatgtaatttgtattgttgtatagttttattgattacactgatttattctaccctattttataatgcaggacttttgtaatgttgtttaaatgaggaaaaatttctgtcaaattagcctagtaaaatttctgatcgttcattataaaggcagcgttcatagaattgcttttctttctttttaccccccctttgggaactggatttaagtttaaaactttcctgtttcctttttttttttttttttgtaagtatttaaatacaattatttttttctctcaatggtatagcatattcctatgcttgagaagtataggtctactgaaaaaccattgtaaatggacgttacaggtatgctgtatttttgaaggtattttgttgtattaagtttgatgaagctaaaattagggaactctgaacagatttgcaggaaaaaatgttttaaaggctttaaaacattagggaggcagtctagggtgataacgaacaggggttaagtattaaatacacgaagttacatttttgttcatgtttcattgtccagaaagcagcaggaaactattcagttgtgatcaagcaggaaaaaagaaacaccaacagttgccagtgtttttgctttttagcttaaaagcatagtgaagatgcttgaggaagactttgctacctggggtgtgtagacagacagactgagagctatcagcatttgaaggcccagcccttgactctgagacacatttgaattttttctttcccatcaaatggcattaacaagattgggcaaagatgagtccctcaaatttctgtgttttttgtttgtttgtttgtttgttttttctttgggaactgaagtcagaggcacgaacactaactcttagcatttttctgtagactttttcttctggcccttgtccctgccagcaaaacgccccttttctgatcattcgtgcgcagagggcctcccagtaatgccacgctctccatgctagagagccttctctttcctctgaggtttgaactgatgttctgtgtcttcacaccctggcatgacagttacgtgtggtcagcccgctccccaggcccgtccctgccgccgccaggtgtgggctctaggcaggccgacaaggttacacctcccagagcttgtgatcttcattttctgacagtcaaagtgtgaaggaacccagacttccccgagccacggtgttcagtcagcccacaggaatatgcaagacccatctccaaaagtttgtctttgattttttccaagcccttagccccataagctttgaatcctgtagttacagtggcataaaggactgacaaaacctggataaggaaaaaccttttttttctatgaattttttttgttttttaggggaaagggattctaagaatgtcatttaatgtactttgcatcatgtctctagaaatatctttgtccatagtggtggtggagtctctctctctctctctctttttgtttgcttctgttttctttcttgtcttcattctttcttttcttttttatttctggtagcaggcctccatagaacaaatctaaaacacaaccaccatagtaatgtaaggagagcttcagtggcacctcaaaacccacccttcgagatctgtccaaagacagtctcagaaagctgcactgcccaccggctcagctttcattcaaaaaggcttccaaggccaattctgtcttgaagtcaatgcatgtatttactgtttgacagtaaacccgctctgccttctccacgtccaaggctgtgcattcgtctaattagcgtcgtgtatgttttccttttattttttccaataaaaaagcagtgggatgaaaattgctttgatatatagcaggtaacattgaagctattccatagcacttaactgtagtgaatactgtgtcaccaattttgaaatcaatttaatgtttaatgcaaatccattacatggtgctattataggctgacaaaatgatttacacaaatgtgacaacttgggctcaattcactctgctttccaacagtgtaaatgcatagcagtgtttatctgcatgagaactatgcactaatctatctgaagaaaaaaactatatcaactttggtatctactttccgtttacttcaatccttgcctttttggtcattgttataatgccagctttaggacagaaagaattataagaaaaccagcataatacctgatatattaaaatgtagtgcctgtgaaatctgtattatattgctcttctgaagtaagatttttctacaccggtagccttcgctgtctgtcagtcaggaccttctggtataggtgatgtaaaataaccgtacaatattaatgcatgcgattccataatgcttagtgaactgtatgaatattactcaaagttatgttagtctttttttccgacttggttcttgtcagctaggtttaaaggtatttcactgagaacgcaaattctgtcttttcttgatttcggctgttttcagtattttggaggtatacatttacttaaattcagtattactcgtgttttgtttttgtttttgttttttgttttctttttcctaggggacaagcatgggtgtttgatttcagaaatcagtacctggcgagatttttgtctcaaaacgactatttgaatttcaagaactgtgctgcgaagacactctgagaacatttgcaagtcaggggcattttccttgacccttgactgatgctatgcggagactgatacattttcttaatggacaatgttcaagccaggtacccatgcttgatctgtcttcacaccagacctcctcatattaaaaggaaaaataagaaaaaaaatgtaagaaatcacatggctatttagtttcatgcacagttgcaatattttcttcaaaaataaaactctgtacaaactttgggcccgattcataagaaaaagaagtttgctattaacacgggatttttttaatatactttttttggtctaaatttgaaattacttgcttcccaaattaaataaatttcatctcatttttttccctaaaccagcacccatctgccttttattccccaaagagttacctttcccagattagggggatggtatgtggggagcagatagcggaaatgcttagaaagataagggggaccacccacagctggtcgtgagaacagggagacagtgtgtgggggtgggacctcatctgtgtgcctggtatcctgagttttacatgtagatgcattcgcctatttgattcagaaaaataaactttcccaaaatgtgtctgaaccacaagagcatacagtggaagtgctacctctaatctaaccagagcaccttcatggtggaagacacccaccaggtcatacaatgtgaacttttgtatctctgcagtggtttcaaggacaaatagtgtccaatgtattgggccatttttcctgctgtttttatactcaacttctcaaaatgaaaaaagcttttatttttcctttgacttatttgtgttgttcttattttttaaatttttattttttgataatagtctgtaagttagcctttttgggttttttttttttttttttggcttttttttttgtttgtttttttttcttttgacattgcaaccgaaggtcataaggccgctagctccgctgggacagaggcttgagagaactaacggctcggtgccttctccctggtctcagaccatcgtctctgcactgcgaaggcatttggtagcctcgccactgagatactaactagacctagactaggagctttatcaggttctaggaggtcctttaggaagactctcaaaggcaaatccctgatcccccgccccacccttagccctgccctctcaccagagcaaaattcactggggacttttcccaccacacatggaaatctgtccactcggaatacctctgttttccatttcaaattgtagggggaggggatggaacacttccagtgatggtaagagatctgttatgaaacgaaacaccccccgtgttaataacttggtctgaaatctgtttttatgagccgggccccctgtgcctctagtatacttgtattgactctcatagttacccttttagttttactgtgttctgtgaaaatttgtaattggttgagaatcactgtgggcgtccattcttattcaactaaatctccacaggttttttgagctggtgtggattagtttaactcttgtattcaaccattagtgctaccaccttctcacattacaatacaattactggaagcaagtactgcatttcctatgcaacaaaaaaggaaaaataaaaaattgctaatgctatggaagctgtgtcatcatttgctttacagcatgcctgggtgattgagtgacagtcacgggtgtggactggaggctcccacagaagatggtctttatgcaccatggggtttgtcaggcacatagcatccttggctgtgttctgatgggcagtgttacttttttcacctacttggacaaatacaggatttgacactcacatagtgtttactgtgtgcctgatattgttctgagtgctgtatagattgtatcagttggggcccaatcgggaatcaggaataagattcaatgggttttccaacaggggctgtaaagttgcctaggtattagtaactgcaggatacagccactacccctggagctggggaaaccgaagggaaaggtgggcttaccagaacctaggcactcaaggagggacaccacacagctgatatttgggtcttttctgagggaggtggtcaccacaaaggtggggacagcacatggccagtggccagacctctgagaagacatggggtgctggtgctagaatcactgcagagaatgaaggggagattagtactttctgaggaggtgaggtgtggctggtgccagagtgcccaaaggagctggaggctgcaggtgcagctgttctctgctgcggtggcattgtggacagaaactgaaaccagaaagaaatcccttcgccctcttcctcctcctcctcctaggctcctgcctgtgtctcccctgggctggacctaatggtagccgtcaggcaagggagtctggaaaaggtaatgagaaaaatatcagccccaaccccacgaagcagaatatagatgagacagcttggagacaagacgatacataaataacagcagacatatctcagtccattcaaacctcacagccaccctgggagagaggtactgcttttatccttttatagatgaggaaaccaaggcagagggagattaaataatttacccaaggccatatggtgtgtaattgacaaagggggatttgaatccaagaaatccggccccaacctccatcctataatcactgcaatatattgactctattaattatttattcaataaatacttattgagtgcctactatgtaccagagaccatgccaggggctagaaatagtaaagattgggcatctatgctgatagagtatgcattctagtggacaaacgaaacattcaaataatgtttgaacagcagcagaggtaagcatgtggttgtgacatgtgccataaatgttatacattgttgcaggaggatgccatgagctcaagagttcgagaccagcctgggtaacacagggagacccccatctctaccaaaaatttaaaaatttaaaaattggctgagcatggtggtgtgcatctgtggtcccagctacttgggaggctgaggtgggaggatggcttgaacctgggagatcgaggctgcagtgagccacgatcgtgccactgcactccagcctgagtgacagagcgagaccctgtctcaaaataaatttgtttaaaaaaggatatacattgccatgaaagcctaatgagactagtatgataggtagaaattaaccaggcaaaagagggaagaaaatattctgcgcagaaaaaccagcatgtacaaagaacctgagtcaaatggagctcggcacctgtgaggggatagaagaaggcttgtttggatgaagagagaaacggagaagaaatgcagtacgaaatgaagcttgatatttaggtgaagacattgtgggaccttgcaggcaggtttgtcctaccttctaagagctttataaaacatgtatcaatcagattagactaggtctgtgctgtcatacaaacaagtccaaaatctcagtggctcgcaacaataaaggtttaccaccgattttacatgtctatcaaaggttgcctgaggcctcttcacaggatctcattccgggacccagggtgaaaagtagctaccatctggaccactgctggatgtgtcagcaaggcacatagctggcttttaatattccaactggaattgacacacgccactccgctcacatttcactggccagaacaagtcaccaggccatgcctgggtttgacaggacctagaaggataatccttccccgcggaaggcttagagaacattactgcagcctagttaagagaggagagagaagtaggacctgagtggagagggctgccaaagaaagctactgcagcaatggaagagatgacagactcccaggctgtggtgcccatgatagaatgtaagagaagtggatagatgcgagagattaatacgggtattaatagccactgcatattgagctctttcatgtgccaagtgctataggtgatttatcccattaaattgaatatgttctctcttattgtagctctcagaaaggtatagtcagtcctcaaaacacattgctgactcaagtgaatagagcaatttcacatgtacatgccttagagtttaagttagaccaaatcagtcactaccttatttcagtcttgagtatttgggattaagaaattggaatgaaagtcagccgacaccacccctttattgacatactctatgacaagtggtgtgtaatactgggctcaaagggaaggtaatgcagtgatcaaaacgatggactcagacccagtcagcctgggttgaatcctggctctgcattttattagctctgtggtgttggcaagtgcctcagtttccccattggtaagatgggaataattataacagcaccgaactacttcatagggctgatgtagatttttgatgagttaaattttgtaaagtggttaacagtggcttggcatattgtaaatgctatgtgaatgctgtaactaactcaacaaatgattccaaaatgtagacataaggcattctttcagtgcaccattggcataaaccttcttcctcttcctgatcattttcaggcctctatttgggggaattctgaaacctttcatctaacacctgcctcaactaagtaggaggaagtagcatacaaaattagtccaggaataaagaaaatgtggtatatatccacaatggaatattattcagccataaaagaatgaaattctgccatttgcagcaacatggatgagcccaggggacattatcgttaagtgaaataagccaggcgcaaaaaggcaaatactgcatgttctcactcatgtgaaagcaaaagttgatcttgtagagagtagaacagtggtgaccagaggcaggaaaagcggtgtgtgcaggataacaagttggctaatgggtacaaaattacacttaggataaataagttatagtgttcttatagcgtagtaggatatatgtagctaacaataatatattgtacatatcaaaatagctagaagagagggttttgaatgttcccaacacaaagaaatgatcaacattggaggtgatcgatatttcaattagcctgattttatcattacacattgtatacattcattgaaagaacacatgtaccccataaatatatatgattattatgtatcaatttaaaacttaaaagaattttttgagatggaatcttactctgttgcccaggctgaagtacagtggcacagtcttggctcattgcagcctccacctcctggtttcaagcaattcttgatccttgtgcatcagcctcctgagtagctgagattacaggtgtgcgccaccatgcccagctattttttatatttttagtagagttggggttttgccatgttgcccaggctggtcttgaacttctggccccaagtgatctgcccacttcagcctcccaaagtgcccgccaggattataggcgtgaaccactgcacccagccaaaacttaaaaatgtatgtgtgtatatatatatacatatatatatacatatatatacatatatatatatatacacacacacacacacacacacatatatatatatatatatctcgcaccattgcactccagcctgggcgacagagcgacactccgtctcaaaaaaaaaaaaaaaaaaaagagtggatttccctggcagtcagaataccgttaaggaaaatacgaaccagagccaggtgaggccatctctctgggttccatccaatctagtctggtgcccgatgcttggaactgtgcttcccagcacattctcatccatgttcattgagccattcggacttctctcttgagggcggcagagattgctgcgttcattttaccagtgaggaaactgagactccgaggtgcagtaacttgcttagtgttatgtggccagtaagtggtggaagtgggactcacaatccagtcctctagtttcaagccaggctcctttccactatacaatactgccctccagggtgccagggttcttctccttggagaggcaccagagtaatagttgttatgtggttgatactgcgctgggtgttttacatgcattaatttcatttaacccttttaatgaccttataaggtagttactatccttattcccattttacatatagggaaattgaggccctatatgtaactaataaaatgacaaaccaagatatgtatagatagatgatagatagatagatagatagacagatgatagatgatagatatagatatagatatatctaaatatatatatatatttagatggagtttcactcttgttgcccaggctggagtgcaatggcgccaatggcgcaatctcggctcactgcaaactctgcctcccaggttcaagccattctccagcctcagcctccctagtagctgggattgcaggtgcccaccaccacacccaactaattttttgtatttttagtggagacagggtttcactatgttgtccagactggtctggaacacctgacctcgggcaatccacccacctcagctgggattacaggcgtgagccaccatactggctaactcaaaatatttttaagagttaatagaaatatgaaaggaaaaaaaatgaatccaggatctgagaccagacacactgggcttaagtcttggtttgtcattttattagttctgcaatattaagggcctcaatttccctatatgtaaaatgggaataaggatagtaactaccttataaggtcattaaaagggttaaatgaaattaatgcatgtaaaacacccagcgcagtatcaaccacataacaactattagtctggtgcctctccaaggagaagaaccctggcaccctggagggcagtattgtatagtggaaaggagcctggcttgaaactagaggactggattttgagtcccacttccaccacttactggccacataacactaagcaagttactgcacctcggagtctcagtttcttcaccggtaaaatgaacgcagcaatctctgcctccctcaagagagaagtccgaatggctcaatgaacatggatgagaatgtgctgagaagcacaattccaagcatcgggcaccagactagattggatggaacccagagagatggcctcacctggctctggtttgtattttccttaacggtattctgactgccagggaaatccactctttttttttttttttttttttttttgtttgtttgttttgagacggagtgtcgctctgtcgcccaggctggagtgcaatggtgcgatctcggctcactgcaagctccgcctcctgggtgcacgcccttctcctgcctcagcctcccaagtagctgggattacaggcgcccgccaccacacccagctatttttttgtatttttagtagagacagggtttcaccgtgttagccaggatggtctcgatctcctgacctcgtgatctacttgcctcggcctcccaaagtgctgggattacaggcgtgagccaccgcgcccggccgggaaatccactcttaacaggcaaggaaaggaggccaagagactggcaccagtcatcattttaaccatccacgttctgcctctttggtaaaagaacatggctaaatagtaaagatcccactggcggagaagcagggcttcccttgacttatgaggaatgaaataccttctggttcatctctgaaacacattaggccattgtaaatttgctttccatctggcacactcagtatggattttaagtctttttataggaaacctggtaaaacaaataaaaagcacatttatctctactatcacattaaattttttattatggaacaatatcatgcatgtacaaattaaagagattgatgaacaaattaatatgtacctatcgtccatcacttgtaatcaatggctcccccgtttacaccccagccacttcctgactgaccacccccaggttattttaaaacaaatatcaggtatccataaatttcatttcgtccccaaatttttagactatatctctaaaagacaagaattcttttataagacgtactcaaaataccattttatacctcaaaatagtaacaataatttcttaatatcactgaataaccagtctgttcaaaaactcctatcttataattttttaaaaatagtttgtccaaataagaaacattcactaaatggtttgtatatgccttaagtctttataactgtagggtctccttccctctctggtattttccttgtaacaatttgcttgagaaactgggtcatttgtcctgaagagtttttcacaggatttggtggattatatcaatgtggcatacacaattcagcatgttctaccataaaattggaagcatattcctgaccttggaagttgaccctatgggatgaaatcccaagactgtttcacagataaatcatgggaaggactaagggacttgcccttgggtttgtgtcctgactctctggaaactgtgggcaaataactggcccaaagggcaagctgcttcaggacagttctatgctgctgatttttgttttgttttgtattgtttcatctaacagggaaagcgaaggctaagggagggcctactgaatgacaaaggaccctgtcctttgtcagcttctactgatattaaaaacaaaaacaaacaaacaaaaaaacagacaaaaaaactatttccaccttaacagggaagatgaataattctggttgaaaactcaagattaaagtctgtctggactgggcacagtggctcacgcctgtaatcccagcactttgggaggccaagtcaggcagatgacctgaggtgacggagttgaagaccagcctgtccaacatggtgaaactccgtatctactaaaaaaaaaaaaaaaaaaaaaaattagccaggtgtggtggtgggcgcctgtaatcccagctaattgggaggctgaggctggagaatcgctcgaacccaggaggtggaggttgcagtgagtggagatcatgccattgcactctagcctgggcaacaagagggaaactccgtctcaaaaaataaaaataggccaggcacggtggctcacgtctgtagtcccagcactttgggaggccgaggcaggcagatcacctgaggtcgggagttctagaccagtctaaccaacatggagaaacccctttctctactaaaaatacaaaattagctgggcatggtggtgcatgcctataatcccagctactcaggaggctgaggcaggagaatcgcttgaacctgggaggcagaggttagagtgagccaagatcacgccattgcactccagcctgagcaacaagagagtaactccatctcaaaaaaataaataaataaaataaaaataaaaataaagtgtttctgttcatgcctccttgttcaataggcttctttcctttgagaatatgtgctcttggggaccagaagtcagttgctagccagggaagaaagaattccctggtcaggctgtgtggaagcagtggggctagattcttgaaggctctaagatcacttcatctctagctcacttgctgcttccacttccaccaccatggctctgaaccctgacatgggccaactcttttctatgaaactacaaaagctcattctgtaaagtcattcaaaacaaacacaacaaacatcattgagtagctcccatgtgccagaacttggggttagcgaaggagatgaatttgagatcatcccagaagaatggaatctagtagaggaagcagacatgcaaaccgaataatcacgccacagccttgcaaaaaccacgaagacatcatgggccaggtaatctgggaaccaatcatgcccaaggaagagagaagagggaggagcaggggctctacagggagcccctggaggctacagggaggagatacacagtctaggagttcaaggatgaggaagagttcaagagattggctggaagatactaatgacactaatagtaacaacagccacatgcactgagtgaacccttcacttcacaccgtgtgttattctaagtgcttcccacacacttgcacatataatccaacccagtggcagagacaccattgttatccctattttacagatgaggatactgaggcacagtttcagtagtgtttcttcccttcttaatagctacctgtgtatgaccttaaaatgcaaacactcagaggcttaaggggtgtagtgcctgacatgtgtaaatcacaatttgttccaaaatgaagtctggttgaccgccctcttcccaatgcccagaacagtgcttggcatataaaatacactctatactgtgaggggatgagcatcctattatcctgtgtgcccctccagatgcactctccaatcttctccaaaatcctctctgctcggaagactgacctgtgtggaccacatcagtgggcttctctgacctagagctttcaattgagatcagcagattggaagcgctgacagaatggtggattggaggagagtgatgtcagggtatttatgcagggactacagaaagttcctggagaaatggagttaaaagataaaaataatgctttcctgggggtcatgttaaaaagataaaataatttttggctgggtgcggtggctcatgcctgtaatctcagcactttgggaggccgaggcgggcagatcacttgaggtcacgagttcgagaccagcctgaccaacatggtgaaaccctgtctctactaaaaatacaaaaattagccaggcgttgtggcgggcacctataatcccaactactcgggaggctgaggcagaagaatcacttgaacccaggaggcggaggctgcaaaaaaagataaaataattgttttaaaatacaaactttgtttctcaacgtgagcttcataaatttcaagacatctttgtgagggatgatcgcagtcatttagtccatcccttgagaactgagggtcccaggaatttaaccatgtcagtgcagtctttcttacattattaacaggacaaaaatgggtgccctttaaatatttttttaagattaggaaacaaaaggaagtcagaaagagtcaaagcaggaccgtgatgtggatgcccaatgatatcccactgaaactctcacaaagtttgccccgtttgaggagaggaatgagcaggagcactgttgtgctggaaaaggcctctctggtgaagctttcctgagcatttttctgtgaacactttggttaactttctccactctcatagtaagtagatgttattgttctttgtctctccagaaagtcaataagcaaaatgccttgagcatccccaaaaaaccattgccatgacctttgctcttgactagaacagttttgctttgactagaccacttctacttctttacttttttttttttttgagagacaaggtctcattctgttccccaggccagagtacagtggcatgatcacaggtgactgaagcttctgctccctgggcttaagcaatcctcctacctcagcctcctgaatacctgggactacaagagcataccaccacacctggctaattttttctattttctgtagagatggagtcttgctatgtcgcctaggctggtctcaaacttctggacccaagtgatcctccacctcagcctcccaaagtgctgggattacaggtgtgattcacggtgcctggcacacttccacctgttggtagccattgctttgattgtgctttgtcttcaggatcatactggtaaagctgtgtcttatctcctgttgcagttcttcaaagatgtgcttcagaaccttcatcccacttgtttaaaatttccattgaaagctctgctcttgtctgcagctgatctgggcacaagggttttggcacccattgaatggaatgggtgactcaactttaatttttcactcggagaattgtgtaagctgaaccagttgagatgtctgtgaggtcggctatttttgtgctgttaatcattggtcctcctcatttagagcatgaactgggttaatttttttcctcagaaattgatgtggacagtcagccactgtgggcttcatcttcaacatcgtttctttccttcttaaaatgagttatccatttgcagcctgctgatttctttttcttagagacagggtcttgctctgtcaccctggctggagtgcagtggcacaatcccggctcactgcaacctctgcctcccgggtttagacaattctcatgtctcagccacctgagtagctgagattacaggtgtgcaccacacgcccagctaatttttgtatttttagtagagatgggcttttgccatgttggccagtctggtcttgaactcctgacctcaagtgatctgcccaccttagcctcccaaagtgctgggattacaggagtgagccaccatgcttggcctagactgctgattgttgggaggcattgttcccataagctttttgtgatgcatcaatgatctcaccattcttccatccaagcttcaccatacattgtttcttcttgctttcattttagcagaattcatgctgctctgataggggctcttttcaaatcgatgtcttatccttcttagtgcctcaaactagatcctattcagtcatgttataacaagttagtatgagtttattttggtgtaaacattttgaaaatcaagcatagttttttcctaatacacattttccatgaactttttaaagactcatcgtatttccctggctccctctggttcccctctggctggtggcattcctcaacagaaggtcacagctcctctcaagattctctggacccgaatttctccttctactttctagtaactgctctctctctcattccttcaggcgtggggtagtaaaagctctgggggtactgctctatcctttgtattctccctacatcttgtccacgcttttgtaaaaagtctctgtattaaacccctctcaaaccatcttgagctgtatgtgccatctgtttcccgctggaaccctgactgatagagagatcaagccagagcagacttccggaatcttctttctcctgaaactccagcagaggctcagatttattcacatgatagatgtcaaaaccataaattttcccatcttagtttatccttgactcagaaggctggactcaaccttcaaaggtcactgaagtccatttctctgcctccagctgggaatcccacccccacccccaccctgactgctcctgtcagagggaagtacatcttactctgaagatctccaggtaaggagataccataactcactcatgtgtcttcagtctccttgcctgataaatctccctcctgtctaacaggaaccccttgtgttacaggtgaagcctgtttcctttgtctgttccttggcaagagctgaaaaaagatccttcattctttgaaaataggcattaaatcatcctcgcccttctccggctctgaagtgcagatcaatgaaggcagacaatctgcacatgctagtctcaagcagtcaacctggacgttctaggagaaccctacactgtaactaacatttacatgaatgtgtttgaaaggtttatccgaggcagaagggaaagatggagccaaaatctctgggaaaaaaaaaaaaatggctggaatgggttcctgacagaagtgatggtgaattcttctttttcaatttacttttaacttattggagatttatcctcttcctgttatccaaaccctgaattctggagggtgccggtttgctgctattaaccagccctgacaaaggctgccactctgtgaacagaaatctgcaggcagttcctctcagctctgccttctctttctgtatttgtctgctcgggctttcataacaaaatactacagactgggtggcttcgacacagaagtgtatttattcacagttctggaaggccacaggctggaagtccaaggtcaaggtgttgtaggtttgctttcttctggggcctctctccttggcttgcagatggctgccttctctctgagtcctcacgtgaccttttttctctgcctgcaaatccctggtgtctctggtgtctttctttgtgtccaaatgtctttttataagtacaccagtggaattagcccctgccccacaacagcctcattttaacttaaccacctctttatatgtcttatctccaaataccttcagaggcactgggaattcaacatatgacgtgattcagcctattatactctccttcttctcttcagcaatctctacctaactgggcttccaatggacttgaactgagccagccatgaaccaggaacagtagtaaaacctagaatctgataaacctcatagcctacagaccattgctttaaaacaaattgtactaaaattcaaaaatgtctcccctaaatcttgatgtacacacacacattcacatgcatgcacatgtgtgtgtgagtgcatgtgcatgcacacacacaccacacacacaatcccagttgtttgttttaaagcatttacctggattattaaagtgttctctaatttcatacactttgttttattctcattcctagattagtaaactcaatcacatgggatttcagcctattcctacaaaagcatacatggctgatgtatcagccccttctcattcctacatcatttagatgtccagccctgaaacccaacagtcagcactagagagggtgctttacttgtgtcacggggtcatctcatttaatcatttaatccttccagtaggatagaaactaggagtcccattcaataaaagaagaaactataagacacagaaaaattagtcactcaaatgaaaagcgtgcaccctgagggctcacctctgagcctcaaaagctgagtaaaatgtatttacacaaagagttgctatcaactaatattactgaatacttgcaccccaaaatgctcacaattaggacttgtggacacctcacaatccttcagtgctttcagaataattaagaaaagctctgaataacgttaacaccacgggaataggctaaacttttaaagaaagttttgtcctttgggagtgagtggccagtacatgaaccatcaactgaattgttggttaccttagcaccattttcagagtgtggggggcattcagtgggtgaggggagaacatgacccctgaggacacacacccatgcctgttacactgtgtgggggaagtcctgatccttcaggagccccctacatgttcagtcagggcaaatcctcagtgattccacagagagccagggatgtgccctcagcacagcaaaaggaagtcagagattcctactcttggcccattgtccccttgagtgaattgagcctcatcatctcctgggatggaaaatacacaggatctggacttaacagtggtgtttggagctgagaggttgtattagtcagggttctccagagaaacagaatcaagaggataaatatatgtatttgtatctggaaagagataaggtatgggctcatgcaattatggaggctaagatgtcctaccatctaccgtctgcaagcagagacccaggaaagctggtggtgtagttcaacggcctgagagccagaggctgatggtggagattccagtccaagtctgagggtctgaaaaccaggagtgccagggacgagagaaaatggatgtcccggttcaagccgtcaggaagatagctaattcacccctcctctgccctcatgctattatactaccctcaacggaccctcaatggatcagatcatatccacccacgttagggagggccgtctgctttactaactttacagttcaaacgtaaactgtttctcttctggaaacacccccacagacacagccaggaatcctgtttaaccaggtacctgagcatcctgtgatccagtcaagctgacaaacatgaactatcacagaggtaatacagtagtccccccttatccatggagaatggattccaagacacccctcatcccaccgtggatgcctgagaccacggagagtaccgacccctacagacactatgttttttcctgtacagtaatgggtgggtagcatccactgtgtggatctgctggacaaagggataattcacagcctgagcagggtgatgtaggatggcttgagattctatcatgccactcagaacaagacacaatgttaaacttatgaattgtttatttctggattttttcatttgatattttcattctgtggttgaccatgagtaactaaaactgggaaaagtgaaacccgtagacaagggaggacattgctaactggttcagcagccttcaggcgtctcttctagtaaggtcactaatcccatcatgagggccttatcctcaagactccctctaaccctaattacctctaaaaggccccatcgccaaataccgttgccctgggggttaggacatcagcatatgaattggggaaggcccgaacactccaccgataacagtaacatggtttacatacaaaaatcaattatatttctatgtaatggtaatgaacaattcgaatctaatttttaaagtaccatttacaagtacaaaaacgcttaggtataaatctaataaaatatggttagtatgtatattctgaaaacccaaaacaatgatgaaagaaattaactaagacctaaaaatgtggataaatacaccatattcttggattggaagacaatattgttaagatgtcaattctctacaaattgatctgtagagtcaagttgttcataatagatatctcagggcatttttttgtagatatcaacaatctgatttcaagattaatatttttaaaaatgcactagaaaaaccaaaagatttttgaaagaaaggaacaaagttggagcactcacactatctgatttcaagtcttactataaaactacaataatcaagaaggtgcagtattggcaaaagaatacatatatagatcaatggaatagagcagagtctagaaatagatccacacaagtgtagtcaactgatttgtgaaaggggtgcaaaggcaattcaatggagaattgtcttttcaacaaatggtgctggaaaattggacatcacatgcaaaaagaagaaagaggagaacagcctctattctactttatactttgtacaaaatttaattcaaaatggaccatagaactaaatagaaaacctaaaattataaaacttctagaatcaaatatcctaaaaagtctttgtgaccctgggttgtgcttctgagatataagagcaaaagcatcaaggatgatacattggctttattaaaactaaagtatttttcttgtcaaaagacactgttaagagatggaaaagacaagtcacaggctgaaaaaaaaattttcaaaacatgtatacaacaaggaacttgtatctaggatacctaaagaaccctcaaatctgaacaataataaaaacaaacaacccaattaaaaataaacaaaagatttgaatagacactttatcaaagaagtagagtaatttttactgtttgtaaattttttagtttaaaaatttaagagatatagttaaaccataacttgaataacatgttatagttaagaatgaatgtactaccaaataagaaaggatgaaatcattgcattaagaatccaactcaaaaaaaatttttaaaccactaaattatgcccaagaaaagtagagagaaaagagaaagagaaaaaaataatgaaagaaaacataaatacacaatatagattaagaaagccatgaattgttcctttttttttttttttttttttttttttttgagacagagtctcttctgtcacccaggctggagtgcagtggtgcaatctcagcttactgcaacttgaccttccagactcaggtaatcctctggcctcagcctcccgagtggctgggactctaggtgcacaccaccacacccagctaattttttttctttttgtattatttgtagagatggggtttcaccatgttgcccaggactccaggtgcacaccaccactcccagctaattttttttttttggtattatttgtagagatggggtttcaccatgttgcccaagctggtttcaaactcttgggctcaagcgattcacaccccttcagcctcccaaagtgctgggattctagactgagccaccatgcccagccataagttggtactttaaaacaaacaataaaatggaatattccctgaggagaatgactggtcaaagagcaacttaaatgcacaaataagcaatgccagaaatgaaatagagggatgtgctatagatgtggtagcattacaaataacagttaaaaaaagcttatgaactagtcttaccgcaataaactaaaaaatattgatcaaatggacaatttttttagaagcctgacactagattaaattaaaagtctgaaccatcctattaccatgaaaaaaaaaatcaaaaacttttccacctagaaaactctaggtcctaatatcttcaacagtgacaatgaccaaacactaaagaaagaaacaatgctaatagttcataactctatagagaataagaaagaaaaacctctctattttacctggataccaaaacctgaaaaggacattacaggaaagaaaaattataggctaatctcatgcacgaacatagatgcaaaactcctaagcaaaatgttaacacgaaatccagcttggtcaggtgctgtggctcacacctgtaatcctagcactttgggaggctgaggctggtggattgcctgagctcaggagtttgtgaacaccctgggcaagatagtgaaacctcatttctactaaaatacaaaaaaattacctgggtgtggtagtgggcacctgtagttctagctccttgggaggctgaggcaagagaattgcttgagtctgggaggcagaggttgcagtgcgtgccattgcactccagcctgggcaacagagcaagactcttctcaaaaaaaaaaaaaggaaaagaaagatatccagctttatagtaaatgggcatacaacacaactaggatggttttattcccataatacaaatgtaatttagcactcaaaaatcaaagtaattcaccatattgacaggataaaggagaatgtttgcatgtgataaatcattggctttagaattttattgtgtgcacctatctatatatgtgttatatttcacacttttaaaatattaatataataaaggcatttaaggcagactaggctaccctgaaattcacatgctttttataattagacattctgaacaatgtattaggttggtgcaaaagtaattgcggtttttgccattacttttaatacaatttgtaaaacttaattgtgtggctgagcttgcaaggaagagaaatcgtgaggttctagaaagagtagaaactgagaacatagtagaagcacccgatgcggattttggagcagccaccccaggggttgggagttgcagagccaggacaagtgacaagggcttgagtgttactgcctgtgtgtgggatagtgtgtgtgggagattaagagctgaactttagacattttaagccacagatgcatgtgagacattgaagtcaagcagtgagtttgttgttaaacatctgaagtgcaaggaaaaaaaatatatatatatgtaagcttgggaatctggcccactggttgggtttaaaaactgtcttcaggggatcttgaattcctgtggcactctgtgctttcctctatggttgcactctccctatgaattttctttttgtatactgtctttctagacttaaagcagggactgtttctggatccttgttttggaggccaagaaaaacaaatgaaataaaaaaaaaaacaactccatcaacatgattattgaactcctggtgattttgtcaagcagcaggaagccaagcacggatttagtcaggtaacagacatgctggaaaagcaagtgagcctggaaaggaggacagaatgtactggaaaagggagagatgggcttccaaggagccacctcgaagctacagaggcaggagtggacattgagaacagagagcctccagagaagagcaggttggtgttcttgggtccaagaccattctcctcctttcagggtctgacatgtggttctcaggaagtatagtgtggttgaaggattggttaggaaagtccctccacgtcctaccacctccaccctggcactgtgtgcccgtggggctatgatgggaacaacccacaccctaaaataggatccaaattccttcctcttttgtcatcaaagctgcatctactttgctcaagcaagtcagggaatctctgtgtcttgagtccataaatctgctttcaaattcctccagccacctctccctgggtctgtgaaaggtcattcagagtctctcctttgagaggggagaaaccacccagcagatgaaaggaacatcactatattcaaagctcgtgtgcatgccaggtgcttgctgcaagagctgttcctgactcaccttgctttctgaatggcatttcacttctttgccaattccttggaatccctcaattgccacacctggcaaataaaaaatcaaagtaattcaccataatatgcatctgcaggtggggcagtgagtagaaggtcgggggaggaagagtgtggtgggcacaaggtttatagtccagggggtgcttgttgactgactggtcttgatcctcatagaggccaaggctctaccagaaactgaggtcctaacctgaaaggagaatcaggaagatcagtgagctacatgctgcttttaaatagcctgaatatagctggaggaggaatggttataatgtttcctaaaatgaaagaaaggtgggtgccaaataattgtacagagaatacgctgcagactatagcatgaagacaacctcagcataggggaaaaaaagaccgggaggaaattgaccaagatattgtaactgtaataggttcatcgccccatgtgcagcaagtcaatatgctgagacactgggttgcagcagagaaagaggtttcatcctggggctgctgaacaaggagatgggaggaaacctcacatgtatcattccaaggagtttggggctagggattttaaaggttttggagtgggctgaagtgtggagatcgtcgactggtcaaacggtgcagggtgaagtcatgggacagggagttgaagaaattgcattctcatgctgatttggttccaccgtgggggttttcagactggttgtcctcagctgttctgctggaattcagaatctgaaaaacaacctaagcaattcttaaaagctttatgattataacattggagagcctacctataagaacaatgaggatgcaaatggtcggtgtctagtgctacacgactttccattacaaggaactgagccaaagcacagcctgattcatgcttcattataattctattcctgtccaaaatgcttgttaaccccgtgaggactgcttcagtatcacactgtattttacaaataatctatataatgtgcatgcctatcctattttctaaataagtctcaaatgtgtatgcctatgctatgtatacactgaaaaataccaacacactttctggaaagaataatacagatttttaaaaatgttcatttttgtgggtacatagtaggtgtacatattcctggggtacctgagatgttttgatacaggcatgcaacgtgtaataatcacatcatggagaatggggtatccatctcctcaagcatttatcctttgtgttacaaacaatccaactgtcttgttttaattacttttaaatgtccagttaaattattactgactttagccccccattgtgctatcaaatactaggtcttattcattctttcattttttcggtacctattaaccatccctacttccccaccaaccccctgggttactttcttatcttgtaccctaatttggctgactgagctggccccttttaaacaacggtaacagcaacagcaactacttcttcatgaattcagtgtttacctatgttgggcatgatgttcactgagtaactactgtggaggctgctggtgacctgggtgggagctgtctcccaaaaagggggtagaagcctgactgcattgggctgttgagtgagaaggggcaaaggaatgaagcacgtgagagcaaacgtgttcaagatgtttggttgtatgggggctgtcatcgaagtggctgttaggatgttgtattagtttgctagggctgccataggaaaataccacacactaggtggcttaaacaacagaaatgtattttctcacagctctggaggctggaagtccaagatcaacgtgttggcaggtttggtttcctctgcagtctctctccatagcctgtggatggccaccttctcgctacatcttcatcaagctttcctctgtgcatccacatccttgctttctttctgtgtgcccaaattcttcctctcataaagacgtcatctaaattgaagttgggcccacctaatagacttattttaactcagtcaccttgtttaaaagaccctatcttcaaattcagtcacattctgaggtactagggtttagggatttagtatatgaactttgggaggaaggaatgggtgcaatccaacctgtaggtccagaacttttcttttcttttaatatgcaagtgccaagcatttttatatgtagtggaagagagcttagagaaagagaggtcacttaatagaggaaaagccctgaggctggggcagggatgggaaggagaacccaggggaaagggagccctgggcaggaggagggaggcatctgccgcagtaaccaagggtggaggcagtcgctttctctgcaatattgagggtgcagacacagtcggtttatctgcaatgctggggtgcaggagcagtcggtttctctgcagtgctggggctgcaggtgcagttggtttctttgcaatgctgagggtacgggcactgtcagtttctctgcagtgctaggggtgcaggcgcagcaggtttctctgcagtgctgggggtgcagactgcatttggtttctctgcagctctgggggtgcaggagcagtcggtttctctgcagtgctgggggtgtagattgcatttggtttctctgcagctctgggggtgcaggagtagttggtttctctgcagtgctgggggtgtagattgcggtttgtttctctaacatgctgggggtgcaggcacagtcggtttctctgcagtgctggggctgcaggtgcagttggtttctctgcaatgctgagggtacaggcactgtcagtttctctgcagtgctgggggtgcaggcgcagccggtttctctgcagtgctgggggtgcagattgcatttggtttctctgcagctctgggggtgcaggagcagtcggtttctctgcagtgctgagggtacaggcgctgtcagtttctctgcagtgctgggggtgtagattgcagtcggtttctctgtagctctgggggtgcaggagcagtcagtttctctgcagtgctgggggtgtagattgcagttggtttctctgcagtgttgggggtgcaggtgctgtcagtttctctgaagtgctgggggtgtagattgcagttggtttctctgcagtgttgggggtgcaggtgctgtcagtttctctgcagtgctgggggtgtagattgcagctggtttctctgcagtgctaggggtacaggtgctgtcagtttctctgcaatgctgggggtgcaagcagttgatttttctgtaacctgaaggtgggaagctggtgattcttcatgtgacagtggcaaaggatgcctgagagtataaactggaaacattttgagggcagcttgaccacatgtgtcaaaacctttaaaatgtgcatgcagttaatttatcccaaggacataattaggggtctacatgggaagctggcaataaagacggctacgcaaataaaactatagttttgtttatcatacaaaaggatagaaaacaacttcagtatccaaaaaatggatgcctggcgatgtggtttggaagtttgttcccttcaaatctcattttgaagtgtgatcctcagtattggagatggggcctggtgggaggtgtttgggtcacggagggcacacccttcatgaattagcttggtaccctccccatggtaacaagtgagttctctctctgttagttcatatgacagctggttgttcaaaggaggctgactcctcctctcttgctccctctctcgtcatatgatatgctggatcctcctttgccttctaccataattggaagctccctgaggccctcaccagaagcagatgctggcactgtggttcacatacagcctgcagaatcatgaaccaaataaacctcttttctatataaattatccagcatcgggtattcctgtatagcaacacaaggactaatatacctgattaagcaaactattacatgttttagaatgtcacatgcacaagtcaatagggcgccaagagtatttacagccatcagttacagaagtatgtttatgaagatggaatggtggtgcaggatagccttatataaggaaatgcggagcagacaattacacgacaattatacaaagaataatcgtgacttaaaaaaatagacaatggattaaaaaatagacaatggataaagtaaaaataaagacagcccgtgtgtgggaggcaaaggttaactatggtgatctctgggtggtgaaattaagggagccaattatcttctttttgcttacctatatagtttctagtttttgccatggtgaacacattatttaagcaagatgggaaaaaagcaataaaaacaactttttaaatgcaccacctggatttcttttcagggctattttccataaagaaacccattttttatgacctaagagttgttgtgtaaatgatgctggcacgtggaaaataataaaggagatatgaatatgctccctgcagattgagatggcagagaggtgccatgctccctcccctggggcctaggacagcatttagcacacagtaggcccccagtaaatgattcaggaagaaatgattgagtgagatactattggcaaggagggtaactgaatgtccctgtaagtgaaaaaatcactggctcacagcagcctctatatgaggtgtaaaatcatgcattagtaaataacaaattatcatgggctatgaatccctgatgtggctcgagagttgtcaaaatctagaatgttctttctatacaggtttgcacctatgagaaatgtgaatttcaacctctgttcactgctcaaactactgataaacctaaactctggcactggttagatgcaagcatttgctttccagaaagcctttgaaaccaaaagttttcattaccatgatatcattaccacgatatcctgaaggcattacatagatgtcatgaagcaacaaccttttaaagtcatggtatggactggcccagccatgtaatctagtcctaaaatgtagatgtttctgatgctgtgaagaggaagacaatgggataatattattacatcagaggatgagtctaatgtctttcatctgccagagagaagactagagatatttattggttcagtatttcaacaacatggtattaattgtctttgagtgttttcataggtagttagcgcaagggtattaatgaaaacagccccacttcatttaaaaattaactacttggccattgagcaacaggagctgataaatcatggcaataaatttgtgatggagatttatgccctcgtgactcagagccaggccatgggcatatttagatgggctggagagataaggaataccaagtgtgggcactggaaaccatctggagttcttcagggatagaatacagtttagtagtagagagaatacagtctgcctggtcatcactaatgtagcacttatccaaaagacttatccaaaacatcttttcttccaaaaaagttgctaagctctttagccatcacctttttctggcatgtcataggttggtgaagacctggcctcccaggcccaggggcaggccccaggccatcctgctggacctgtggagactaagcccatttctacctgatgggtggggaaagagcccgcattcacctgctcatcagaagagcagctcctcccaggccagctgacacggctgatatttcctcagagctcctcttttgctaatgcaatggaaaagtctacccagatgggtgcagcaaagagggaaggaaatatttcttgcacagttgttgtcaggctctgggctaggtgcctaatttacataatttcatttaatctccacaacaatcttgaaaggtagctcttattaaccaactattaactccatttcagagagcaggaagctgacactcataaaattgaagtggcttgccctaggcccatgtacggtgtctgcattggacgccatattgcagggagaatgtgagttttgaaatcacagaaaccagcatttgagtcccaggtacgctactcactagctgggcagttttgaaaaacatttaacctttctatgcccacagtttttttcatttgtcaacaaaaggtgatagattaacatagtcatcacaggatacacgggtaggttagactaaataacaacatgaaagtcttaaataaaaaggagctgggattccaggccacgtttttcagactccaaagttcttataactaaaccataaaaactcatgaccctggagagacacagaggccaagacagaatgccaaatccagagctgaggaggacctaacgggacccactggggtgcagtgtagggcttggacttgcaggggagcgcaaagagagcagagttatccatgctgaacaaaggttgcagcaaggtcagcagccaggccgacttgaagatcagctaatgatatacttcctatatgaaaatcataaaaaagagaatgtgggaagtaagattgacttctgagatctcaattatatacagcagcagctcggctttttttttttttttttttttttagactgggcctcactctgtcacccaggcgggactgcagtgtcacaatcatggctcactgcaacctctacctcccccaggctccagcaatcctcctgcctcagcctctccagtagctgggactataggctcgcatcactatgcccggctatcagcttaaatctgagcaagcccaaaggtctaaccgattaatatatgtcagaaacttaatggtctgggagaggagggacctctgggagaaagatagggggataatacagtaaaagttgctggacaatggacaccccaaacggtttcccagggggcaaggactggtggggggccatgagaaggttcatttctgggccttggaattaactgagggctatcagctctagggaagctactgacagtagggtttgggcactggaagccatctggggttctgcagagatagaatacgatttagtagtagagaacatggtctgcctgggcgtcactaatgtagcacccaccaatgcaaatagccaggattcaggaaaaccaaagggaactggaagctgaggttacagagctgatgaagacattagtcctgtcctcaggaaggctgtggggaagacagtaaacaggcatttctgacacaaggtggtcacatgttgacaaaacaagctcagggtcctagaccagccctgaggagaggcacctaagtcaccaaagggtggtgaggaaaggttcctggaagagagaacactggaagcaagacacagaagacagtggtagctgatcaggacaagagaggatgtccctgacatggtcctgcttacaatcatgttcaattcagtaccacaacccaaaagatgaactatattcatgatttggctcccactgacccccagtctcatttctcttcactctgccccacacttcgggctacagcaacatcaactgctggtggttgcctccatgtccatgctgctggtgaatttttgattatatgactctcatctgctgaaatactccaccaccccttgggctaactgccatttttattttattttatttttttgagacagagtctcactctgtcatccaggctagagtgcagtggtgcaatctcggctcactgcaacctccgtctcccgagttcaagcgattctcctgcctcggcctcctgagtagctgggactacaggtgtggaccaccatgcccagctaattatttgtatttttttttagtagagacagggtttcaccatgttggacagggtggtctagaactcctgacctcaagtgatttgcctgcctcaacctcccaaagtgctgggattgcaggtgtgagctaccatttccggctgctaaattctatttattctttaggagccttttaggaatccttctctgcctcctgtatctggtgttagatgctcttccctgaaacccctgcacacctctcaatcactgtccttgccaccttgcactagacttaacgatgtgtccattttcctcactagacagtgcactagttgatgtcaggaattatgtattcctttttacagtcacagttgccagcatttagccactgcttcataaatcattttgcaaaggccagttaaggaaagatagacagacaaatttaaatgaagtactcttttctccttagggttaccagataaacacaggacacccagttacactggagtttaaattgaaatttgaatttcaaataaacaaagaatacttttttcagtataagtgtgtcccaaacagcgcatggaacatacttgtactaagcagaaatgtgtctcaaatgttgcgtgggacacacaccaaaagattgttacttatctgaaatgcaaattgaactgggcatcctgtatttttatttgctaaatctgtcagccctaaatattgaaaagcataaagcgtgtgggcaagagcagtctcattctgctgatggaaaatgctcaatctggtaagaaatttggcaaaatattttccaatatgatcagataattgctcagagataagagagttaattccagtatttaccatggcccaaagttagaaaacacctaaatatatacccttaagagattggttaaatgaaatagaattttatgtgccatgtaacactgagattaaagcacaagatctgaaggcaaaatgcttaggtgctatttctcaactaaaaataaaacaaaacaaaaatgctttggtgcaaatcttggctgcacatgacactggctatgagactctgaggaaggttacctaattttttttatgcctcagttcccacctgtgtaaaataggaatatacacatttttaccctataaggtttgggaagattaaataagttatccatgtatagcccttaaaaaaagggcctggcagaaagtaatgtttaaataaagacggttattgttattatcattacccctatgtagaatactgtggtttcattaaaaatgactttatagatttatatttattgatggaaaaaggtgttctcattatacagtgagggaaaacaatcaatcaaagcatcatatacacagcatccatgtagcaaatcattctgagcaccatctctgtcaggtcctctcttagaagtcaccaacagcaaacatagccagaacacagcagaaaacctggagggtcatgagcagacacatatatatgtgtgtgtgtgtgtatatatacatatatatatatatgaggaaatatatacaaattaaaaggcaattaacattctgataagagctataaaggaaaataaataaagtgtaataggaaaggcctcaaaagacagagctatttttcctgaaacccgaagcatgagcggagttagccaggccagagctggaagaatattctaagcagagtaaatggtgtctatcaaagccatgagaagggagatatctgggcaagtttaaggaactgaaacaaggccaacgtggttggatcccggtggatgagtgggagagtggagcaagatgaaagtggacaaataagtaaggggttgatcatgttcagctttgtaagatatcaaaagtcaaattaaggagagtagtgtatttgggtctttaccctaaggtcctttgagacaatctcatcatctgtcatctttgctttacttgcttaggatttagaattctggactgaaagatctcagtggctgaattaaagccacatgtccccaagggtgaaacagggaggattcccccttcagcttccacgtttgccattgaagagctgtggtgtggccctgggaccctcctcgccactgaattcagggagcccatgtcatcccacctcccatcagtatctctagcctccagatagcagtttctggtgttaccctcatcaaggtatttctcaatactttggcaaagggtatgtcctctaagctttcctcggagacatagtcagggagtgatagggttagttgcacatgataaattcactccagcattcctatctctcagagtctttggattctttcctttactcggtatcaaggaatttatgacatctcaactctgtttaatattggccaccactgagtccagatttctgtcaaccaactgaacaaacaacggtgtctactcccagctgctctgagctagcaacagaatctggagtctctactaagtgcatcattaccagggacttcaacttggtctgaaattatgttcgtttccccttggtcaagaacgtacagaattcattcccacacatattcctcggttttgaaggtgtaaattagcaaggtcttgcaaatcatttgttatacatgccttctgctcccggtttgactttttactccccgcctcccccacaggtattctaggtcagatcctgtagacaagggagagatgctgcagtgcagagaaaggacagactccttctttccatgtaactcttttgggtaagagagttacagtgtcttttgagcaaaaaataaagagagccaacagtccaaggaggagagttgctttggctggcacagaaagattggtgatttctctaggtcttctcatatacccccattccacatcttttttatttattttttatttatttttatttatttttttgggatggagtttcgctcttgttgcccagactggagtgtaatggcgccatctctgctcaccacaacctccgcctcccgggttcaagcaattctcctgcctcagcctccggagtggctgggattacaggcatgcgccaccacgcctgggtaattttgtatttttagtagagacagggtttctccattttggtcaggctggtctcgaactcccgacctcaggtgatctgcccgcctcggcctcctaaagtgctgggattacaagcatgtgccaccacacttggccttccacatcttactctatcagtaccttaactttctccaaagaggcatgacaaagctgtgcattcaactgatgtaattctaccaatctcacagtccaaatttgaatttgttttctactctctcagcagtgtggcttttagaggttggaaattcatttagcactgccatagaaagttcttgggtgtggatgtttgccttaaattgagaatctggggatttaaatttgtcattctcttttcataagctacccagggccattcgaagcagccattcttccacagtccttaactcctgtcttttacgctgacccaggacaatacttacatgctgtcctaaaagcttccttgattttcatgagcacttcctccaaatgaccacaggtgatactttagatgttctgctgctgtggacatgagcttccatattcctgtctctgaatcctaaaagaatgatcatgtcctaactcctcactgaggcaatcggatcaactccagatttctatcatacaggccttctgacttgaagagcccggagcatatgcctcggcacaaatttctgcatcaataagctgcaaggaacagaaactgattctgactcaagtatattaatacaaaagagggattcattggaaggtattaggtagctcacaggtttgcagaattaagaaccaagcaaagcaaggcagcaggaaaaattcaccaggatgtaaccatagccagtcacaagcatagccatcacggcagaccactgtcccggtcgctgccaggctggtctcatcatcccttcactcactcaaaagtcaaacttccgggtagaagcattcaataagtgacaatcggtcacatgtcctcactctagcagaggagggggcagtggagagacagaaagagttcccctaaggaatcccagagagaggttgggtttgggaaaggcaaaaagtaatgtgagactgcgttctgttttgtggtgtgacatagaaccagatgttggtacaggggtcgggaaccgaccttggtcattattaatctctattgtctcactgagatgttgccacttccatgtgatgagcccatgcaggtcaccatggaatctgcctcctcccgcccacgggagcaaggagccacatcccatctctttttccgtaccgcaccccgccaactcttggctaccggaaagcctgagggccgctgcagcactgttttcctagatgggccacatgaccctttctactctggccttcttttttttttttttttttttttttgagacagggtctccctgcatcgcccaggttggagtgccgtggtgcgatcttggctcactgcaacctgcgcctcccgggctcaagcaactctcctgcctcagcctgggattacagctgagactacaggcgcacgccgccgccatgcccggctaatttttttgtatttttggtggagatggagtttggccatgtagcctaggctggaactctggcctatttcctcttttcacagactctcttcagataaaaggagagggctcctgacatccacaaacctgtctggaatttctgctgttccttctatttttttatttgtttgtttgagacacagagtcttgctctgttgccaggctgcagctcactgcacaacacagctcactgcagcctcgacctcctgggctcaagctcagcctccggtagagctgagatgtaggcatgcaccaccacacagactaatattttgatttttattgaaacaggatcacactttgttgtccaggctagtcttgaactcctgagctcaagcgatccttccacctcagcctcccaaaatgctgggattaggggcatgaaccaccgcagggccttctgttccctcttatcctggggttgacctaaagtggggcaggaggcaggtacctttctaggtacctcactgtgtctgagccttccttgcttctctcctgactctctcaccttccccatctgcagaatctttttgtagttactgctgttgttttgttctgaaggcaagggaggctggctttacatctatatttctaaatctattgcttatgccctgacaggcttttgaaacccagaagccataaaattgaccctttgttttctgcattcttcttggcactccctcttctaaggcagaaacagaacatgcatgctgttcatcaaatcagaggaagatttattacaggataacaggaaataccatgaagaaaaaaaattgatataaatataaacaatattatcctgcaacattactgtttttatgtgtacttaaattttattattaattaaatcagatgacagtgtcatttaaaagacaaagttactttatgaggtagtcagagctccgtaaatggaggtgttcaaacagagcaggatggccatctattaagggtgcagtaaaaggaacttctccattggtgctcccagcaatgagttgatgtttaacgtctattctaaacctaatattttacgcttttttttattatattttttctttgctccacaggttttggcatcaaaatgggaatattttgaggtccctagtaattataaaaatttaaaatggcctccctggtttctaacaaatcagtcaacatttttaataggacttgttctgaatacccaagattggccatttctaattccattggttctatttgttttgtaacaactctttctgttacaatggcttgattgttcttttctatttcttgtggcctttgccccatgaatcttctatggagtgaatgtttccttatttttcttagaagaagaggaagaagcattgctcttacccaagtttggagaaatcatctttaaaaacacaaaagccaccttggacttgaagtcaaggaacatgtatgtcagctctagacatggtttttgtagttgtggtaacctgagaagttattctgtctctgagcttcaggttttttaatatgcaacgagaagatagttcctattgtatcaacacaatcaaaattaagtaaaaatgatgagtccaggtgtgaattgatcctgaggtcatagtgtcatggccccatctccatttctctgccattctctgtattccatccttccctgtgggtcaactccacacttccccacttcttccccctcccctggctgcctccttttgtggtaaaaacaacagcaattttcaggcctctcttccacatagtccacacttcaaaggaagaagactgatctcttccagtagttgccatagataaaagagaaaacctctttcctggaagttccagcaactgtccccttacacctcatcagccaaaacaagtcacatggccatcctgacaaattcttgagctgaacaaatggaaaccaactagagctttctctggagataaggtagaggctgtcccatcctaagagtggagtcccctctgaatgaagatctagatgctatttctgggagaaggagatgcagagatggagaaatggaggctggggaggcattcaccaaggggcccatattcttatacagctcactaggctaatataaaaatcacagaagattgtgaaaatgacaatgacctatacctgtaaaatactggacactgacatgcaaagtggcatcagaagactagtttgatttctggtcctatcactttgaacaatttacagaactctgagccttggtttccccatctataaaatggagatgtcagctaacaacggaacgtgcttacatatatgtacttattataaattgcttttagcttaatccatgctagaattgagtcagctcttataaagatagtttgagctggtaaatttggaggtcttgtctgcaacttgagaaaaccacccctaatcacatcaataagttctgagtaaccatgccactgagatcttagatggaaggaatgctttgtgaaccaaattttttgtaacatatagaaaatcaagttcatctgttcataagtcatcatgccctgaacccttaatctccatatctctgatgcagaaagattaatcttagaaggaataactgacaacccactgcctcaggctacaaagaaaatgaaaatgtcctctataaatgtgattcatattacaaactcgtgcacgttttgtgctatccagccttgttcaaataaaaggaacttagtcaacgattctgttggagggtaagcttttttttctttttttcttattgtatcactttcagaattgctagaagataaaaagaggcctgtttcttgctaacacaatcttatctatgaggcaagcattcctagggagtagtgcggctcagttggattttgtcagcttgttctgtgaccaaattcagactcaattatttacttaacttccctaagctttagtattctcataggaaagttggggtgataacagtacccacctcattgtaagaaataaatgagataatgtatgttaaatgcacaaaagggagcctaacacgcgtaatacatgttagccattactgtatttggatttctgagaaaagagggaacctatattggaagagtactaggttaggttgatgcatattctggctttagaccttttcctatcataacatgtatgtcccaacatagcagagacctggaacagagtacagataggaatctctggctcacggccaacccccttcttttccaacccttaaccaagtcctgcaccatgatgggtcttgggcacatgcttagacatcccaacctatacagtccaagctctacctataaacccttcccctccaaaggcaaagactaccctttgcaattggaagcatatacatatgtggcaaagtctgccattgccactggaagatggacaggagaagaactccacagggcatgaaaggaagctggggccatttgagcaggaatttcagggtgcttgggcccaatagcatggcctataaaggagagggagagacctgggtagtcacatccccttggctccagggacacctcagcctgtggggagagtatagcaatagcagagccaaagaaagggccctctaaagtagaggacccaggacaggagccccagttgcctggatttaattaagagtggtactgatttcatctcttgaaacttgtcctttagaaaatgagtgcctaaggctatatttttttttaaaaaattaagttttattgatatataattagcataccacacaattcaccaagttaaagtgtacaatccaatggtttccagtatattcacagagttgtgcaaccagcaccaggctcaattatagcccagtgggaggatgagaaggggacactggaactgggtcttcctcagggcttctctctccttcatgtcctcttataaagtatgtcagtgcactgagtttcattctaatatttaaagatataaatttggccggacgcagtggctcatgcctgtaatcccagcactttgggagacggaggcgggtggatcacttgaagtcaggagttcgaaatcagcctggccaacatggtgaaaccccatctctactaaaaatacaaaaattagccagggttaggggtggtgcatgcctgtaatcccagctactaggaggctgaagcatgagaattgcttgaacccaggaggcaaaggttgcagtgagccgagatcatgccactacactacacagcctaggtgacagagcaagactctgtctcaaaaaaaaataaataaataaataaaaataaagatataagtttctggtacacctccaatgggcaactcaatatcttcttagagttccatgaagaaatagtgatcttttcccaaactaaagaaaaaacttagcctccaaaatatatcttcccaagggattttcaagggaaaatgtggatatacgaactttcactttattcaccgaggtcagaacctaatctccaagaaatatacaagtgtacttgacacagaagcacagacagagcgtttcgctctgtcccgacttctgcaggccctgtctgaccgtgactcagagtcaggtcgatcagtcatctgcagctgtgatctcctcagttcttttaatagtgcattttatcagtaaaaacaacaacaaactggcatctccataattacacacagctatccttcgctatctaaaaatatcagttcctgagttgagatggtacatttggatagtgaagagtatcagtttatccaaatctatttggttctgacatcaagcggtcagaatttggattgccaagaattcatcctaaaatatatctgaattagttcagttcttgagtttgggtaggatagctatttatttaaaattatatttgtgtactcctgtactaaaatattatgggcattaaaaaatcagaaaaatcatcattttaaatggagaaaataaaaataaatgccatagacgttctcatgatgatgttagttttttggagtgtgtgtccctgctttggagagcgttcaggtggtctgagaatcaggagtgaccaagggtcatggggcagactgcagataaaacagcccaatttatctcactgattctcagaacagttctcttctctcatatatattcacagctattagcatgtctaatgcttgggatgactgcatgttcttcatgtagcctcattttatcactttataagttttgatggtattagcaaatttgtaatagcttctctcttctctgcttcacagtagatcaaacattagcacgttaaatgggcagtttatgatttctccttaaaatagaatcctaattgtgtttaaaactaccttctccctgggtagttttttcaatagtaattgccaaaatgctgaaaggtttctgtctctcaagaagtaacaatctaaatctggcctcttgtggcctcattctgaatttcaaataagcatctggccttttctgacccagggagagtcagtcaggactgtacctatgaactacagttgctggtgcagttgagacttgcaatttaatttaatcaatatttctgaagactttccatctacaagattcagtagtctgagactgagtatccggtttacgttagtattgggttagtgaaagtgttatttatgtgcagagtggcttaatatatagaaaccaggtcttcagataacattcaaatttttcatttcatctttgtatctggttgtcatgaagagaaaattggcttgtctattatagtggtcttcaaacactttttagtagcatgagatctctctaagattgtacttggaaccattatgtatgaaagagaagattgatctcaagtctacaggtgcaggaaccccaggttccagctacttggccttcccttctccaggacttccatttcccttctttgtagaaaaaaaggaaggagctgggagaaaatattgaagcacatgatctaaaatctcagttctaaaagaaacagtatgaatgtgtcactttgagcaggtcattcaacccctctgtgcctctgctttttatttatttttttgagacagagtctcactcttgttgcctggttctcaagggatggactaaatcactgctatcatccctcacaagacatcacaaagatgtcttgaaattgatggagttcatattgaaaaacaaagtctgtattttaaaaaaattattttatctttttttttcttttttggagatggagtcttgctctgttgcccaggctggagtgcagtggcacaattttggcttactgcaacctccgcctcccaggttcaagtgattctcctgcctcagcctcccaagtagttgggattacaggcacctgccaccacgcctggctaatttttgtatttttagtagagatggggttttgccacattggccaggctggtcttgaactcctaacctcagtgattctcccacctcggactcccaaagtgctaggattacaggtgtgtgccaccgcacccggccaatgtttgcttattttaaagataccaatggtatctgcttcccagagtgattataagcctcaaatgaaaattttggctccaggttttacttaattactctgcatcaatcaggcccaggtttcctcctgggcaagaagagggcagccatgacaattgttcttagcctaagctaaggcacacaggtgagaaagagtttccacctgaatcttctttatgcagcaacatcaataggtaaaacagtaaacctggatgtgcagctgcaaggtttgttatctaactgacttcttcctgacagtgagagaaaccacaggtcctcagtcctccagatgctctccataagttcttaatgactagtctgctttctcgtaaatgtattaataacttactttgtttctaataactaaatattgtgtctttcccttctcccacaagagttcccctccaacttctgcttctgatcagtactgacccattcaatgaaaatgattgtgaatatgctttgaaatgctcacgaactgtgcacattagttactgtgtttcatacatgtttccagaaattctacatatcacaccttctgacattcatttatcatcagcttcaaccactattatttttcctttgtaactaacctacacctcatctattcctccacagccctggaagcctaaattcaagacagacctatagctggtggctctgcaagtaaactgagctctgtcctttccccaccagccagttatattttctcagaatggagccaaaattctacactagatatgctgctgcctggtaatcttttcattaacaggccatccgccaattggaatcatcaattactgttggcacagagaattcacagtccttttccaacaatgagggtggtgggcataccaggcctggattcatttcagccgcatgtcccctttttcctctccgtctccactggggggtttcagaatctgcattgttttgtgaagaggagaatggtcaaggtcctggctagtgttgtttctgtggaggtagaacctgtgaacaggaagtgtagccagctggtggctcaagctatgggtctcctttcaatctggggaccctcaggctctgcagctgaaggagagacagctggaaggtgggggcgaagggaggcaaatgtggcaagcagctcattgcccaggcctgacacttcagcccctacaacatcagaggtgtttgccaacaaccccaccttctctggaaagggtgagttattgactgtgaaggaaacacaaataatggacgttattttcgtgcaaagacaacatgagacagggttctcttttaggtagtgagtcttatcaacaatggcttccctaagtccttccaaagtgtctatccattagggccaaaggaggtgctttgattctctctcagaggagagagcagtttaataaatcagcaagtggatggagcatctaaattcaataattgtgaagtgcagataaatcactgctgtcaatgctgactttagactttattcactcaaaatggttaaattcaaacagcaatatgcctacccagcatctggacacgcacagctcatggcccccagccaccaggctagaatgtctccccagagttgggcctcattcctggcggtctgttgggaagtgaagacaaaggaaggaggttgaattacagcctgagagatgacccattctagtggcagagagattgtggaagctcaaagtgaataattcattgtgctgtttggctgtgcattaggtttgatccctggagctgctgatgcaaaggagatcaagctctggcatcttaccccagctgcacaactgggctttccaacacgttatttgttgttgatttgctcaccagcaacatgagggcgtgaacaatggtacatgatcaaagctagaagtttaatagactccagttgagccaagactggtagggtgtttccacttactcctctagatttttcctcgtagaatatgtggtatatctactctctccatttaaactctaagtttcatgtgaaatgcaaggaagtgcagcccttatatttataaacatgtcaacttgcaaatggttggataggtatttgaattattgattgttaaatatttaagctgaattcctcatccatcagttctcatgagaagccgggggacagatttacgatgctggagtttttctggttagttggcagttggcatctctatcaattatagctcacacggtaagttccgcagcgttcattgcaggcactcagaatcagtgtctattcttcctttcagagagagtttgtgcaacaagagcttctgaaaggaaaagaaaaagtaacatgccgtctctgaattattgctgccactttctgaggttttggtgggtctgattgtgtctctggctataacgtagttgaaagatcaagatttttagaggcagatagatctggatttcagttccagctccctcacttccttaatcctgtgaacctgaacaattttcttcatacctctgaatctcaatttctttatctaaaaaataaagtctcatgattctgtttcattagtgaaatttaaacaaagactcttgctcacactcattctcacttcttctgcctcctaaacagcccaggtgcttccctgtatggcccttcctggtgtggccctgtgtggcttggcataccctttcctcttgtgaaccatgagtaacaaactatcttcttttttgttttttgagacggagtctcactctgtcacccaggctggagtgcagtggtacgatctcggcttactgcaacctctgcctcccgggttcaagcaattctcctgcctcagcctcccgagtagctgggactacaggtgtgcaccaccacgcccagctaatttttgtatttttagtagagacggggtttcaacatgttggccaggatggtctcaatctcttaacctcatgatctaccctcctcggcctcccagagtgctgagattacaggcgtgagccaccatgcccagcccaaactatcttttcaatgacaattatctcctgctgtctctttttttctttttttgagatagagtctctctctgtcgcccaggctggagtgcagtggtacgatctcggctcactgcaacctctgcctcccgggttcaagcaattctcctgcctcagcctcctgagtagctgggactacagacacacaccaccacactcagccaatttttgtatttttagtagaaatgaagtttcgccatgttggccaggctggtctcaaacttctggcctcaagtgatccggtcgcctcagcctcccaaaatgctgggattacaggcgtgagccaccatgcccggcctcctgattttatggtctcatcacacctgaataataataaaatctacatttaaaaacatctatatatatatatatatatatatatatatacacacacacacatatgtatgtgtgtatgtataacgtttatgtgtgtatatatatgtgtatgcattaatgcttatgtgtatatatgcgtatgtatatatatatgtgtatttgtgtatcaggtaccatgtattgacagcttgctatgtgccagacacaattctaatgattacatatattaacttgtttaattctcacaacaaccctttgaggtatgtacgacttattagccctattttatagctcagaaaattaaggcaccaaaagtttaaggaaactctctgagttcacacagctgttaagtggtggaattgggttttgaagccctaaactttctgcaattaaggaaatatgctatatgtgctatctaaatggtaggcattagccacatgtggccaatgagtacctgaaatgggattgaggaactgaatttttaattttatacaaatttaattaatttaattttgaatacccacatgcggccagtggcaactgtactggacagagcaggtctagaccctgtacctctaacccttacaagacaggaaaattgaataaacatttgtctgcagaacttctcagagcctttgtctgtcaatgggtattgtgaaactcagagaggaaatagaacatacccaagggatacaatcttttctgcttctctagagatggcagatgacctctgtccccatgtgggaatgtctgggggactgacacccccagccagagctggtgcctgcccatgcaatgtgatagtgactgcctggtccccagatactttcctgaaatgtccaccatggaaatcagtcctctggcatagaaacaaaaccatttcatctcaaacatatgcaggtggtaagagattcaacttatttcatgaacacattgttattttaatacagaattgattaaatcatttaaattaatcaagttgcatattttacaaattataaatttgcaccttaacttatatcaatgttactcaaagtgtgatcccttctagcagcagcagcactgatgggaatctagtgagaacaaaattatcagcccattccagacctaatgaatcaagtcctggggatgtggcccagcaatctgtgttttaacaagtcctctgggtgactcattcaagtctgagatcaccttacgtaaatggtctaatttaatctatagagctggggaaagggagtcccagggaatttaaatgacatgctcaaagctactgagcagaaaaattacggaactggaacatgaacccagttctcaaccagcggcttcatatctgcctggaggtcttccagatttcctggggacagccctagctgctgactggccctcttctctatgcttaccccagtctcagagtggggtggtggctgtggggcaagagagccagccacatgctccccttgcatttctctttcctactcccaccctctccatctcacctcctgtcacgatacacaggtcaacaaatatacagtaagcatccttttccatctttccctcagccttcctcctaagacttttatacattcctagtctctcatgtgggaaagtagaaatttaataggcatggtgggggaaggggaaggaaatggggttccataattgggaaatgctggattaaacaaaattaagtaggtttctttattacaggtcttttcagagcttttacgatgtaaatatgtgacactccaaaaaggaggatatagcatgcagcattcaacaattcagatgaccacagaaccttcttatttggagaacattttgtgagatgagcattctgtagaggacaggttcttttcccatggaaagcagagcatgagccctaagtgtataggacataggacaggcagatcttgcgtgtcatgataaaggatagagaaattccagaatgcagaattcccattgcaccagtcattgccacttctagtatatctttgagtctagccctatcagagatcttcctaaggtcaagtttactgagtgaagaaaggtaatggtagggaaatattactacttggagggtgctatagtctgaatatgtcttgcaaaattcatatgttgaaacttaattgccaatgtgatagtattaagacgtagagtctttagcaggtgattaagtcatgagggccgagccatcatggatggaattaacatcttataaaagaggtggaagggagcaccctaaaccttttttgcccttcaaggtgccatattgaaagcagagtccaggccctcaccaggcaccaaacctgccagtacattgatcttagacttctcagcctctggaactctaagaaataaatttctattatttataaattacctaggctgtagtatattgttacaacagcatgaatgtactaaggtagggggtgagacgtaacagcaagtggcccacaatagtgctaggactaagtaccggaggccctactgggccagctgtgaaccccttagttgctggatcatggggagggagagtgaggagtctcagaatagagtgcaagagagctgagtcacagtattctgaggattcagggtaagagcagtctgccaactatagaattatttcattctttgacaactgagatagtgattctggtacatgccagctaaatattagccctgaattcaggagcaggctttaaaacatcagtgttccatcatagactatgtcatcctaattatatatattatgtccccaaaagccatacacacacacacacacacacacacacacacacacacacacacacatatatatacacacatatatatatatatttatacatgttatgtcccccaaagctatctatataaaacagtgttagtatctctcaaattgttgttaaagacaagctttcttttaatttaggtatctggtggctctacttgatggactcaaaaaccacattttttgttgttttttgttttttgtttttttgagtggtcacacagctcaggcagaggctcctggcttgcatggttgcccataataggacgaagaatatttaaattaagctttaaaagccttggtgcttgtttcagttcggctatttactagttgtgtggccttaggaaggttatataccttctctgaacctcttttttctcatttggaaaatgatgatagtcataatatacatgaaagcggctgatataatgcattgtacataacatgctttcaataaatgttgcaagaactaaaaaaataattactaagaactggaaaagccaactaactaattagctaactaaaaacccacatgcatacatacataccagctcattctgggccacaggcttcatttgagaagtagacagttggtttggatttgtatgtggggaagaatctgagattaactgcctccccattctgcatctttggcttcagttaaggaaaagcagatgtgtggacaggaaaggaggtaccaatttgaatgacaaaactgggctgaaagaatgcatacatcacataaaacagacacacagaccaatggaacagaatcaagagcccagaaataaacctatgcatatatggtcaactaatatttgacgaaggcgccaagaatacacatggggaatggatagtctcttcgataaatggtgttgggaaaactggatattcacaggcaaaagaatgaaattggatccctatcatacaccactcacaaaaattaattgaaatggattaaagacttaaatgtaagacctgaaactgcaaaactcctagaagtaaacatagggaaaaacttcttgacattggtcttggcaatgattttttggatatgacaccaaaacacacaaacaacaaaagcaaaaacagacaagaaggactacatcaaactaaaagccttctgtacatccaaggaaacaatcgacaaaatgaaaaggcaacctatggaatgggagaaaatatttgcaaaccatatatctgataaggagttaatagctaaaatatataaggaactcatacaactcaacagcaaacaaataaacaaacaaataatccaattttaaaatgacaagacacctaaatagacatctttccaatgaagactacagggagtgtatgttaagggcaacttgaatctatgtgccagagggcattattacacttttatttttatttttaaaaagacatacaaatggccatcaggtacacaaaaaggctctcaccatcactagtcatcagggaaatgcaaatcaaaaccacagtgaaatatcacctcccacatgttaggatggctattataaaaaagataaggccaggtgcggtggttcacacctgtaatcccagcagtttgggaggccaaggtgggtggatcacctgaggtcaggagttcaagaccagcctggccaacatggtaaaaccccgtctctactaataatacaaaaattagctgggcatggtggcgggcacctgtaatccggctactccgaaggctgaggcaggagaatcgcttgaacctgggaggcagaggatcacaccactgcactccagcctgggcaacaagagcaaaactctgtttaaaaaaaaaaaaaaaaaaaaaaagagagagagagataagggttgatgaggagatgaagaaaaataaaccctgtgcactgctggtgggaatgtaaattggtggagccattataaaacagtagagaggttcctcagaaacataaaaatagaacagccatatgattcagcaatcccacttctgggtttgtttccgtaggaaagaaaatcagtacctcaaagagatatctgcactctgatgttaattgcagcattattcataatagccaaaaccacctaagtatctaagtatctgtcaatggatgaatggatatctgtctatctatctatacatacacacacacacacaatatatataacagtatttattacatattatatataattatatatatatacacatatatatatatatagtccagccataagaaaagaagaaaatcctgccatttgggacaatatgaatgaaacttgacggcattatgctaagtgaaataagtcagaagagaaagacaaacactgtatgatctcacttaagaagacagtgtggcgattcctcaaagatctaaagacagaaataccatttgactcagcaatcccattactgagtgtatatccaaaggaatataaatcattctactggaaagatacatgcacatgtatgttcagtgcagcactattcacaatagtgaagacatggaatcaactcacatgcccatcaatgatagactggataaagaaaatgtggtacatatacaccatggaatactatgcagccataaaaaggaatgagaacatgtcctttccagggacatggatgaaactggaagccgtttatcctcagcaaactaacacaggaacagaaaaccaaacaccacatgttctcacttataactaggagctgaatgatgagaacatgtggacacatgaaggggaacaacacacactggggcctgtcagtgcagggggagggagagcatcaggaagaatagctagctaatggatgctgggcttaataccaaagtgatggatggtttgatctgtgcagtaaaccaccatggcacacgtttatctatgtaacaaatctgtgcatcctgcacatataccttggaacttaaaattaaaaaaaaaaaaaaagttgaactcattgaaacagagagtagaatggtggttggggagaatagaatggtggtttctcccgtaggagctggggaaagtgaagagatgatcaaaggtacaaactttcagttataaaatggatgagttctggggatctcctgtatagcctggtgactgtaatttacactgtattgtatacttgaaatttgctaaaagagtaaatattaaatgttctcattacacacacatacacaaaaggtaactatatgaggtgatgggtgtgttaactaacttgattgtggtaatcatttcactgtatatatatatatatatatatatatatatatatatatatatatatatatcaaataatcacagtgcacacgttaaatttatacaattctgtttgccaagccatacctcaagaaagctgtgggtgggggaagcatccataaaacctgcccacagagctgccagaatggagaggtggaggaggtcaccacctctttcctgggaaagaaatgagttttgtttcctcaccttctgtgaactgcagttgtggtgtttagcctatggctcactgagcatcaaaaagagctgcatcaacatcattactgcttttctgtcctcacctgatggtgtttcacaccttatcagagatgctggagatagcttagtgacccctgtacactaagaaggtgacaatctgggtgtatgacagctttaagctttgctttatggaagcctggctggccttctggccctttccaggttcttgaactaactgatcaggaaggatcttcatttgtacaatcccttcattcctcaggtaggaaaaccagagaagatgtgctccttatttaaagtcacacagtatattagtagcatgtatcagttagatttgctaagtaacaagctgccccaaagcttagcagcttaaagcaacaaatgtatacttagctcattgttctatggatcaggattttgggctgtgctcacctggtcttgactgaactcactcatgcatgtgcagtcagctgcagagtcagctaggtgctagcctgtggtggtctcagttaagatggctcacctctgctttatgaggtctttcatcttccagcagattagcccaagcctattcacatggcaccttggcaggatgccccatgagagggcgggtgctcttaagacctcttagtcctagcttcaaaagtggcacaacatcgcttccacggcattctactgttcaaagccagtgacaaggccagcacagattcaagagatagggaaatagcctccatctcatgatgagaggagctttaaagacaagtgcaaaagggcagcacacaaagacagaaataatggaagcttttttgcaaactctgtcccaaagtatatccaggaattctccccaaggctcttgattttgaggtataatggagatctattgttttgcccacctagcatccatctcctcttccttggagacttacacttagaatttactttaagtccagttttgggagaacttttgatgaaaaagctccacctatcctgttgcatgtccattaacaggtggacatgcaacccaggttagacccatccagatgctctttgcctggaatttgaacactgacccagcagagtggcagcatgacttcagacgagatgctccatctgttcctgctgcctttgctcctcagtgcggcccagccacttcccttgtgaggtctgaccatttggctgtgcttcagttctgtgaactgcctgctgcagtggacgctgtgtgcaccacccagatcccactcaggacggaggcaattattcctgcagctgctggaagggttgattgctgagagccacagacacgtctcaccccaagaattgcccttctctcaagagtgctacctttccctggggatggcctcccttgggacaactctgaagggccatccctggccgatcaggtgaggcttttgttgtacctgagtcacagttcaacttctccttctgcccagttctgcttccctcactccctcatgagttttgttgccaagaacagcctccagtagatatcccgcagaaaaatctccatctgagaaactgtttcctgaggttctcaccttaagataccccatatccctttcataaattcatttcttacctgggtgagtcagtcagtttctgtggcttacaaccaaaaactgttaaaaagctatgttcttccagccttcttttcactatatcattttctaattcttgcccactatttacttaacatgtactatttgaccactcaaaataacccttccatgttggtactgttagcctcgtttgataggtgagataacttaaatcaaggaccttaaatgaattgcccaaggtgataagcaaagtagctaagaaaattaactttggagactaccaccaccactccctacttatgtcaccttggacaacttaacctatatatgccttggttttctcctctgtaaaatggggataataataatagcacctatctcatagggttgctatgaggatgaaatgaattaatacacataaggtgtttagaacagtgtctgccaaacataagttctacatcagtgtttgctatgattattgttgctgatgtaagtattagtagtaatggtattaatattgagctttctgattctagagcttatgcttgctgtgtctgcaatattcctcaagtgtaaatcctctttctgctatttccacagcccatcttgctcccagaatgccagatcttgagtagagaaccatgtatctctaatgaaaggaacagttctgctgacaaggcccctctttgcttgccttcccatttttctttgtttcaggtttgaaatatggtcttccccccactcactggtttgctgtaagtaattgtcttcttggagcaacctgaaaggtgctcctgtttggggcatcctagcctgttggggatgtaatttgttaaagtatattttaaatacaatagactcccagggtgaatgtgcctgctatgctacccaaggagctggtttaattatttgaatcattcccccaggccattcttaatctcaggcctgcctctgttaactgcacatcttgtgatgggacacaacatgaatatcaaaatcaataaattacacgttttcaaggatggaggccaaacaacagcaacctagttactgggcatgaaagccagcttcctcttagaaaccataatcccaaaacaataagtctgggcagtgggacatattcttgttatggggcacatgctgttctgacattaaaagaatgcagattggtcttaaaacctgggaccttgtaattacaagggatgaatggttcttagtgaacacagaagcattcccagggcttaaccgacttctgtttggaaatcacgatgccagggtgaatgtgagcaactaacattgactgagcactcctcaaaaaagggaagagaatgcagtccttgctgtcctgccaagaagggaagtgagggggacacacaggaaagcatctttccaggagagccaaggagcaaaggaaggaacaacaggaaaggcatctgaagccagcttgagggcaagtcagggcttccctgagctgaaaatgctcaagatgagggtgaggagaagacaggcaggtgcagaaggagagaggccgtgcaggcagaggccaaagctctcttgatggcaccaacacatgaacggctttgggaactacaagcatctcttaaatccatttcccatccctcactccccaggagcaaaggctctcatcattgttgttgttgtttttgcatctcctcaattccccacccccagcccctgtagccaccattctactctctactttaatgaattgcacttttttagattcctcatatgagtgagatcatggagtgtttgtctctcggcctgacttatttcacttagcgtaatatccttgatgttcatctatgttgttgcaaatgacagaatttccttcttttttgaagctggagagtattccactgtatacatagaccacaatttctttattcatttatctgatgatggacacttagtttgattccatatcttggctattgtgaatactgctgcataaacacagaagtgcagatacctcttcaacatactgagttcatatcctttggatatgtatgcagtagtgggatagctggatctgtgacagttctaattttaattttttgagaaacctccgtgctgttttctataatggctgtactgatttacatttccaccagcactgtacaggagttcccttttctctatgtcctcgccaacactttttatcttttgcccttttgatagtagccacactaacaggtgtaagttaatgtcttattgtggttttaatttgtagttctctaatgattagaaatcttgagcattttttcttatacctgttggccatttgtatgtcttcttttgagaaatgtctattcagatcctttggccatatttaaatcagattatttgttttcttactattgagttgagttccttatatattttgaatattagctccctattagcatggtactggcataaaaatagacacataggccaatgcaacagaatagaaagccaagaaataaatctgcacatttacgattacttgatttttgacaaaggtgccaaaaacacacaatagagaaagagctctcttcaataaatagtgtgagacgactgaatatccacatgcagaaaaatgaaattagacctttatctcacatcttatacaaacatcgactctacatggattaaagatttaaatgtaagacccaaaactataaaactactagaagaaaacataagagaaaagcttcatgcatgaccttagtctgaacaatgatttttgggtataagccaaaaatcacagacaacaaatgcaaaaatagacaaacggtattacagcaaactaaaaagcttctgcacagacaaggaacaatcaatagggtaaagagacaaactacagaatgggagaaaatatatgcacaccatacaggctctcctcatttctcaccaagaatactgcagtggccttcttgttggtactgctgtctcctgaccttccctaacctttcccaccacggccaccatcttcacaaatacgtctttcactgaataatctcattctcactctccttctcaaaactcttccaaggtgcctcaccatcaggataaaatctcatcatcgatttagcatgtgagacagtgcctgatgtgagctaatcctggtatcccccagggaccctcatccccaacctccactatcttgtgctctggtaacacaaaactaaaatctgagtgtcatctgagtattaggcacagtgctgaatgctttcactttatatattatgtcatttaatcctcatagcaaccagatgggacagagcaacttatcctcattttacagatgggtccaaaagttaagccaacgtgatcctaagacccatgttatttctagggctgtagtttggattaaatttgtttatgtccagatatttaaactaatgattaagaaaccctggagaaataaagctacatgttagttacatacaagaaagatacacattaaaataataattcacttactgaagtcacattaaagacatagaaatgacacccaaccccatactctagctcataaccacctgtctgacctaatttcctaacagcccctctcctgctcactgtgattcagccacacaggcctcggctcttctcggaatggtccaagtctgcttcagttgcaggatctttgtgttagctattctctatctgaaagtgcatgtgcaacaagctttttcatggttcattttctcacatcactgagatctttgcataaattttacctcctcagagataactttgctgaccacatttcctaagacaccaccatcatgttctgtttttctctttcctgttatccttattcatacccttaccatgaccttacaagattagttatttatttgttatctgtcttccttacttcacagggttccacaatggtagggtctgtatttctagaacctagaacagtatctaacatgtaataaacacacaattaatattcatggaagagaaaaatggctcccaaactcccgaacatctttgacgatgacctgactgagagtattagagtagctagaatgcatggggtcacacagaagtggcttgggtaattagtgaagaaggggagaacagtagacatgtggagaaaaaacagtaaacatgtgttggtggcattcattcaacaatgcacagtaaagagaaaggcctgttagggtcacacaagtccacgtcctttgaggggagtgccatacattatggagatgagttgcatgaagtagacactcagtaaatgcttaaaattatgagtgaatctcggaattttatggttacctcagcctacctccacctggttctactcaggttctgagagctaaggtgggtcagtgactttgtaagttggaagggatttaatatacagttatccctcggtgtccatgagggattggttccaggacccccgcaattatcaaaatctgcagatattcaagtctctggcataaaatggtgtcgtatttgcatctaacctacacacaacctcctgtgtactttaagtcatctctagatgacttataagtaataaagagcagggaacccaacccctaggccgcagaccagtaccagtctgtggcctgttaggaactgggccacacagcaggacatgagtggcgggtgagcaagcgttaccacctgagctccacctcctatcagatcagcatgggcattagattctcacaggagtgtgaacactattgtgaacagtgcgtgtgggatctaggttgcctgctccttatgagaatctaactaatgcctggtgatctgactgaggtcttccatgaaactggtccctggtgccaaaaaagttggagactgctgatctggagtatgtaaatagttgttatactgcattggttttttagttatattatttttatcattatattgttatttttttctgaatatttttgatccacaatgcggaatctgtgataagaagggccctctgtacattttttcaatcctgtgattagagtggcaacaggaatagtctgatttctggttcctttattaggcagaaactttcctgtaattctgaagtttggctcagactcagcctgtggagactgggaaactgaggactaagtgtggattccaaaggccttctctgtcggagtggttagtgtttggcaagcttgatggagattcttcactatgggaaccacctgatttctcaggacggcttgaaatagctggatgaccagaagctcagtctacagcagtgtttttcaacctaccagttgcaaccctcggtggtttatgaaataaacatgatgagtcacatccagctttttaaaataaaatagagtagacaaactctaactggtttagaggagaaaaacatcatttcctcactcatcttaggttcaggactgaagcacctacaacaaaagacagattaacaaaagaagagcatacaaattatttaagttttacaagacacgagagacttcctaagaatacgaagacccgaagaagcagtttaaacctgagtatttttacgccagatttgatgaggaatggacagttgtggagaaacatataggacaaagagggtatgacctaatggtaataaagtgagggaaacttagcaaggcccgattgttcagattcttctctgtgacccttcgtattcagatatcaggatctctttcctccagtggtatagggagggcacttgtcacaagagggtgttatgacctgtgttgggggaaggtcagaaaatcctttctggcttcagggaagaagggcgagaagggtggaaggtcagaaggatctctctgcttctgctgtttcttaacatgctgaggtggcatattttggggtagtgtgtcctaaaccccatcgctggcagcctagaatcaaatatttcaaaaatgaaggcaaactcaagacatttttagacagcagatgcacactgaagaaaatactaaagatattcaggcagaaggaaaattatgccacacagaagcctggagatacggaaaggaaagagcaacagaaaagataaaccttagagaaacttaaattattattggctgcataaaacacaacagtaatgtgttttgttgtataacacacctcgagaattaaaatacatgacaacaaagcacaaaagttgggagggtaataaatggagtcaagatgttctaaggttcttatatttcttggattgagtatatacataatgacatataacatatgacacgtaccattatattacattattacagtggtcatattagattttaaagtcaagtatgcataatgtaatctccaggataaacactaaaagaataggaaaagaataaagtaattaaaaaattaacccaaagaagaaaagaaggatagaagaaaagcaacataaaaaaggtgaaacagagctgggcatggtggcacctgcctgtagtcccagctactggggaggctgaggctggaggatctcttgagcccaggagtttggggctgtcactgctctgatcggcacctatgaatagccactgtgagacctcatctctaaaataaaaataaaaaataaagaaagaaaaagtaaaggcagaacacatttttgaaatagcataatagtaggtttcaacccacataaatcaataattacattatatttcaataaaataaagtttccaattaaaatacaaagactaaataaatcaaaccaaattccaattaaaagacaaggaataagtaaaacaaacaaaatactgcatggtgtttacaagcaatacaatgtaaatgtaagaatatagaagggttgaaaagggttgaaaataaaagtatataaaaagaaatacgatacaaacctaaccaaaacaaacagggtagctatattgttatcagacaaaatatatttcaaggcaagaagcattgttggggatgaagagtgatatttcacaatgataaaaaggtcattctgccaggaatatataacaattcaagttttttttttctaataaaatgctttcagtatacagtcatctaccttctgctctactgatttaccagttctgggcatttcatataaatacaatatgtggccttttgtgtctgactttctttcacttaatgttttcaatgttcatccatggtgtagcatggaagcatgtatcagtacttcattcctttatatgagtaagtcatattccattgtaaggatataccacatttaatatattcattcatcagttgataaacatttgggttaatttctatttggggctttatgaataatgctgctttgagtatttgtttacaggtttttgtgtagataaatgttttcagttatcttgggtatattgctaggagtgaaattgctgggtcacatggtaactctgtttaacttttgaggaattgctaaattgttttgtaaattggttgcatgttattttgcattcctaccagcaaggcataaggctaccagtttctctgcactcttgcctgaacatgctattgtctagtttttttgtttttatttttgcaattatagtcatcctagtcagtgtgaagtggtgtctcattgcggttttgttttcatttccctaatgactaataatgttgagcatcttttcatgtgcttcttggccatttgtatatcttctttagaaaaatttctattcaaatcttttgcccatttttaatagctttattgagatatgatttgcataacatataatttacccatttacagtgtaaaattcaatggtctttgctgtatttgaatattagtttttcaaattgtggtaaaatcataagatctgccattttaaccaatttttaagggtacaattcagtagtattaattacatttacacacttgtgcaaccatcaccactatttccaaaacttttatcactccatacaaaaactctgtaaccactaaacagtaactttaaatcccccttccccgcctctccagcccctggtaacctctaatcttctttctgtgtctatgaatttgcctattctagatattttatgtatgtgaattacacaatatttgttcttctgtgtctggcttacttcacttggcataaagtttttaaggttcattcatgttttagcatgcatccgaacttcatttccttttgaaactgaatatttcatttgtataccacattttgtttactcatttatctgttaatggacacttggattgtttccacctcttggctatattgaataatgctgcaatgaagattggcatacaagtatctgttacagttcctactttcaattcctttggttgtatacctaggagtgaaagtgctggatcatatggtaattctatgtttagctttttgaagaaccaccagacttttccacaacagcttcaccattttatactcctaccatcaatgtacaaggtctccaatttccccacatgcttgacaacacttggtatttttggttattgttgttgttttaactctagccgtgctagtaggtataaagtgatatctcattgtagttttcatttgcatttccctaatgactaatgaggttgagaatcttttcatgtgctgttggccacttctatatcttctcaggagaaatgtctagtcaaatactttgcccattttaaaaactggattatttgtctattattgacttgtaagagttctttatacattttgagtaccagttccttatttgatatatgattttcaatttcacttttgtgataatgtcctttgaagcacaaaagtctttcattttgattaatctatttaaaattatttaattttgattttagctatttttactgttatcatttgtacttttattgtcacatctaagaaactgttgcctaatctaaggtcatagaactttacttccttttccttctaacagtgttttagtttcagcttctacatttaggctataaagcatgttgagttaatttttgtatgtggtgtgaggtaggagagtttaacttcattcttttgctgtggatatccagttgtacaaacatttgttgaaaagactacctttccccagtgaattgtcttgactctcttgctgaaaatcaatgaaccataaaagtaagaatttttatgtctggacttttaattctattccattgatctatatgcctttccctttgccaatatcacactgtcttagttactatagttttgtagtaagttttgaaattgaaaaatgtgagtcctccaacttcatacttctttttcaagactgttttgtctatttgaagtcctttcttttccatgtgaattttagagtcagcatgttaatttctgtggggaaaagccatctgagattttcataggaattatgttgaatttgtagtttattttgggaagtattgctattttaacaatattaagttttgcaatacatgacaatgggatatcttttcacttatttaggtcttgttagtttatttcaattatgttttctagtttttagtttacaagtcctatagttcttttgttaagtttattccataatgagagatttaaacacactttctcagcacctgatggaatagacacaccaaaaataaaatcagaaaatatataaataatatgttatatgattgaaaaaactaatctaataaatacgtatggaacatgataatcaacaatgacagaatatatgtatttttcaattgtacttggaaattttacagtgagttttactatacagtaatataagtcctcaaactttgttcttcttcaaaaattcttaagctaattttatcatttgtatttttgtataaatattagaatcaccttgtcaattacctaaaaactacctgggattctaaatggggttgcactgaatcactggtttatgctggggaggactgacatttatatcatgttcctgtgttgaaagaatcctctcaacccaggaacacgatatatcccctaatttatttagatcttctttgagtcctctaaataatgttttatggtatagtggtgttgcacttctttctttatgtttattgctattataaatggtaatgtttacaaatattattttccaatttgttgttgctggtgtataaaaagacttctgatatttgcatattgaccttgtatctaaagaatagctaaattaatttcttaattatgtttatcttagattcttttggactttctatatttacaatcaggttgcctgtgaatgacagtttccttcttttacagtctttatccttgtatgtccttgtttcattgcagtttctaggacttctggtatgatgttgaataaaattcttgatagcatgcattttattcccattttcaggaggaagcttttaatatttcaccaataagtacgatatctctcttaagatattttgttttgtttttaagaggccttttatcttattaaggatgttcttattcttaatttgctaagtatttttgttcatttgttatcataaatgggtatagaattttaaaaacatttttactggaataaacccaacttggtcttgcaatatttcatatgggaattttgcatctgtgttcatgggcgagagatactaaataagacattaaatccagagtgctacgggctgatgactataaatggacttgatactataggaggacatatgctaggggtactgaacctactgtctgaaagtgagagaaggcgtcacataagaagagtactctctaagttaaagggttagtaagagcaagccagttgatgatgacatgggtaggggatatagcacattccaagcaaggtgaagaacctgttcaaattaaaggtaggagagagctatttgtattccaggaattgaaaaccattcagtgtatctgcaatacgtggcccagagagtaagaagaggcctgcatatggaggacagaaggccccattaagatctatttgggtggctttttcatttcttgctcacttacactaacagatattgagattgtgaccaatactgaattaatattagtatagcaattttccactcctgctctacatagcccaggcattctgtagagatgtccagcgactaggttaggatggaaggtgggggcagaacaagaccctctccttcatcatctattttacagccaccacttcaaccagaacattttcgtacttatctgatttagaaaatgaatttctgtataagatttcatctgaggaaaggtttctgctgctatctatctacctatctgattatatattatatataaatacatatacgtgtgtgtgtatatatatatatatgtttgagttcaatagttcccaagaaatgaactattctctccgtaaactcaaaaatctgctcctaggtaagcacccaacctctgtcctccaaaggtaagcaagggtgggggtcttcttggtagaatgtggccagatgttttcaacatgctgcaatgaaaatttgcttgaatgttcccacagctgaactgcaaaaactacagaagggaaggtaagaggaaggagagaaaggggaaaagacgaatgtgagcacgagcatttgcagggaccttggaaaatacattttctgaaaatacaaggtccctgcaaaagctcaaatggaaggcttcttaagaggacttttggaaataaaacaagcttcatgtcacttgtgcctttattttaggggccaaaatggtaagcaaaactgagtatttctcttcccaccctctatgtcatcacactccaccccctagccctgactattgcgaaaggataatttgaatttggcagaaaatgcaaaaacagttcattttcctaagactttgaaaaacaacaattaaaaccatctcaaacaccttgaacattaattaattcttttccagttaagctaatagccttgtgaaggcaataagctcatcttgttaatatacactggaacatttactcattatctctccttatctacctgtcttatctatctttatttggacttttacaaaatagttactgaattgtgtgcaccagtaaatgcattaactcagtgcaatttcatggagatttatgcacctgcaatgtcgaatatattaagtttccataaaagcttggcattttgggtatgttctttccgaagaccctatggggtacattttcaatgtggagaatgataagcaggaaccaaaatcaatgggcttaaattattaaaattctaggcagtcgttacagattgggtcaagtattataaaacttacagttcatcaatttactttcaatattaattttagctttgtgccttgccatgaaaaccatgagaatggaaagcatgtaacatctcacttacagctgacacagaagggaagtgactctgaaatatagaccctctcagcctctggggaagatttatgtggcgaggatcactctccttagagtgagactgcaggtgagtggcaggtctgcattataaatgcctggggtaactataaaaacataaatggtatcaggttattgattttttttttctttctggagctcacaaattagaaaagtcactgctaaaaatcactggtctatccacaaattttaattaaagcataaataagtcattttagttgctgcacttgcatataaacaaagggggagatggcatccttacaaatgcttgtcaacatttggtgactaatggctcacagtgaaaatacaatctgaagcaattgaattgaaagcagattctggagctaactaatatcacatgcaaaccatctaaagctattatggcaagaggcattgaaaccacagatcaggtttttctggggagtgggggatgaggataattttgttaggtagagcaatactattttttttattaaataaagtgaatccctgtaatgagatattacagctgctgtactttcaccacatgatggaggaatggataccccactcctacagcaaacagtaaccacatgctgcagtgattcaaaatgttgactttattcctaaataaatacatagcaaggactaatataaataggtctttagaaaataggggtttagggggatgttctgagcagtcctagatcccattacatcaaaaaaaaaaaaaagagagagagagaaattgagatagtgagtattaaaggaattctcgggggatttccattcttggcatggactcaggaagccaggacatgacctccgtgttgtgttccagctttggggtaagcatgtggaacactcctctacaggtatagtgggagaactcccctatttctccttcaaaattagggtgatgcagaagtaatgggacactaggcttggctgttgccacagagagggggctatgactgagtgacctatggtcagcatgtcttagtacaaggttctgcactcaagaggaagatgggccttccgtgagtgtctatgcagtcagaatggaggctcagagagagcagaaagcatgctgtccattgtaactccttatttgtcaaatgttagtaaaagaaaggatcaattcttttcccattcattcattcagtgaataggcattcattatatactttctatatgctatgcataatgttagctatttgagaatacaaaaatcataatacatagtctccgcccttcagaaggagtcacaagttatacaacaaaatattcaacacaacgtagtattttaatagcagcatcctaaggatactaaggagagcccagaggaaggcaaggtttaatgtcgaatgaaaagaggcagggccagggaaagcttcacaaagatgatgctgtttacatggaatcttgtcatatgaatgtgcatttgtcaagtaaaaagataaaatttccaaacaactggaatttgaccttttctatgctgaaccttgtctacttaccaattgttaaaggaaggaaaattttatttaaaataaaaaaagttatagtaaagacatagagaacaaatcctgaatccagactacctaactttaaatcctagctctaccacttcctggctgtggaaatgtaggcaagttacttaacttgtctgtgcttccaattcctaatcttaaaaatgtgtgtcataatagtatatacctcactaccgttgtaagagagaaagaggagagagaggaaagaaagagaatgtgtatgatattgtacatgcttagtgtgagagttctgtaagagaaggaggtggcatttgtgactaagtggagtgttcagatttagaagtaagtggcattggcagttgagattgtgagcaccctgagattagggactctgtttttctgtttacacctattctcagtgcctaacatggcaacgggcacataatcaacgctcaataaacgtttgccatcaggcaagtataataatttaataattattatacttgcgtgtgtgtgtgaatgtacatgtgaatgtatgtcatgtgtctatatatgaatgtatgtgtgtgtggttacagtgcttgttgtatgctagtcactgtactaagatatttacaagtattaactcattcaattcctacagtgatagtaaggtatgcactattaggactcctgttttataagattaggaatttgaggcacagagaagttaagtaacttgcctaagtttccagatccaggaagtggtagggctaggatttaaaactagatagtctggcttcagggtttgttctgtatgcctttgctatagtgttttatctgtctttttcctttgttttctgcctttattggtagcatcaccacttagccagtggtccaaacccaaaacctggaaatcatccctgattcctttctctcccatctccaaatctcatcaccaagcatttcccattttatctctaaaagtgacatcaagtctacctcttctccatcctgatactgagtcacggagttcaaactgactgccatggcccctgaaccagcctccaatttagctcgtcatgtgcccagttccctgaaggaacttttcaaagtggaatctggccatggcccactcactttaacctcttaagtgaatcctcactgtgtacagtgtacacagcatggaattcaaggtccaaatgaatcaagcctccttacatcaagtgacgctgaacatctccagcctcatctcaaaccactccctgactcacattttatcccccttcaatatggagctacttttgtcctccacatgctcctctccttcccctaccctctgggactccacccctctgggaaggtttcctacctgccccctctggccagcgcccctctattctattccctgtaccttcctgtgcgtgactcttacactgtacccttcccattgatcattgtgggtaatgactaatgatctgtgtgtgtgtctcttaccctgctgcacagtgagcctagcacagctgcctggcatagagaaggagcattagaaatatttgtgggaagaatgcagtacttcatcaactttaacatgacttttttgagaggtgcactgttattttatataccactaaggaaaaagaaatgctgccaattaaacttatactacatattcttatcacatctattatatgacacatcccaattgcagagatgttaaaatgggaaagacaggcttttagaatccctgaaatatgacaactaaaattgtctttatgactttatcagaatagtgcagtgattaagtcacaggctttggagatcaaaatcctgtctctatcatttactgggtgtgtgaacctgcgcatattacataccctctctgtgcctcatttataaaatgaggataataacagtgctttgagggtagtaattcctgctttgtccagccataccattcctgaattttggacgttgaatgctgaagccattgcctttctagaatggtctattatgtatcttgatagacatatgcttgtctgccctttggagagccaaccctcaccccctttcagttgtcttgctcaattcatgtgattctgatggggtgttgacaccagcttccttccaaagcaagtgaggggactgaggaagggggaaagggaagggcaggcagtcacagccagcaggcctgaccagccagagcgcactatgctacttggccgcagcaactggttcaaggcaaaaagtaacactagagttcaggtgctggttaaagaagtgaatgtacagaaagccattgaacagtacctaacatatggtatgcacagaatagctattcactagtatcatcattattactgtggtgaatgaactatgttgtaatgaagcctgaagtaactacagaagtctgtaagccagatgccatattcaaaatgcacccacggattttctgtaacaactagaaacttgctagaatgtgagctttatgagggcagagatctgatttgttcactatatcccaggcacctagaatacaggctggtatatggtagatattttttaaaaattgtcaactgaatgaatcctagtttttctgttaacttcctcactgtctagatataagatgtcattttgcctggctttcaatgcgtcttcctctaactgtacttcaactctccttctctctccctctctttcttccttctttcacttccagtctgctgctagctgaaaaataaaaatagccatatgtatcagaattgtctttcggcctaagtaatgcatcccccatccctgtccatcctctccttgggtacaacctcatgccatagagaacccaggtgtttctcactgagcttatcaccacgtttgaattgatagtcttgcaacttcagagacacctgctacatcggttttcctctatgttctgttcctggtgacttgacatcgatagcaattagccctcagagacattctaaaggaggtctgggcatttggatggtcctatttttctttggcctttctcctgatttgcttccattcccatcacccattcctggtgattgcaggcttcaaactgagatgattgatgccatctcagcctaagggacctcaggattatctccctctccctcatcacaaaaaaacacgacttatggggagaaggcatttccagccatgtaggcccattccaggcctggcactctcgctaaaaaggtaacacctggggctcatcctcactccctgagatcatgaggagaatggaaatggcccattgcttacagggtgtgaagcccagaagaccccaggacagaggccaagggcaaaatcccaataaaacctccatccaaagggattggcaagagagtggcaggcagcagggtacaaagcactggaatagaaaacctagacaccagaataaccaagtttgattggtgggcacaaactgaaactagaatcattcataatagtaacaaccctcatttttgagtatgtcttaagggttttacctacgttgtctcaaataatctttacaacgtactgtggcagaaccaggttcaaagccaagtctgcctgatgccattgcctgtactcttgaccattcttctcctggacctccaagttctgaggttctggagtgcaaagcatgagcctcttggcaaggtgtctgcagctttacctgcagcattaagagcaactggaagtccagcagtaagaatggtcttcaggccaaagatatattactcacaattagcacctacccagtgcccagcactgagtgcctccccgtgagttccgggcttaatcacgctgcgtcttctgtcacccacagtttggatggaggataaatctggtgcccatttgtttgcggccaccttttttttttttttttgagacaagatttcactctgttgcccaggctggagtgcagtggcacaatctcgactcactgtagcctctacctccgcctcctgagtagctggaactacaggtgcacaccaccacacccagctaatttttttatttgtagaaacggggttttgctatgtcacccaggctggtctcaaactcctgagttcatgatctgcctgccttggcctcccaaagtgctgggattacagggataagccactgtgcccagactgtttgtggccttctacaggtcatatcagccttctggcctacctgtgcaggaggtcagtaccaaataacaccaagaacaatgaccaaaaatacagtggtcaagagtgctggccttgcagtcaaacagcctggatttgattcctggcttggcctcttccctgatcctcattttcctctcctgtaaaaatggaggaattaataatagtatctacttcatgagtttgttgtgtagaatgcaattagagtagctcgtggaatatcgtagatgcccatacacgttagctactgttattacacaagttgaatatcccttatctgaaatgcttgggaccagaagtgttttgaattttggattttttcacattttggaatatttgcatatctgtaatgagatgtcttggggataggacccaagtctaaacacaaaattcattgatgtttcatacacaccatatacacataacgtgatggcaatttcatataatattttaaataattttgtgcatgaaacagttttgactgcattttgactgtgacccatcacacgaggtcaggtgtggaattttccacctgtggcttcatttcggtgctcaaaaatttcagagtttggagcatgttgaatttcagatgttcagattagagatgctcaacctgtactgagcatatgaaccaggaacagcgccaaacactttgcatgaattttctcatttaagcatctcaactctatgaaataagcactatcatttgcccccatttttataaatgagcaaaagaacggagaagtgtaataatttacccaaggttacacagccaggaaatggtggagatgggggttgagttcaagccaacaggctccaggctgcgtactgagaaccactacacttaactcttcccagcataaagccaggcttcagccacgtgctcacttcatgcaaccttccgcacaaataataaatcacattgtcctcttagcatctgccctaattattagcagcctcacctgcttcatctctcagacctgacatttagctcatgcacatatgaccttgggcccttgacagccccttcttcagacacactaggtgacaaccctccaggtccagcatcctatgcctctgtgggatgttcctacaggcagaccctggaactcttgttgctctcctgagtgccactgtttttgtgctgctaaggtcctattatgctgtgtatagcaaattccattatatgattacatggtaaaagctgtgctacctgatacatcacagcatcatggggcactaactagtcaaaaattttagtgaactaggagttctaaaatctctgcttcctagatttaagaagcaggacacaagtaacattcctgatacgatacttccttgatatgttagtttttgtgttgctgtggatatatgaagttttgcagggcaaaaagaaaaagttacgtttgttctttttagcaggaaaaaggaagagactttgaggtcaaagggaaggaggtgaacagagatgggaaaaggcgttgcaggtcaacaagtcccaggctgttggacagtgatccagaaagagagtgagagctcagaggtgagccgctgtgtgggagctcctggagatacaagatacaaggagtggggattcccattcccccaggatgccagccagagcacctggacccagtgagacctctgggacagtggacatctcagtagtgaccagaaggtctctggccctgcaaaagcatttaggaacttgtccacaaactggaacttgtccacaaattgtccaagactgagacaattcctcctgacatgaaagggatgggaactcacaatttgatttaagttgattcacaaaaataacaagatgtcatattcctcacttccttagtctgtggattaagattcatatctgctactcatttgactgcctactacgtgttaggcaatgcagtagggttttcaaacatgttttatcatgtaaacttcaaaacaacactcctatggatttgaaccagattttacctgactccaaagtctgtgagtatctctaaaataaggagaattaaaggaattaagtgttagagtgttcttgcatttacattatacatgtgaattcactgaatcctcacagtcaacataatatatttttaagtagatggacactgcctaaggcccctgctctggttgtgacattaatttattctctgttctctaaatgggtgctgaaagactggcctctaccgaatggccttaccctcccacagtcatgagttacacatccttgttctaaaaggtcagcagagatcaagtctgagttccagatttctagaaaagaaactctgctaattcttggcccaatcagctatgccagtagcatgcggtcaaacagcatatccaatcagattttctctcccaacaatatacaattgtgtcttagagattctaattagtctatgctggtaacttgaactgaagacatgtaacctgaatgctgtgcagcagccatagctggctgtgtgtgcatatagatgaagaggatgccaacctgcagagatggaggagaatgatgcacacagcacatgcctgtgctctggctgtttttgcctcactagggcacctaggacacccactcaccaggtccacttagaacaaagtccctgcagaaaatattacaagagtattaacatagccctggggcaatctggttgtgtgccagtgtgctgccatgctgaggtcaattggttttagatctttctaccaatggggatagagaagaacacatttgccaggtcaataatcacacaccaagggccagaaatagtgatgatctactccagtgaagatataaattaatcagagaagctgcaactggggctaacaactggttcaacttacagtaattcattatcatttgccatgctctttcttttttcagagaccagataggtaacttaaataggtatgtgatagagactaccaccttgcaacctttaagtcttttgaagatagaactaatttccacaataccagaagacaaagagacaagttataaaggatcctactttgtccttcctgccacagtgaccttactccatacatcagggacccaatgcaagagttccagcagctgctaagtacacctatcccaattatacatgcaggaactagatatacaaccatacggtgagtctgcaagtacattggacccaaaatgagacagttttgggcagtaccccatttatctcctagcttccgtaagtcccaccctaaacagataaccatgatggtatttggggtatcacggtcctatggattaaatgtttgtctcctcccaaactcaaatttaaatttaattgccattgtaacagtattaagaggtgattaggctatgagggctgtgcactcactcataggttaatgctattatttggggagtaggttcattatcaagggagcaggtttcttataaaaggatgagttaggcctccttctgcctctctctgtcacctaccttttgctcttctgtcatgggatgatgcaggaagaattccctagcaagataccacctcctcaatcttggacttctcagcctccagaaccatgaaccaataaatttctgtttattataagttaaccaatctgtggtattctgttgcagcagcacaaaacagaccaagacatttggtgtcaatgttagctgagtctcatatcttatactcctcaaaaaagtctgtctgttctgccacccttagccctaaccactaatcagtgcacagttcctgtcaaatgacacaagtaattttgtgaaaggattggggaatatttattctgacaagggcattgcagttccttctcaagggcacccaacctcacctctaaacaaagggctctggacctacaaattgagattgaaaactggatgaagaaacctaattttctgtcatgaaaactaacatccatattgtgcttatcagctctcaagttatttacactcatacgttccttaacaatgggggtatgttctgagaaatgcattgttaggcaatttattgttgtgtaaacatcatagagtatacttacacaaacctagataaaatagcctactgcacacctggtatggtctattgctcctaggctacaaacctgtacagcatgttactgtactgaatactgtaggcaattgtaccacaatggtaagtatttgtgtatctaagcatatctcaacataggcaagatacagtaaaaatatagtattataatcttatgggaccaccgttgtatatgcagtctgtcattgactgaaacatcattatggagtgcatgactgtatttactcatttagttacttagctagtttaaattttgcaaaacatgaccaggtgtggtggctcacacctgtaatcctgacactttgggaggctgaggtggggggatggcttaaggccaggagttcaagtccagcctggtcaacacagtgagacctcatctctactttaaaaaataaaaattaaaaattaacattaattttataaaacaataagtatcatttatttattgatggacatatcatgtgtccgtttgtctttcttctaagaacagcatgatctatccaccatcaccatagatctttgtgggtttaggaaccctaattgctactttcgccttgctgcctggtacagtaatcaactacaccttgcctctgattattaagtgccaccaattggccttgtccattcctaaattccatcatctccattgagacttgagaccccacttccatggtagattcccacctatccacttgcatcaaccctggggtacagaatttctcaaagatacagagccctcttcaccagtgtgtgtcttctaaccctagggaagggagtggccttcaaggcctcttgaggaacaaagacaggcaggatattctcagttcttacatagtaaatccagtctgacattccttctctgtgactctgtgtttcactctgtgaattatattttctgaattactaattttctcttcaactatgcctaatctgttgtcaaaaatccatgagttttttattgtaatttttacaattttcatttctaggagttctatttgattattttccaaatctaataggttacttttacagttgcctcttttttactgacatgtgtaaggtaagcttttttttttatttctttaagcataaaaagcatagttctgtgtttgataggataatacctgagatctttgagggtctgtctctgctgtcagttgtttctgctagttcttgctcttggtgccttcactgagtacttactgattttttcactttgaactactaatttccctttgaaagttgttttgggattctttgaaacctaggacaaaggtccattcctcagagagaatttgtattcacttctgccagggacctggcagtactaccagcctggaacaactttaaaattaataactttaaagcctgaagtttttggaactctcatgcaatgtaaatataaatgtaaatccaagcatgagctggctgtggccacaatacctaactattctgctaccgcccaggccacactccatgtagtcaccaggagtaagggaataggaaagtttagttctaggtcacccttatactgagggtgacactctgggtaggggcagttttatgaggaagggtctcacattagaatctccacctagggagacactgggctttagtctctgtaatccacaggcagtgaaaagtcaaatttaagagcacaaaattcagtaagtgttctcagaataaaggctttttctgagctttcttttcttttctgagttcctctcagaatgtgactagataattcttccttactctaccagctcttagatgctttccagaagattaaaaaaaaaacttttagcttgcatttttagttgttttcatcaagaagacagggccagataccttgcctgccttgtaactgaaaatagaaatctctttttttttttttttgaggtcaggaaaccgaagacatagcaaaggccatgatagtcttatgttcaagaggaaaatcaagataataaataatcctgtgtttttgtgtagcctgctctatagttcacgaagtaccagcaccttgtctcatatctatccttttctctccattcccccatcaaccagcctaagtcaggccttcattatctttagttgcctcccacctgatgtctgacttccatcttctctctctccaattctttctgctggaataatattcctaaaaacaatttcaaccaactcactccatcgtttacaaatattctataactgcccattacttattagacaaaaatcactcttaattatagaatggaaaactgccctacataaaaattcatctttatctagactgaatcctcaacacaggcaaacatatgcatctctatgtcctaattcaaccctaattttttctctgaaacattgtctacaactcttggcctctattcttttttcccctaagcactgaaggaatttatatcagcaatatacaatgtattattttttaacagttttattgagatataattaacacatcttatgatttacccgtttaaaatgtacaattcaaagttttgtagcatgctcacagggctgtttaaccatcaccacaatcaattttagaacattttcatcaccctaaaaagaaaccacatacccatttcccctcaacgttccagctttaggcaaccaccaatctactttctgtctctacagatttgcctattctaaacatttcatataaatggaatcataaattatgcagtcttttgtgactggattctttcatttagcatagggctttcaaggtttatccatgttgtaatgtgtatcagtgttttatttgttgttataactaagtaatattccattgtagggatatgccatgttttattcatccattcatcagttggcgagtatttagatgttccccactgtttggttattctgaataatgttgccttgaacattcatgaacaagtttttgtgtggacatatgtttttatttctcttgggtacataccttggaatgaaattgctgggtcatatggtaattctatatttaacattttaaagaactgctaaaatgttttccaaagcagccacaccatttgacattcccaccagcaaagcacaatgcttccattttctccatatcctctccaatccttgttgtttaatgttttcatcatagccatcttagggggtgtgatgtggtatctcatagtggttttgatttgcatttctgtaatgactaaggatgttgaggatcttttcatgttcttattagccatttgtatctcttctttggagaaatgtctactcaaatcctttgcccatttgaaaaactgggtcatttgtctttttattattgagttaaagagttcttttacattctggatataggtcctttaccaaatatatgatttgcaaatactggatctcattctgtgttgtcttttcacctttacgatgatgttgttcacagcacaaaagtttttattttaatggagttcaacttatctattcttttgctgtttgtgcttttggtgatttatttaagaaactattttctgacccaaaattgtaaagatttacttctatgttttattctaggagtttttctaatagctattttgaagtctttgtctgctaagtccactatacagaccccttcaatggctatttctgtggcctgtttttttcccttggtttttgcatgtcttgtaattttttgttaaacactggccatcttagctaatataacagctctgaataccaatcccctccagaaattgtttgtttatttgtttggtgatttggctgaaataattccacattctgtttctgctgcaatgtgcagcctctgatgcccctgcccagatttttttctgtttgttttcatcttttagtctgactacctaaaggtcactcctgggttggcataaaccatttattggtcaaaagttgtgtttaacctctttcactagttagattttttccccctttaccaatgaatgtgtgtgtggcctggagatttctattacaactccaggagtttactttttttgccccacattcagcaagggactagtagcttggaggttccttctataatcactcctgagagggtgcagccctaggcaatcacatagtgttctacaaggccagaggtgagtgtgagtttacttttaaacctggttttctaggagtttccctttggtcagagtagcttcttgtcaatcagccgtcaaaggtgatgtttaaatcctttgttctagtaaactgtctgccctgtgttaatggctctatgtgcagctcaggagatcctttcaaatcagtcctgcatcctgctctgatggctcttgactaggcacagcctgacccatgggcacatccctcttgaccccagaattgactgtggtcccaggagagctcttcttggttttctctttctctgcttctctccaataagcctctgtactgccatttttcttgtacaaatgatggcactccagcctgctttaaacggccctccactaagatctccattgttttcaacagtggctttagatatggagttctccacactgttctaaatgaagtcagttctcttaggcagagctgcagggctctttggtacttaggatctgtctttgccctgggcagaacccctgtaccactgaaccatagctgagcacagggacctgtgttaaccaaaatggcatcccactctaagagtggtcaaggtggcagctcctgatcgtttctcgccactgctagcatggaacctccaccctactggcaagttgaggtgggagcaaaagggctccagtgttctcagcctttgcacctggaataaagcttccatcctgtgagtcagggctgggtcggggttggaaactcaatccttctggccatgcctgcttaaaatagagcttctgcagcatggaactggggaagataagaaatggcagcctgaccctctctgggtgaaactgcagctccaggctaaggactgggtggagaggcagccacagccttcttggcttcacctgcctggagtagagctactctagcatgaagctctgggtaggggtaaagggatgcattctggctcaaatgccacagactctcactgtctttaccataatttaataggtttttcttgaatgactctttctccatttgctgcatgcctttgggacaattttcagagacttaaatgattgtcatctgtaattttcacttgttaaatggtttttctggggaaaaggtccatccagattcttacaccttcattctgcaagtcttaaatccacagaacccattatttgatgaggataggctttattcatccacttgacaaatatttatagactatgaattatgtggcaggcaatgatttgttgctcatcaacctgtgttgtaaactgactatttcaggttgatatgtatttaacactcatatccaacaggatcaagcacactacatccaacaggccatgtctgtttgggctctgtaaatgtctacagcactcagcacaaggcgggatgtagtttattcttttttttcgctaatctcttcctgatttccctacttgattaacatcacatttccaaaactatgtatttttctgaagtgttcatttcctctttgtttagcaaatcactgtcgattgtctattatttgtccctaccaaaataatggtagatattttgctaccattttttaaacgtgtaataggcattaggttttttttgttttttgtttgtttgtttgtttgtttaagccacagtttcgctcttgtcacccaggctggagtgcaatgatgcgatctcagctcactgcaacctccgcctcctgagttcaagcgattctcctgcctcagcctctggagtcacccaggctggagtgcaatggcatggtaccagctcactgcaacctctgcctcctgtgatcaagtgattctcctgcctcagcctccagagtagctggaattacagatgcgtacaaccatgcccagctaatttttgtatttttagtatagatggggtttcaccgctggtctcaaactcctgacctcacctggatcaccacctgcctcggcctcccaaagtgctaggattacaggtgcaagctgctgcaccgtgctagcattaggtctttgcatatgcaatctcgctagtgctagcattaaccccatagggaagttctaatcccattgtgcagatgagaaacctgagactcagaaaggttaaaagagcttttctcaagttatagcaaataagtggcagagctgcactttgagcagagaactgcctgactccaaagctggttctttttcttccatgctaacctaccctgaccttctacttgtaagaggagaagagaactatagcaagtttgaggaaaatcatctccaacaccctgaatcatatacagcattgcgtggcttggaagcctgccggtttcccaaagctaatatgtgatctggcctcttcgtgcttgcagcactttgggacacaaaatgactaacaaagaaccacaggagtgaacggagtgaccttgttgcaccatgccaagccccccaaatgaccccaattaaatccacaacctggcttatttacaaagatgtagctcacaaaatggcaaatatattaataactcgaccacaaccgatctggccctcgttagctgtgttgtaatgagaacttgtactcatatcattatgaaacacatatttacgacaggaattgtactgaatccaggcttctctgaccctccaggaaaaaccaattaggaatggtgatgcctatctacctatttcttttatttttaaaatttttgtgggtaacttctggaaaattgatttcatagttagagttacccttgatggtgctgagatgggtgtggctgacttggggatgagaagtgggtaagttcaaggatgcttgggaggtgaaaaaaatcccaaataggccttttttttttaatggctcacagcctaaatggaattaaataattaaaaattaaatacagtaaagttgattttgtttaatgttataaatgctaatctaatctttattttcctgtgtttcacttaaatttttacaaacttttttggagaaagatctacaatgcttttcctaaagtagctaatgttcactcttaatattttcttttaatatttacattaagtgtgaatctatttttcctattaactgaaaattcacggtaatcatttctgtttataaattagtagtttctggccaggtgcagtggctcacgcctataatcccagcactttgggaggctgagtcaggcagaatacttgaggtcaggagttcaagaccagcctgaccaacatggtgaaaacccatctctactaaaaatacaaaaattagttgggcctgctggcacgcacctgtaatcccagctactcgggaggctgaggcaggagaatcacttgaaccgggaggcagagattgcagtgagccaagatcatgccactacactccagctgggccacagtgcgagagtccatctcaaaaaaaaaaaaaaattagcagtttctaaaataatcttcacagtgtttcacgcctgcagtaatacaatgatacatgcatacttcagcatataaggaagatttattgtgtttttgttccaggtcctgattgggcactggactctgtaggatagaggaagggaggctggaaggtggaagaatagattcaaagggatggattatggaaagtagaacattttaatgaacatagtcatcattaatattatcttattcactaggtatttttttttcttttttgcctctttgtttctagggattgctaagtattcttatgtggctattctacttacaattaatatatccttttatagatatggttttatgttcttttttttttttttttgagatggagtctcgctctgtggcccaggctggaatgcagtggcgcgatctcagctcactgcatggttttatgttcttataaataaaatgaagaatataagtttgaaaaaatttgtacatggtaggtgtatattttggggtacatgagatatttgatattttgatacagatacacaatgcataataatcacatcagggtaaatgggatatccatcacctcaagcatttattctttgtgttacaaacaattcaattatgcccttttagatatttttatttatttattttatttgtccataagttgttggggtaccggtggtatttggttacatgagtaaattctttagtggtgatctgtgagattttggtgcaccccatcacctatgtataaactgcaccatatttgtagtcttttatctcttgcccctctcccactcttccccccaagtccccaaagtccattttatcattcttatgcctttgcattctcatagcttagcccccacatatcagtgagaacatacgatgtttggttttccattcctgagtcacttcacttagaataatagtctccaatctcattcaggtcactgaaaatggtgttaattcattcctttttatggctgtgtagtattccatcatatatatatatgtttctttatccattcattgattgatgggtatttgggttggttccacaattttgcaattgtgaattgtgctgctataaacatgtgtgtgcaagtatctttttcaaataatgacttattttcctctgggtagatacccagtagtgggattgctggatcaaatggtagttctactttctttaagaaatcaccacactgttttccatagtggctgtactagtttacattcccagcagcagtgtagaaatgttccctgttcactgcatccacagcaacatctactgttttttttatttttcgattatggccattcttgcagaagatacattgttggattcagttagctagtattttgttaaggattttagcattgtggttttgatttgcatttccctgatcattagtgatgctgagcattttttcatgtttgttggccatttgtatacattcttttgagaacggtctattcatgtccttggccgatttttgatgggattgtttgttattttcttactgatttgtttgattttgttgtagatccgggatattagtcctttgtcagatgtatagacggtgaagattttcacccactctgtgggttgcctgtttactctgctgactgttccttttgccatgcaaaagctctttagtttaattaggtcccagctatttatctttgtttttattgcatttgctttcgggttcttagtcatgaaatccttgcctaagccaatgtctagaagggtttttccagtgttgtcttctggaatttttatagtttcaggtcttagatttaagtccttaatccatcttgagttaatttttgtataaggtgagagatgaagatccactttcattctcctacaggtgggtagccaagtatcccagtaccatttgttgaaaagggtgtcctttccccacttcgtgtttttgttcgctttgtcgaagatcagttgactgtaagtatttgggtttatttctgggttctctattctgttccattggtctatgtgcctacttttataccagtgccatgctgttttagtgactgtggccttatagtatagtttgaaatcatgtagtgtgatgcctccagatttgttctttttgcttagtcctgctttggctatgtgggctcttttttggttccacatgaattttagaattgtttttttctaattctctgtagaattatggtggtattctgatggggattgtgttgaatttgtagattgcttttggcagtatggtcattttcacaacattgattctacccatccatgagcatgggatgtgtttccatttgttcatgttgtctatgatttctttcatcagtgttttgtagttttccttgtagaggtctttcagctcctttgttaggtatattcctaagtgttttatttatttatttatttatttatttatttattttgcagctattataaaaggggttgagttcttgatttaattctctgcttggttgctgttggtgtacaggagagctactgatttgtgtacattaatgttgtatccagaaactttgctgctgaattcttttaccagttctaggagctttctggagaagtctttagggttttcaaggtaaatgatcatattatcagcaagcagtgacagtttgactttctctttaccaatttggatgccttttatttctttcccttgtctgattgccctggctaggacttccagtactatgttgaagaggagtggtgagagtgggtatccttgccttgttccagttctcagacggaatgctttcaacttttccccattcagtattatatcggctgtgggtttgtcatagatggcttttattacattaaggtatgtcccttgtatgctgattttgctgagagttttaatcataaagggatgctggattttatcaaatgctttctttgcatctattgagattatcgtgtgatttttgtttttaattctctttatgtggtgtatcacatttattgacttgcgtatgttaaaccaccctgcatccctggtatgaaacccacttgatcatggtgggttatctttttgatatgttgttgaattcagtgagctagtattttgttaaggattttagcatctatgttcatcaaggacatcgtttgatagttttcctttttattatcctctttcctggttttggtattaaggtgatgctggcttcttagaatgaattagggagggttctttctttcactgtcttgtggaatagtgtcaagaggatttgtaccaattcttctttgactgtccggtagaattctgctgtgaatccgtctgatcctggacttttttttctgttggtaatttttaaattaccatttcaatcttgctgcttgttattggtctgttcagggtatctaattcttcctgatttaagctaggggggttatattttcccaggaatttatccatctcttctaggttttctagtttatgtgtgtaaagatgttaatagtagccttgaataatcttttgtatttctgtggtgtcagttgtaatatctcctgtttcatttcttagtgaggttatttggatttcctctcttcttttcttggttaatcttgctaatgatctatcaattctatttatcttttcaaagaactagctttttgtttcatttgtcttttgtggttttttttgttgtttctttcaatttcatttcattctgctctgatcttggttatttcctttcttctgcatttgggtttggtttgttcttgtttctctagttccttgaggtgtgaccttagattgcctgtctgtgctctttcagactttttgatgtaggcgtttagggctctgaactttcctcttagcactgcctttgctgtatcacagaggttttgataggttgtgtcattattgtcattcaatttaaagaatttttaaatttccatcttgatttcgtttttgacccagtgctcatttaggagcaggttatttaatttccatgtatttgcatggttttgaaggctccttttggagttgatgtccagttttattccgctgtggtctgagagagtgcttgatataatttcagttttcttaaatttattgaggctcgttttatggcctatcatatggtctatcttggagaaagttccgtgagctgtttaatagaatgtgtattctgtggttgttggatgaaatgttctggatatatctgctaagtctatttgttccaagctatggtttaaatccattgtttctttgtggactttctgtcttgatgacctgtctagtgctgtcagtggagtattgaaatgccccactattattgagttgctgtctatctcatttcttaggtctattagtaattgttttataaatttgggagctccagtgttaggtgcatatatgtttagggttgtgatattttcctgttggacaaggccttttaccattttatactgtccctctttgtgtcttttaaccactgttgctttaaagtttgttttgtctgatataaaaataactacccctgctgcttttggtgtccatttgcatgaaatgcctttttccacccctttactttaagtttatgtaagtccttatgtgttagatgagtctcctgaaggcagcagatagttggtgtgtgagttcttatccattctgcagttctgtatattttaaatggagcatttaggccatttacattcaatgttagtattgaaaagtgaggtaccattgttttcatcatgctctttgttgcctgtgtactctggtttttttttttttttttggtttttgcttttcaacttgtattttgttttatatgtccctgtgtgatttatgctataaagaggttctgttttgatgtgtttccaggatttaagatttagagctccttttagcaattcttgtaatggtggtttttgtttgcctgaaaacgaccgtatctttccttcatatatgatgcttagtttcactggttacaaaattcttggctgataattgttttgtttgaggaggttaaagataggtccccaacccattctagcttgtagggtttcagctgagaaatctgctgttaatctgttaggttttcctttataggttacctggggggcttctgtatcacagctcttaagattctttccttcgtcttaactttggataacctgatgacaatatgcctaggtgaagatctttttgcgatgaatttcccaagtattctttgtgcttcttgtatttggctgtctaggtctctcacaaggccagagaagttttcctcaattattcccccaagtatgttttccaggcttttagaattctcttcttcctcaggtatactgattattcttaagtttgatcacttaacataatccaagacttcttgaaggctttgttcatattttcttatgctttttttctttgtctttgttggatggggttaattcaaagactttgtctttgagctctgaattcctttctttgacttgttcaattctattgctgagacttaccagagcattttgcatttttaaaagtgtgtccaaagtttcctggattttttattgttttttctttaagctaatctatttccatgaatatttctcccttcacttcttgtatcacttttttgatttccttgcattgggctttgcctttctctggtccctccctgattagcttaataactaacctcctgaattctttttcaggtaaattagggatttcttcttggtttggatccattgctggtgaactagggtgattttgggggggcagtgttaaagagccttgctttgtcatattaccagcgttggttttctggttccttctcatttgtttatgctctgtcagagggaaggtctgaggctgaaggctgtttttcagattcttttgtcccacggggtgttcccttgatatagtactctctcccttttcctatggatatggtttcctgtgagctgaattgcagtggttgttgtctctcttcttggtccagtcacccaatgtgtctacctggctccaggctggtactgggggttgtttgcacagagtcctgtgatgtgaaccatctatgggtctctcagccatggataccagcgcctattctggtggaggtggcagagggtgcaatggactccatgagggtccctagctttggtagtttagtactctatttttgtgttggttggcctcctgccaggaggtggcgctttccagaaagcatcagctgtagtagtggggagagggaccagaggtgagcagggctttagaactcccaagattgtatgccctttgtcttccactaccagggtgggtaggtaagggccatcagatgggggtggagctaggcttgtctgagttcagactctccttgagtgggtctttctgtggctgctgtaggggatggggataagtttcccaggtcactggagttgtgtacctaggaggattatggtgcctaggtcatgcaggttttcagggaagtgggggaaagctggcagtgacaggcctcacctagctcctatgcaaactgaaagggtagtctcccaccgtgcccctgccaacagccccaagtctgttgccaggcggaaggcaagatgggctttatggtagctctataaaatataatttgaagtcaggcaatgtgattcctccagttttgttctttttgcttagaatagctttggctattctgagtcttttgtgattccatataaattttaggattattttttctatttttgcaaagaatgtcattggcattttgatagggattgcattgaatctgtaaattgccttgggtaatatcgacattttaacaatattgattcttccaatctatgtacatggaatatctttccattttttgtgtgttctcttaaatttcttgcattaatttttatagtcttcattgtaaagatctttcacttctttggttaattcctaggcttttaattttatttgcagctattgtaaatgagattacttttttgttttatttttcagattgttcactgttgacatatagaaatgctactgatttttgtatgttgattttgtatcctgcaactttattgaattcatgtttatcagttccaatagttttttgatggagtctttaggtttttccaaatataaaagcatattatctgcaaacaaagataatttgacttctttctttctaatttggattccttttatttctttctcttgtttgattgctctagctaggacatccagtactatgttgagtaacagtggtgaaagtagccatccttttcacgttccaaatcttagaggaaaggctttcagtttttcccaattcaacatgatactagctgtgtgtctgctgtagatggcttttattgtgttgaggtacgttccttctgtacccagttttttttgtatttttgtttgtttgtttttgagacagggtctcactctgtcacccaggctggagtgctgtggtgcaatctcggctcactgcaacctccacttcccaggctcaagggattctcccacctcagcctcctgagtagctggaagtacaggcacatgcccacatgcctggctaattttttttttctttttttgtagagacatggtttcgccatgttgcccaggctggtctcaaactcttagtgtacccagatttttaaggattttgatttttatcatgaaggaagggatcttgaattttgtcaagtgctttttcagcatcatatggcttttgtccttcattctgttgatgttatgtgtcacataaattgatttgcatttattgaatcatccttaggataaatgccacttgatcatgaagaatgatcttttaaatttgttgtagatttcagtttgctagtattttgtggaggatttttgcatcagtgttcatcagggggatattggcctgtagttttctttctctttctttctttctttctttctttctttctttctttctttctttctttctttctttctttctttcttcctttctttctttcttgtttctttctctcttttgacatgtctttgtctggtttttgtatcaaggtaatactggccacatagaatgagttcagaagtattctttcctcctctagttttcagaataggttgagtaggattggtgttagttcttctgtaaatgtttggtaagattcaacagtgaagccactgggtgctgagcttttctttgctgaaagactttttattatggcctcagtcttgttacacgttgtctgttcaggttttggatttcttcatggttcgatcctgataaattatatgtgtctaagaatttattcatttcttccggatttcccaactgattggcatatatagccagtctatgtctttttttattttttgagacaagatctccctctgttgcccaggttgcagtgcagtggtgcaatcatggctcactgcagcctcaaactccctggctcaagtgattctcccacctcagcctcctgtgtagctgggaccacaggtgcatgccaccatgcttggctaattcctttttggaaagattgggtcttcctatattgccttggctggtctcaaactcctggactcaagagatcctcctacctccgcctcccaaagtgctgggattacacatatgagccactgtgcctggctcactctgtcttttgattggagagtttatttcatctacattcaatgttattattgataagtaagggcttacttctgccattctgttatttgttttctggttttgtggtcttctcttccttctttccttccttcctgtcgtcctttcagtgaaggtgattttcttaggtggaaggttactttttgtgtatctgttgtatgttttttgatttgaggttaccatgaagcttgcaaatgatatcttataatccattattttaaactgatgacaacttaacattaattgcataaacaaactaataaacaagcagagaaaactaatacaaactctgcactttaactttatccctctgctttttgacttttacttgtttcttgtttctatttatatcttcttatactctctatgtctggaaaagttgttgtagttatgattctttgagaggttcatcttttagtctttctactcaatatatgagtagtttgcacaccacaattagtgttataatattctgtgtatttctgtgtacttactattaccagtgagttttgtaccttcaaatgatttcttattgctcattagcatccttttctttcagattgaagaaatccctttagcatttcttgtagaacaggtctggtgttaataaaatctttttttttggcggggggtgtctgggaaagcctttatttctccttcatgtttgtagaatattttcactagatatgctattctaggataaaatttttttccttcagcactttaaatcttgccactctctcctggtctgtaagatttccactgagaagtttcctgccagacgaattggagctcctttgtatgttatttgcttcttttgctgcttttaggatcatttctatatccttcacctgtgggagttgattattgaatgccttgaggtagtcttatttgagttaaattggtgctctataaccttcttgtactatgttgatatgtttctctagatttggggagttctctattattatccatttgaataaactttctacccccatctccctctctacctcctctttaaggccaataactcttagatttgcctttttgaagctattttctagatcttgttggtgtgcttcattcttttatattcttttttattttgtctcctctgactgtgtgttttcaaataacctgtcttcaagctcactaattctttcttctgcttgatcaattctgctgttaagagactctgatacattcttcagtatgtcaatcacatttttcagctccagaatttctgctgattctttttatttcaatctctttgttaaatttccttctctgtgttatcttggattttgttgagcttcctcaaaacagctattttgaactctcagtctaaaaggtaatatatctgtgtctctctaggactggtccgtggtgccttatttagttcattggtgacatcatgtttccccggatggccttgatgcttgtgggtgttcatcagcgtctgggcatggaagagataggtatttattgtagtcttcacagtctggacttgtttgtacccatccttcttgggaaggttttataggtatttgaagggacttggatgttgtgatctgtcttcgatcactgcagctgtatctgcactgggggtactccaagtctagtaacactatggctcttgcaaacttgtagaagtaccgccttggtggtcttgggtaagatccagaagaattctctggattaccaggcagagactcttgttctcctcccttactttccccccaaaaaatagaatctttctctgtgctgagctgtctggagctgggggaggggtgacataagcagcctgatggccatcaccactgggactgtgctgtgcatcagcacagcactgggtcttgcccaaggcctgcagcaatcactgcctggctaccatctatattcactcaaggcccaaggcctctacaatcatgcggtggcaaatccagccaagattgtgtccttaagaatggtgagatcctcctggccccaggtgggttgacagatgctgtctgggagctagggcctggagtcaggaatcaggaatctaccctgtgttccattctactgcagctgagctggcacccaagccacaagacaaagtccttcccactcttccctcccctttcctgaagcagaggagtctctccccatggccaccaccaccccaggcccatggcaagtacttcctagccactgccgatgttcactcaaggcccaaggactcttcaatcaacttgtggtgtcagtcctgagcctctcccttcagggaaatgggtttccctgcggcccagggcagttatagaaatgccatccaggagccaagtcctggaattagagaccccagaagcccatttgttgccctacccccactttggtaaagctggtacccaagctgcaagacaaagtcccctttactcttccctctccctttctcaaggagggagggggtctcgctccatagccaccacagctggagatatgctgggttacgtctgaagccagcatttctctgagtttaacccaaggcttatagcaaatacagcccggctgctgctgctaattattcagggcccataggctctctagtcatcaggtgatgaattctgccaggcctggctcctttccttcaaaggcaatagtttctcttctggcccagggtatgctagaaatgacttccaggatttagagcctggaatgggggacctcaggactcttcctggtttcttattctactgtggttgaactgatatccaagtggcaagacaaagtcctctttactctcccctctcctctcctcaagcagagagaaggagtctctccctgagctgcactgcctgtggctggggaagggatgatgcaagcactcttttggccaccccagctagtatctcattaggtcatgtgcaccccaagtccactgctctgagtccagcacagcaccaggacttgccaaggaattgcaattcttgcggcctaaattgccattcaagtttatttaggatcccagggtgctttagcccatggttgcaggatctgctggaactcaagttctcatcaccaagatggacaatttgcccctggctagggctggtctaaatactccctctttgggtgttggctgagttttaccttgtgttgttttctgctatgacacggcagcactgagttccaatgcaaagtcccacaatcagtgtgctctcactccccactgtgctctcactccctcaacattctctcactcccctattctctcttcgttccatgaggccactgctagaggatggagaaggatcgtatagctgactcaagactgtctttcctaccctcttcagtgccccttttcttaatatgatgttaaaaccagggactgtggtcactcacctgatttttggttcttatgaacatgctttttttctgtggatagatgttctgtttggtgtttcgtgggagggacaatcgctggaggcttctattcagccatcttgttccgccttctcatctctatttctttatattgatttgtgaacatcttcaaaaccctgcatccttgagaatcttcagtccttcagtgtcatttgaatagttcagctggatctcactggtttattcctttaaacaaataaaatatcataccttttccactaggctacagaaccaataacgcaaggaggggtaaaacgggaaagaatttgagtggaaacctctgaggaaaaatgtggtttccatggcggaagaaaagttgacatttcattaaattgtattagacaataaacttattgggtgttagattacctctccccaaagtcctataaaacacccaggatagtataatttacctgtcaggaggtcttcaagtatttgttgattattgcaggctgaatcttcccttagctgatgaaggtggggtgaagtcactttaagaatttaactttaaatctgttctagtattattccttacctgccatatggcatatctacatcaccttctttttttgcatctctctgggagttccaaggtggggttggaatgtcttgaatattatttgagctgtttcccaatcgtctttcccttctcagtcctctggctgttgtttctgttgtctagagtgtgctgttattctgctcaaccatattgatgccctctggattggactgagagggctcagtaatgttaatcctctcttctacacaagatctgaaccccctgagaaataagacaaaggactaacatggaaagaggccaagatagcatcttcgttactgacaaaactaagttgaaggacctagcttttacccgtggcctcgtgcaccttctactgtttgaatcaggcctacttggccacccagtcccaggaaggactgaagcccctctgcagatttccccttggaggatcagtttcctaggcgatttgtcatggagaggtagaacacagtgtgtgactcggggagcttactctcagaaggaataaggaagaaactgagctgactatgcccagtttattctgcccaaatttacagatcagttaagtttttccagctctcctggaagggagtgaataaaggagcagagggaggccaagagtgtcactcttatcaagctcagcccacaaaatttagaacctcaagagtggtgcagaagtatttaccctccaataccacacagtgtttttctgaaaggccccaacatggtctttggcctctaatgccactggggtttcctgactgtagacctctgatatttacctctctctctgaccaattcatttctctctccttcaccttttcatgtgctgttcctttcataaagcagagggccacagtaaaattagagtaggaggatggctagaattataattctagatggaatattttgttattgtttggtttttttttttttttttgtaaccagtttattgaatggtctaaactcagtagagttcaaacataaaaaaaattatttcttccagtgactgctcctaaaaaagttctggtgagctcaccttccctcccctaaatgatattttaggtaaaactttatggttatttttgggtataaaaatattcagtataatacaattgatccagtttaaaacttcaaactcatatccaacttaattctcttcctcctaactaagggagtgtgcttttctctttcatttttcttccttcctctcctggctttccttttcttctccactatttttgggccttaaaaacaggtggggaagagggaataaaattcttctatttaagtgggtctatttggtccttccttccttggaggtcagtagctatttatggcagaagtctaaatgctgagcttctcatggactcaaagtgagtccttaataggatcctgtaagattccctttttttttttttttttttttgagatggagtctcactctgtcacccagactggagtgcagtggcatgatcttggctcactgcagcctctggctcctggatttaagcaattctcctgcctcagcctcccaagtagctgtaattacaggtgcccaccaccacacccagctaatttttgtatatttagtaaagatggggtttcaccatgttggtcaggctggtcttgaactcctgacctcaagtgatctgcccaccttggcctcccaaagtgctgggattacagatgtgagccaccatgcccagcgatcctctaagattcttacacagcacaggacctactacggaagatgcactctggcatcatttcttttaatactgcaccccaccctgggttcccattctcagtaagactcatacaatcaccttagccaaacacagcataagtttacttaattctcacttaacagtgttgagttaagtgaactcttcaccctgaggtctgctgtgctccacaggatcattcaagaatccaggattcctcgtttatatctgcatttgagcctgtgggaaggggaaagagaaagtcagagttagtagctttgtctttaaagcaattatttggaagtttccataggtcacttccactaacatcctgttggcttgaacttagtcacatgtccatacctagctgcaagggaggctaggaaaatgtaatcttttgtgggctggctatataatcctctgaaaccctggaggtctttttaatcactaaaatggaaaaaaggagaatggatattggagcagaattgagtagtctctgcctctgttatatctgagatcatcttcttaatgtactccaaaccactctgccttcaggcccttgttgctaagtgtggaccacagtgacagacttccaccccatttcctctagacccagtgaccctctctgtgatgtcttcctgtttccattttaccatccaccaaacatgtctgtagatacctgaaccccaattggaaacatgttttcatgttctttcttactgtgacacatgccattcaaatcactggtaagtgatgcatgtgtcaccttaggatgcctgtggaacacatcgtagggacaccacacctaatccatgtagagagggaagagttgggaaaggctgcctgtatgacagtgatgcctgataagagttctgaaagagtaggggtagtttgtggataggtgtcataagcaacaagaactagaagagaagagaagagggacctgatgcatttacagaacagcaaataggacactattgcttgagagtcaagtgtgggcagaagtgtgggatatttttagaatatgaggctacaggggtaaacaagaagcaaatgatgtaggcctttgtatactttgactttatcttgaggccaaatgggatttcatggagaactttaagcaaggaagtgtgacccaaaccaatctgcatttgcaaaagacaattctgacagctggtgaagcgtgcattgaagcaaacaagaccaggccctgccaggacagttgggaggtaattggagaaacctaagggaaaaaaaattaaggtccagaagtaaaatgatagaactgccaacaaagctcgtatattctttccatgataataacaattttattctccgtttgtacactgtctcattccaaaaaggataggggttgaatttcacaaattcagcaaatattgtagtgaatatgaatctcagtctaaaaattcagatgtgcaagaaatattatttctttcattttctgtaaatcaaacttaatttctaatctaagcccactcttgctgggtagatgggaaattcagtctcagccattttgaggattccctccttcacattagtacaaaagctccagagtcctacataactgtaagacattgagggggttccgctgatgcttagtgccctggtaatgaggagatagtcaccgtgccagttcacacagctccagtggctttgctgataccaagttatgcctgctgctcagagtcctaggccagcatatggaacggccatggttcttacctggggtctttctacttttctagagttctgcctccctttgctctctctaaacccacagatacaaagagactctgggaatctcttgacaatgtgggagaattgcccctttccacgtttctcttagaacccttttttctccaccgaggacacttagctcaacctccttaaaggctttaaacatttccaaacaaattcagaaggagaagtcaaccataattttaccagctctgaagcaagaaagcacagaatctgtaaactgcattcatagaaaaaggagaagaaaattcaaaaattaacatgtcaaaaatggtcctatctcaataccatgatttttttcaaatgtcaaaaatggtcctatctcaataccatgatttttttcaaatataaagaatttatggtgaaagagaaataaaattaaaaatgaatgagaaaattaatgcgttgaaaatgctttcaagcttaggttcatgacgtcagctctgagctttctagtgaccaaatcaataactcaacaactgttcatgggttataagccaccccaatctacggtattctgttataacggcctgaactcatgaaggcaacaactgataaaaataaatctgctaaagaaagcataccagtttttcaggaccaaaatggttttacctggccctgggatgagtggaagatttttttcactggatccttctaaagagaacactttataatgcaggcacccccacgttcaacattatccttacaataatgacttctgtcacattgttttttataacaatataggcaccagagatttaaaaaaacaacaaacaattcaaaaagtgggctttggtctagtcaaggatgcagataaacagataattgccacctgctattaaagcgtcatcatagaggtgttgtacaaagtgcaaaaggagcccagatgaggcagagcaatgatattggaagcaggtgtccaaggatgcattcatgttgctagaagaagaaaggatggagggagcccagcacccaaagatcatgggggctagaatgaggttggaaaatgctcaggtcataataagcagaaaaacacaatcccatattcaaaagaaatgtatacaaaatactaaaaggaaatccatgactattattagttgttgttgtctttgggctgccataacagcataccatagattgggtggcttactggccaggtgcagtggctcacgcttgtaatcccagcactttgggagagagtcagcagatcacctgaggtcaggagttcaagaccagcctggccactatggtgaaatcccgtctctacaaaaatacaaaaattagccaggcatggtagtgggagcctgtaatctcagctacttggaaggctatgggagaatcgcttgaacccggaagacaaaggttgcaatgagctacgatagcgccattgcactccagcatgggtgacagagcgagactctgtctaaaaataaaaataaaaataaataaaacacttgggtggcttataaagaataaaaatttatatctcacagtttggaggtggggaagtttgagattcacgtgccagaagattctctatcagatgagggcctgctgcctggttcatagacaccatcttctcattgtaacctcacgtggtggaagggacaagggaactctggtgcctcttttataaggacgctaatcctattcatgagggctccatccttatgacctaatcccttccctaaagctctaccaccaaatactatcacactggggattaagtttcaacatataaattttggagggggccacaaacattcagtctataacagttgttatttctaggagatcatattctagaattcatgatcctaaaatcatactctgatttttatagtttgcctttagattttctacattttcaatttttatgaggaaaatgttatgaatatttagcaactagttttgattataacagaaggtccacataaaagtagcttctagttcttgtcacgcatgaaatattctagaatgaaataataggaggtctgggatttgcttcaaaatcatgtggggcagaggaaaagtgaacaagggcacaaataagccaagactggccatgagttgctaattgtttcagctggatgattgatgggtacaaagggatttgttacactattctctagtatcctagactttaaacttcataataaaaagctgagaaaacaaatagataaggagagtgaccccagccattaaactctttctgcttcagtttgctcaactgtaaaatgaggatgataataatgctcacctcatgagatagttgtgaggattacatgagttaacatatctaagatgccatgacactgcctgacacttagttaacattatagttgttattatgattgcctaagccaggggcacgatgaccttttcaagctcccaggtccttccatctttctgccctgccatctcaaagtgcgccaccagccatcaatggttatgtgaaattgaagctgctccaggtattaccatagccctgtccagaggcagaaaagaggtcagtcttgccttttgtgtatgtgttcccttttaagacttaggacactttccaagaagcccctagcaggcttccctttgcttctcattggccagggttatgtcacatacccatgcctaaaccaatcactaacaaaacggatacatctaccaagctggctattcactaatcaaaacctacacataggactttgtggaggcccctgaaccatgatgtacaaatgactggaggaagaaaaatcatgggcagtccaacaatagtgacacctcctggcacatttgacagcagtgagtaagttctgtatgactgctgcataagataatatagggaacaggaggagagatgatagcaggacaggtgaattgagatcagtgaaacactaggcagaggacactgcatttttttcctgtaggcagtgaggaaccatgaagattgaggcacaggagctaaggagaacctaataaggatataagaaaaatatcactcatttcatttcaaccaagaattttcctaaagatgatgtgtaatcttatgcaaactatatgcacgtgatatgcaaatctacttattgctccctcaaatgttttgcacgcctggatgtggtgtttgaaaaacaaaaatcttggtagaaacaattgactcagcaataatatctctaagttggttaggcaactagccttggattagatattgatgtcataacttcattttctactggctaagaacttgttttaggttttgtactaatttcctttatgatttgtcttcaaggagcaggtgaatatccacagccctcacaacaaagagtctaccctcagtgctgagtgtcattatccttatgtgaaagtgaattccacatgagtcttttgaagaagccagagcgttttaagatattatttaattacacatgagaaatgcattatttgattcattaaagaagaccatgatgcaaagaggccaacctcaagctattgaaaacctttcaaattaagatgctgagagctttgttattagcataaattttgcttacggggtggggggatgctgtacatgtgatgaaatgcaactgggtcaagaaggagaaattaggaagtatgtttatcacacatgaggctttctagtacttctgaacaagaaatcctgatttcagccagatcttagctgaaatgggaagattatgatttttgtttccatgaaagtcaagcaggtcctgctcctccattgggggaagtaatgtaaaataagttcccatgtacctgatacgtttgtggatgaggatgttctccttgatgtgtagacccttgcataagttattatagatatgaactcaaatttattgaatgaataaataataccaaccctgatttcagccaaatcctatgacttatcagctgaaaatcattgtatattttacatggatcataaattgtattcttcttattattattcgttcacttattcaacaagtttttgtctagacttttttatagtagttactgttctaagcactgggagcacagcattgaataaaccaggcaaaagtctttcttcccttggagtttatattctaatgggaaatgatataaaataaataagataaataagtaatatatatagtacatgtacattgtgatagatgctaaagagatgaagtcggtaaagggaatgggggattggaaagtggtcaagaaggcttgcaatatttgatagcatggttggggaaggcctccattacatggtgaccatgttaaccattaatattatagtattcttcatcaatatttctggttcttctgagcacatgaaaagattgtatttccttgctacattggaattagagatgccaagtgacttgctttggctgatgaaatgtgagtagaagtgatgtatgctgctttgtcatggaagctttaagggctggtatatgattcatcatgctctttctgtctaccacagctatgttccactagtggctgttctgtctgcttggaacctgggatgagaacaatatggagcagaaccaaaatggacatgtattctgacttgttctaaactactgagtttgaggttgcttattactgcagcataacctagcctaatgtgtctaaatgaactacagcaacaattgattgaagacctgaaggaagtaggggagtaaaaagtgtggatttctaggaaggagcactcccagtagtgcaaaggcctcagcgtgggagtctgtttggtattttagactcaaatgaatgaaaaaaaaccatggtaaaagatgcagttcgagaggtgagggacttccagatcatgttgtaccatcctaaggacttttcttctcagggatgtgaagtcattcatagaggagtaacatgatctgacttaaatttttaaaaatactcaaagtggttgttggtttgagcataaactgagatggcggcaagacagcagcagagagaacattaaggaggctatttctagaaatccagggtagagaggagagttgcttgaatcaggctggttgcagcggaggtattagaaatggttggcttctggatatatgttttctataaagccaaggggatttgctgatgtatcagatatgagttgtgtcttagtgcattcctgctgctataacaaaatacccaagactgggtaatttacaaacaaacaatagaaatttatttttcacagttctggaggctagaaagtccaagatcaaggcaccaacaggttcaatgtctgacaagggctgttctcagcttccaagatgataccttctgctgcatccttcagttgagacaaatactgtgctctcacatggcagaagagatggaaggacaaaaggttctagctagttccctccagcccttttataaggcactaataccatccatgagattaaagcctcctaaagatcccacctcttaatactgttgcattggggattaagtttcaacatgaattttgcagggacacaaacttaacccatagcatgttggaagaagaagactaaagtcaaggatggtgccaagattcttatcttaaatcaatggaaggatagagctgctacttactgaaatggagaagattggaggaggagcatatttgttagggtgagctcaggccttagtttcagacggtgttaagtttagggtgaccgctagacttctatgcagagatgtcgaatagacaagaagaccatgttggagacataaatttgggagtcattgatgtatagacagtatttgaaatcattagactaaatgatagcaccaaagggaaaagtgtagagagaaaggtgtagaggcctgaggactgagtttcttaactgaatcttaagaatcagggagaagaggagaaacagcaaagcaggctgagaaggagctgccaatggagtagcaggaagacaacaacaacaacaaaaaaaaaaaaaaaaagaagagtggtggaaggaagagtttcaaagtgttaaattctgcatataggttaagtaagatgaggtctgagaatggacagtgagatttagaaaatggaagtcttctatgacctcgacaaatggtatgttgacagcctggctggaagatgctcaagagataacaagagaaaagaaatggagacaactcattcaaggagttttgttataaaaggaagtttaaaatgaaggtttaattggcaagaaataaagtcaaaagaggattttaaaaaaggagaattaataatgactttgttggctaataggaaagatctattaggaaaaatctgatgatgagagaagagattgttggagcagtgtcttcaaatagacaagagggggtgagatctagcacagaaatagaagagtttgtctttgccaggggttcatcctggagaaatgagaatagatgcagggaggtggttgtgtatggagggggagtatgtggaagttattctctgaataattctattttctcagagacgttggaagaaagttcatcagttcaaagtaagaacggcagtttaaggagaaatgagacagtgtaaaatagcttttgagaacagtggggaagtaaacagattacaaaagtgtactgattgccagtcagcattagagtaagtaaaccagccaggtgcggtggctcatgcttataatctcagtactatgggaggccaaggcaggcagatcacatgagatcaggagtttgagaccagcctagcctacatggtgaaaccctgtctctactaaaaatacaaaaattagccaggtgtggtggcccatgcctgtaatcccagctacttgggaggctgaggcatgagaattgcttgaacccaggaggcagaggttgcagtgagccaaaatcatgccactgcactccagcctgggcaacagagtgagactctgtcttacaaatatataataataataataataataataataataataataataataataaagtgaaccagaatttaatggaagaccaatgagtgtggtaatgtgagtcatatttagttgtgtgggtgcaagctgggagtaggtagagagatgggattacacaggtaggggttttgccagagtagtacaatgaagaaagaaagagtcaatacaactgagggtttaggcaagggtgcaataatatcatacttaactatggaattcaagctggccaaaggggtaagtaaagaaatgagtagggcacattattgacaaaatgtgttcagatcaatgaattatgaaaacggtaggagtggctatagatgactgagtgcctacaagatactatcactgaagtaggtgccttacattaatccatgctagttctcacaacaatcttgctggtattataattccaaatttatatattgctaatagactgacctaatatgttgtgatcacaagaaaagtcatggcattcaatcagttatcatttcaatatccagtattcagtgaacatatctgggtcagcctgttttacattgctttaaaaaaatctgagactgggtgatttataaggaaaagaggtttattttggctcatcgttctgcagattgtacaaaaagtgcaacaccagcaactgcttccagtaaggactcaggaagcttttggtcatggtggaaggaaaggggaaccagcatgtcacatgcaagcaagggaacaagagagagaggaggtaggtcccagactctttcaacaaccagatctcatgtaaacttattaccatggagagggcaccaagccattcacgacagattggccccatgaaccaaacacttcccaccagggccttaccaccaacattgtggatcacatttcaacatgacatttggagaggacaaatattcaaactacatcattccattcctggacctcccccaagtctcatgtctctctcacattgcaaaatacaatcattcattcccagtcatctccaaaagtcttaactagctccaagcatcaactcaaaattccaaactccaaagtctcatctgagactcaaagaaagttccttccagctgtgagcctataaaataaaaaacaaattatttacttcctatataaaatggtggtataagcctaaggtacacatccccattccaaaagggagaaattggccaaaataagggggcaacaggcctcaacagagatccagcagagcagacactaagccttaaagctccaaaataatcttccttgattccatgtcccacatcctgggcacaccagtgcaagggttgggctcccaaggccttgggcagcctcatccccatggctttacggggtgcagcccatgtggctgctctcacaggttaaagtcaaatgcctgcagcttttccaggttgaaagtgcatgctgctggtggctctaccattctgggatctagagggtgatgatcccattcccacagctccactaggcagtgctccagtgaggactctgtgagggctccaatctcacatttccccttagcactgccctagtagagtctctctgcaggggctccacctttgtggctggtttctgcttgggcactcaggctttccaatacatcctctgaaatctaagtggaagttgccaagcttctttcactcttgcattctgcatgcctgcaggcttaacaacacaaggaagccatcaacggttatagtttgtgtcctaggaaagagcagcccaagcagtatctggggccctttgagccaaggctagaaccagagctgctgggattctgagagcagcatcctgaaatggtacggaatggtggcacacggggcttggcccctaaaatcattctttcctcttaggtctctgggcctgtgatgataggcatggcctggaatgtttctgaaatgcctttgaggccttttccccattgtctccctgtcttcttctgagcccttcaaactcctccaacctctgtctgttacccagttccaaaactgcttccacattttcaaatatctttatagcaacaccccactcctggtaccaattttctgtgttagtccattttgcagtgctataaagaaatatgtgagactgggtaatatgtaaagaaaaaagatatattttggctcatggttttgtagactgtatgagaagcatggtgccagcatctgcttctggtaaggcctcaggaagcttttagtcatggcagaagggaaggggaaccagcatgtcacatgaaaagagagggagcaagagagaggggagggaggtcccagactctttttaacaaccagaactcataactaggtaaagggcaccaagccattcatgagggatatgcccctataacccaaatacctcccacctgccccaccttcaacactgtggatcacattttaatataagatttggagggaacaagtatccaaactatatcaatattcaatataaataacaagtgtcatgtggctctagaaaatcagaagaagctggaggtacacttacagatcttaagcaccaaggaaatgcaaagtccaatccatacaaaccaggacaggagttacaggcttcttagaatatatacattgaaattaatataaattgactctagggacaagggctacccaaacagccctctcttgaaattgatttgcagctataaataaagcttaccacatccaactaatcggagtgaaaaacaagaatccagccaacatcctggctgaaacatacaagcaaactcaaaaagcaaacccatgtattacatgggaagatgcaacaggagtctaagctgaggcacaagaggagtgttacaccaggtatctgtagctccaggtctcttagttgaaaggaacttcagtgactttcaatgattatttgtatagatgaattgtttaatattaatatttcacactaaggaatctatgcaagttttatatatttctaacattggcatgaatttggcctatagggtgacggtcttataactccaacttaaattatgtactcaaaacccttattagatttgtggttttaatttgaagttttactaaatttacatactatattagaacatttaagagaactacagttttctatatttacaaatttaatttattagacacaatattttaatactaagataagttttaagttagacaactgaaactcttaagaaatcaaatatattaaatgtataaatgcactttaaaatatttgaagatgtttaattaaccaaacttgtaaatgagaccaaaccttactcataggctcccttaaaaatgattgctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagattgctaaaatttgctagacttataaatggatcaataagatttaagctacatttaaaagcttaaggacacacagccaggcatggtgcctcacacttgtaatcctagcactttgggaggccaaggcaggaggattgcttgagcccaagagtttgagaccagcctgggtaataaagtgagaccccatctctatagataattttttttaaaaaaattagccaggcatggtggcacatgcctgtggtcccagttacttaggaacctgaggcaggatatcacttgagaccaggaagttaaggctgcagtgagctgtgtttacgccactgcactttagcctgggcaacagagagagaccctgtctcaaaaaaacaaaacaaaacaaaacacagaaaagaacaaagcttaaggacaaacccaggttttaaatttgttactttaaagaatggaaattcattttaaaaagcaaagtaagccacggattaatctttctgtgtactaaaactgctttgagaataccaaaaaaaactctcaacatatatgaagaaactgagacagacagttactaagtggcagagctggaatttgattccaagtttgccaactatgaaaacccatgcttttctcatcattcttcattgccttcccctgacaaataattaaacaacagtaacatacaattagcataaaacttgaaaagaagagtttgttctctctcctgtgtcctgcaatgccttagggttataattatattattaccctacagtacagactgtgctggagaaggtgttttaaggattgggccgaattagtatcactttaattattacataccctggaaatagcttttcctactaaatccctaacgttggcatgtgtgtatatacttttccagtttctcataaaagtagagtataaatagaagaaatccaataacctgtggctgattatttaaactatgtttgttttatagataaactggagattgctgtcctcaagctttttccttagattggttctgtgtgtccctagggaagacagattgcatggagaggtgttcctctttatgcattctaatgaaaaccaaaatccaaatccccaaacagataagatctgattattctcattagcagccagcactactgaagctccaatcagggcacccagcccgctaagcagctgccctctaaagatccacctaatgcttgcagagctgtttgagcttctccatctacagcttgttcggtggtgtctgtctctcattgtttttgcattttctgttaacaaggaggaaagtcggtaatggctgtgggggacacagttggtggtcttctcagttgcccttaaagcccttcctctttgctaacagattcccagttttgttgagacaggcagcccacggaagagctgtgattatcccattcttctttgccagtgatgtgtggaggtggacatgtgacctagtttgagccaataaaacataaggataagactgcaggcttggataagaggcctctggaaaacatttcctcccagatataagagggatgttttgagaagtccctctggtcatgccctccatcctgcggggatgctgtcctttgaacaaggcatgcttggagttcagtagccaccttggtactgtaaaaggtagaattttcacttacatcagcacttgccttgttgataccaaaccttactgttgtattttattcaactgtttctaagcagcagtacctgatgaaggaccttgagttttgagggactccaggaaccagacccttactggacctaactgaagactctgtgatgattgataggcagtaagactggttttaacaaattgcaggcaggcttatagacttgttctgctttatccagtatgagtttggtttgttgtttaaatttcctagcaaaagtacagtggcgcaatcatagctcactgtagcctcaaactcctaggctcaaaaaatcatcctgccttggcctcccaaaatctgggattacaggtgtgagcccctgcgcccagctccagagtactagttgttaagccttagttaacctaaccaccatgaaccactcccttcttactcagcacttaacaacccctgtctcttcccccttaagaaacttctcagtgaattttttcacaaatactgtgttcctttgactattaatttaagagattcacattttttctaaacacaaaaacaaaaaaaccctggtgtctgttttatttgctcacatgactataagagaaccacagaggtaattttccagctccctaacttcatgatgttgctgaaccaacctcaaaactatccactactaggcttcatgctaagaaaacctcaaatatctttacatttcatgccagggattgaccaactacagcccacgggccaatcaaaaagttatatggagcacagtcatgcccattgtttacagatgtctatggctcctttcacactacactggcagagttgaatggtggcagtagggacaatacagcctacaaaatctaaaacatttactatctggccctttaaagaaagactgctaatctgagttttcagtggtgttagttgggttttctgatccatgatgttgctaacattatgctacattatgatacagctacattttggctacttcctctaatttctggattttcccagtaagctcccagtaagattgtaagttattccccacacactgattgatccatagtggatcaaggactgaatctaatacctacttaatctaaaactcttgtacaaccgaagtctctgctatccagacatgcagctctttctcagatctgtgaccaagccatgatctgtctcaacaggaatatcacacatgtagtctggaacaatcatataacttttcccttacccttggataacttctattcttttttttattctttacaacttagctcaaatgccattttctttcttttttttttttttttttgagatgaagtctcactctcttgcccaaactggagtgcagtggcgagatctcggctcatggcaacctctgcctcctggttcaagtgaatctcctacctcagcccccagagtagctgggactacaggcacgtgccaccatgcccagataatttttgtatttttagtagagacagggtttcactatgttggccaggctggccttgaacttctgacctcatgatctgcccgccccagcctcccaaagtgctgggattacaggcgttagccaccgcgcccatccccaaatgccattttctaaggaaagcttctctgacccaccaaaataggtcatgttcttgttttatagtttcatgggaccctaaccttttccatcatagcatgtgtcaaaaattgtagctaaggcatgaattgtgtaattagtttttaatatcatcagctttctttgtagaatgaaagctccataagtgtagggactgtgtgtattgtctatgttctttatccctagtgcctagaaaattaagatatataataagtgattaatgaataagtgaatggaacaaacactatcaatcttactttgaaccgtgtgaagtcctaggtcctttagcatgtccatcatccagaaatataaatgagattcagttgtgttagactggtatgttttatgtgagtctaggagtgtcctgataagtgtgtcaagatctggcacctcaatcacccaacaatgaggagccagcgtgctcctcatttttctaatataatatttcaattgccttctccattcacctgctgatctttcattcatgtataccaacacttgctcacccacagaaaggtagagttgccactcactagctcggagcccttgcaggctacttaacctctgttttctcatctgtaaaaggaaggcaatggtgtgtagattagagacttctcccactgtgaagaggatatataagcttctgcctaaactcagacatcatatctgaaataagaaggaagaggggaaaccaccttcagatagaagaggccgtcctgatagccctattcatggaatccgctaatattacctgaaaccattttaaacttaaagagactgcactacctttcactggcaagtctgaagttttcccctccatcataaggaatgggatcttgagattaaaatggatctgaggataatgtcactttcagttataatgacgagttccactgagtttaaatcaaagtttcaatctcacttccagtttaaaacttctactctgcccattatcccccagtatgcaaccctcaacataggcctgagtcatggtcaggaattttcggtggggagtggggcgtgtgttgctgggtttgttctcctccctctactggctctccaaatttgaagtggaagggagagaaagaggaagagaggaaacattgcttttaagctatggctgctgttttaagtctcctttggctaacactgcctgtttcccattggagttttctataccctgggtcttcaggatgtttggatgtgtggattacactgaggcaccctgagaacctacacactgagcagctccctgacattggctttagcaacacacactccagctcatagcttccagtcctccaactccagcttttgcaggttccctattgccattttctgctggagtgaccttcaaggagctttaaacccagtgactttctgaaatatcctcttggcacttggaaaactcatgcatcccttccatgctgaatggtagagccagattgttcctctgttgctctttctctttgccctgctgctgcaagctgctcatccagcctcccaccttcacgctgcttaagacaagaagtaggcacaattctgtgttctcatgtgccccacctccagggaaaggaccacgtttcaagcccccaagaaccttcttgctctcttctgcctgagaagcagcacctgcatgggcctgggagtgtctataactcagccagcgtctggccaagagtgagaggccagactctctttcttgtaggcagcaccagcttcttggaatggttctcttagagctactctcattaggctgtgaggtgaggaaatataggaaaaggcaggagcgatgacacaacagtccccatttaatcaacaactcatttctatgaagttcctactttagcaaactgagtttgagttttttgtcttttttcacataggccgatgggctgatggggcatcataagactatctggtccaccttttaatagtctctgcaggtatatgcctagcatctcctcttcataatgtgattacccttgcagcaattgcttttaactttacacctgtaacctagagtccaagacaagaagaggtaaatttattcaaaaaaagtatatgcatatatatatatatatatacacacacacacagatctattttaccaaactttgaccatattgttatttttttattattattatactttaagttctagggtacatgtgcacaacatgcaggtttattacataggtatacatgtgccatgttggtttgctgcacccattaactcatcatttacattaggtatttctcctaatgctatccctccccctgccccccaacccaccataagcccccatgtgtgatgttccctaccctgtgttcaagtgttctcattgttcaattctcacctatgagtgagaatatgcggtgtttgggtttctgtccttgtcatagtttgctgagaatgatggtttccaggttcatccatgtccctgcaaaggacatgaactcatccttttttatggctgcatagtattccatggtgtatatgtgccacattttcttaatccagtctatcattggtggacatttgggttggttccaagtctttgctattgtgaatagtgctgcaataagcatacgtgtgcatgtgtctttatagcagcatgatttataatcctttgggtatatacccagtaatgggatcactgggtcaaatggtttttctagttctagatccctgaggaatcgccacactgtcttccacaatggttgaactagtttacagtcccaccaacagtgtaaaagtgtttctatttctccacatcctctccagcatctgttgtttcctgactttttaatgatcaccattctaactggtgtgagatggtatctcattgtggttttgatttgcatttctttcatgaccagtgataatgagcattttttcgtgtgtttgttggttgcataaatgtcttcttttgagtagtgtctgttcatatcctttgcccactttttgatggggttgtttgtttttttcttgtaaatttgtttaagttctttgtagattctggatattagccctttgtcagatgggtagattgcaaaacttttctcccattctgtaggttgcctgttcactctgatggtactttcttttgctgtgcagaagcttcttagtttaattagatcccatttgtcaattttggctctcgttgtaattgcttttggtgtttttagtcacaaagtccttgcccatgcctatgtcctgaatggtattgcctaggttttctgctagggtttttatggttgtaggtctaacatttaagtctttaatccatctggaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggcgttatttctgaggcctctgtccctttccattggtctatatctctgttttggtaccagtaccatgctgttttggttactgtagacttgtagtatagtttgaagtcaggtagcgtgatacctccagctttgctctttttgcttaggattgtcttgccaatgcaggctgttttttggttccatatgaactttaaagtagttttttccaattctgtgaagaaagtcactggtagcttgatggtgatggcattgaatctataaattaccttgggcagtatggccattttcacgatattgattcttcctatccatgagcacagaatattcttccatttgcttgtgttttcttttatttccttgagcagtggttgtagttctccttgaagaggtccttcacatcccttgtaagttggattcctaggtattttattctctttgtagcaattgtgaatggtagttcactcatgatttggctctctgtttgtctgttattggtgtataggaatacttgtgatttttgcacattgattttgtatcctgagactttgatgaagttgcttatcagcttaaggagattttgggctgagacaatggggttttctaaatatacaatcatgtcatctgcaaacagggacaatttgatttcctcttttcctaattgaataccctttatttctttctcttgcctcattgccctggcaagaacttccaacactatgttgaataggagtggtgagagagggcatccctgtcttgtgccggttttcaaagggaatgcttccagtttttgcccattcatattggctgtgggtttgtcataaagagctcttattattttgagatatgttccatcaatacctagtttattgagagttttcagcatgaagggctgtgaattttgttgaaggccttttctgcatctattgagataatcatgtggtttttgtcattggttctgtttatgtgatggattacatttattgatttgtatatgttgaaccagccttgcatcccagggatgatgccaacttgatcgtggtggataagctttttgatgtgctgctgtattcagtttgtcagtattttactgaggattttcgcattgatgttcatcagggatattggtctaagattctctttttttgttgtgtctctgccaggctttggtatcaggatgatgcttgcctcatagaatgagttagggaggattccctctttttctattgattggaatagtttccgaaggaatagcactagctcctctttgtacctctggtagaatttggctgtgaatctttctggttctggactttttttaattggtaggctattaattattgcctcaatttcagagcctgttactggtctattcagagattcaacttcttcctggtttagtcttgggagggtgtatgtgtccagaaatttattcatttcctctagattttctagtttatttgcatagaggtgtttatagtattctctaatggtagtttctatttctgtgggatcagtggtgatatcccctttatcattttttattgcatctatttgattattctctcttttcttctttattagtcttgctagcagtctgtcaattttgttgatcttttcaaaaaaccagctcctggattcactgattttttgaagggtttttgtgtctctatctccttcagttctgctctaatcttagttatttcttgccttctgctagcttttgaatgtgtttgctcttgcttctctagttcttttaattgtgatgttagggtgttgattttagatctttcctgctttctcttgtgagcatttagtgcctaaatttccctctacacactgctttaaatgtgtcccagagattttggtacactgtgtctttgttctcattggtttcaaagaacatatttatttctgccttcatttcactatttaccccatagtcattcaggagcaggttgttcagtttccatgtagttgtgtggttttgagtgagtatcttaattctgagttctaatttgattgcactgtggtctgagagacagtttgttgtgatttctgttctcttacgtttgctgaggagtgctttacttccagctatgtggtcaattttggaataagtgcaatgtggtgctgagaagaatgtatattctgttgatttggggtggagagttctgtagatgtctattaggtctgcttcgtgtagagatgagttcaagtcctggatatccttgttaaccttctgtctcgttgatctgtctaatattgacagtggggtgttaaagtctcccattattattgtgtgggagtctaagactctttgtaggtctctgaggacttgctttatgaatctgggtgctcccatattgggtgcatatatatttaggatagttagctcttcttgatgaattgatccttttaccattatgtaatggtcttctttatctcttttgatctttgttggtttaaagtctgttttatcagagactaggatttgcaacccttgcttttttttgctttccatttgcttggtagatcttcctccatccctttattttgaaccaatgtgtgtctgcacgtgagatgagtctcctgaatagagcacactgatgggtcttgactctttatccaatttgccagtctgtgtcttttaattggagcatttagcccatttgcatttaaggttaatattattatgtgttaatttgatcctgtcattatgatgttagctggttattttgctcgttagttgatgcagtttcttcctagcatcaatggtctttacaatttggcatatttttgcagtggttggtaccagttgttcctttccatgtttagtgcttccttcaggagctcttgtaaggcaggcctggtggtgacaaaatctctcagcatttgcttgtctgtaaaggattttatttctccttcacttatgaagcttagtttggctggatacgaaattctgggttgaaaattcttttctttaagaatattgaatattggcccccactctcttctggcttgcagagtttctgccaagagatctgctgttagtctgatgggcttccctttgtgggtaacccgacctttctctctggctgcccttaacattttttccttcatttcaactttggtgaatctgacaattatgtgtcttggggttgctcttctcgaggagtatctttgtggcatactctgtatttcctgaatttgaatgttgtcctgccttgctaggttggggaaattctcctggataatatcctgcagagtgttttccaacttggttccattctccccgtcactttcaggtacaccaatcaaacatagatttggtcttttcacttagtaccatatttcttggaggctttgtttgcttctttttactcttttttctctaaccttctcctctcacttgatttcattaatttgatcttcaatcactgatactctttcttctgcttgatcacattggctgtgaagcttgtgcatgtgtcacgtagttcttgtgccatggttttcaactccatcaggccatttacggtcttctctacactgtttattctagctagccagtcgtctaatcttttttcaaggtttttagcttccttgcgatgggttcgaacatcctcctttagctcagaaaagtttattattaccgcccttccaaagcctacttctgtcagctcatcaaagtcattttccatccagctttgttccattgctggtgaggagctgcattcctttggaggagaagaggtgctctgtgttttagaattttcagtttttctgctctggtttctccacatctttgtggttttatctacctttggcctttgatgttggtgacctacagatggggttttggtgtggatgtactttttgttgatgttgatgctagtcctttctgtttgttagttttccttcgaagagtcaagtccctcagctgcaggtctgttggaatttgctggaggaccattccagaccctgtttgcctgggtatcaccagcggaggctgcagaacagcaaatattgctgcctgatccttcctctggaaactctgtccctgaggggcacccacctgtatgaggtgtcagtcaacccctacttggagttcgagcttccctggccactttgtttacctactcaagcctcagcaatggcggacatccctccccctgccaggctgctgccttgcaggttgatctcagaccgctgtgctatcagtgagcaagcctccgtgggcatgggacccactgagccatgtgtgggatataatctcctggtgtgccgtttgctaagaccattggaaaagcgcagtatttgggcgggagagtcccgattttccaggtactgtctgtcacagcttcccgtggctaagaaagggaaatcccccgaccccttgcacttcccgggtgagtcgatgccctgccctgcttcagctcaccctccatgggctgcacccattgtccaaccattcccaaagagatgaaccaggtacctcagttggaaatgcagaaatcactgtcttctgcatcaatcgcactgggagctgcagactggagctgttcctattcagccatctttgaccatattattttataagtcacttcttaaacttaagaatgtgttataatatttcccatgctacaaattgggctttgaaatattatttttaaaagtggtgagaggcagacctaaagtcctcacagcatcgataatatttcagctgagtctaaaagggtgagtcacagttttccagggaaggcaaaaggaagccctcatattgaaatatacataggcaagaaagaacactaaatacacaaagaacttgggagggtgtcacagagacctgatatatacaatcgcatgaaatgcaaggccaagtacttattattattattgattttactttcaaaggaggaaacagaggcttagagagattataggatttaccaaagagcagcaatccagttggtggccaagtcagaattccaagtcaagatttctagcacctaaaagggaactgaatgtaagaaggaaaggaagatcagtgaaaggaaatcaaggaaacccaagtcatgatgagggagaagaaggggtgccctaaacctgagtgagtgggaagaaaagaaaaaccctccactccattcctaattcagtcccttttgttctcagagaagcctgggaagttgaccgccagtctgtctcatctgatgagtgaagtgtaataaatgtgagctttgcatttttgtacaaatgtgaaatactttccaaaattagccctggtccaactgttaaaatccccaagttcccaaactctctcaacaggaaacaagctgtggacatccagatgtttctcctcacagtgtgttgtctggatagtgtttacatttatctttttcttgtcaaatcatgactttgtaaaatgctttattatggtgattgatcatttgcacaacagtgctaagaaagagaactgagggaagtgtgggtacagggtgacacatgaatgcatagccaatgatccatctcagaaaaccatttctgagagccatgattccagcaagtgcccagagttaaaacatcaagtgtgtgactcagtgagactgtcccttttctgtatgaagagaattagcccaaggagcaaccttgatgaatccactctttggcagttaagaaggaaacggatctatccacaaatcatggaatctaccaaaagctatgtataccaaaagagcatcttcctgcaggaagagagctaacagaaacttggaatggtgagtaacaaataggctatcacctttagttatcccttaccttgcgctaggcattttgcatacattgccttatttaatccttgcaacaatcctaggaaggaggtactgttttcatgccctgtttagagatgacgaaactgaaacccaagaaaggttaagcaacctaaaattacacacccagtaagtgactgcactgggaatccaacctaggtatatctaagtccaaagagatgggattttgcctccatttccaataaggcaagggttgtccttttctctgttggtaactattgaatgagagtcaccttctccactcttacctagggcagctattttgcttagaagatgggtcacttttgatcacatttcttgtcttcctttttggccaccattgtttcattctttccctgaatcccaaagaaagatataagaggccaacagaatatacctgccaggtcatagttattagcaatgaaaaaaaaaaaaaaaagaatttaaaaccccacaaaaaacaccagctatagagttggatcctggaagcctttctcctgccagataacagtgaccaaagagatagcttgtcagactttcaactgctaccacatttgattaattggtctttcccctctttaattaattggtctttcttcctttttaattatggttttagccaaaactccatgctgttcatcctactgttagagggaaagaaggaagaagaaatgaagataaatataaccaattttatttggatctgctatgtctcattagcaattttatagttttggtatagagtgatacttagtacagaaaaagcagtttttctttctttaaaaacaaaacaaaacacaacacaaccgaatgtttaattagttagtcccctttggcctagctagagaaatgcctatagctgacatgcacattacagtatgtaataatgggcgtaaacaaaagtcaaacatctgctcaccagacctgcccctaagtcttcttcttaagcaccaagggaagcatctcaagttgactttgcaggaatgctggattctctgtagtgcttttgcctctcacctttcttgggagtttataggggactttgaagttcctctgaacaaacagggtctctgtttcacttattgctgagccaaccctggggccttggttccatcagctccttattaagtgtttagtaatttcagtttccaccttttggtcttgctcgctttgcaaacatctggagagaattagctcccaggcctctgtaccatacccattttgtggttctagggagacttgtgtgctaggggatgttgttgcccttaacgagctttctttatggtgtttaactgtaaaaggtaccctcgttaatattaatagacaaagagaaagcaaggccactccactcgtatttagcaagggcttgactatgagtgagaacttcatgccgaagtgggaataatgaataccatgaacacgagattgaagtataagataaagtaaaatatcattatcataaaacgtctggacacttgaaatgagtctaagtctatacctatgctattcaatataataactactaacctcatgtggcttttgagcattggaaatgtggctagttcatattaagatttactataagtataaaacatacactaggttttaaagacagcataaaaatgtaaaatatctcattaatgacttttatattgattgtatgttgataatactttggagatagtaggttaaatgatatatgttaagattaattttacccatttctttttacttttcaacatggctgttagaaaatgtaaaattacatacatggcccacatttgtggtttgcatcatgttttcattggacagcggtatactagaagataagaaaaattattccacaagatatgattgggacatgcaagattctgtgactcggaatccatgtgacattaaagtaaacagcaaaaatatcaaaaaggttactaagaaaatgtcatcctgacaccacagggaaaaaaacacacaaaatttaaaaacatatataaaaataaaaagaaaagaaaatgttattctgaatctcaacaaataagaaaagacagctatcagaaattactggtcaggttttttttcagggaaaaattctagaatcgattactaaatacatctatgaacaagttaggaaataagaagatgattaccagaaactggctgagttccctaaaaacaaggcataccacattaaattcattaccgtttttgattaagtgactgggctgacacatctaaggaattatagaaacatacctgatttcagcaagctattggacaaaccttcttatggtatgtttgtggccaaatttcagaaacttgtattgtgtaatagtaagctggcaaaacccaactggttgaatatttgtaaatattatagataaccttgaaaatctacttataggatggtctatgggagagatcacaaaactaaaaattagctaaataaatatgatcaatatcaaaatcggtactcaaaaaataatgcatcagtaataagaatatggcatataaccaccatcaaagtaaaatgttgagttcctaaaatgaattgtgtaggtacagcactaagctggcccactttgaaaataatgtgcataaaaagaattattttttttctaaagtacaacacaaactaaatgtgtagtatgcttgtgaagaagtatgggaagcagtagtctcagtttactgtactaaactggctaaatccagaatattttgttcagttcttggataaccacaatggtgaggaggtgttaacaattagaaaatgaaagccatgcagctcaacaaagaggagctctgggaacaacctgacagctatgctcaatgccatcacttggagggtacacatgttctgctttgctgcaaaaaattggtggatccaagaacaactggggggagttacagggaaggcaggaacagatcattatgaaaatttgttgaataatcttggagctctccacgagaaagcatgccttggaagataataagtgagctccctttccttaagagtgttctgtagaaaccagatgggcattcatcaggaactttatagaagagacttctcctgtggcaggaaggttaattaagtgaaatctttatattttcaactcttaggctagaaatcctattatcagtattgggagactaaagataactctgcaggcttctactttggtccaattaagctaaatatcatctggaagcttgctagcaaattgtgatgcaccagaaattagactatcaagaaatgtagcacacaactggctctgtgcatgtatttgggagtggggaggcgagggagcaaagctccaatttgtaatgtttgccaattactgtggtgtaattactcctaccatggcaaactttaagctacccacggttgaataactgtgagttagttcctgaaaatgtaacacagctctcacaagccagtatgaggtgactcctgcacaccacttccagcttgtcacttggcagtcagcatacagtgtcaagacaaaattgatcagtccatcatatatttaatttgtttgtttgttcttgttttatgtttgctatgggtcccacattctgaaaagtgctcataggtgacatggtcttcttcctcaaagaatgtaaggctaacagggaggagcagtggtggtggtggcagtggagggttaaagattaagatgcacagagaaaaacagagtttttaagacatggaatgggcggaacatgaaggtctgtgctagtggagctcaggaagcagtgaagggacaagagctaatgtttatcaacattgaaaggctcatgtgctgggtgagccaccactttttacatctcaagaaacataatcataaccctgtgaggtagcttttgtgcccattgtatggatgaggaaccagaactcaaaaacatcaaaatatgtacctgcagctcacaactgatagcacaatccatcggagtctgcagatcaaatccatcccgccactcactcctttgcattgtcagggaaggaggaaagtgaagactgaagcttagctggaaggatagatagaatttaaatgcttccttcaaaacaagaagcctgcaaagcagagaaatagtcctatctgtctgggaggcagcctgctgcagttgacttgaacagctctttgaggccactgtcgcttctgagccatagctgatttagaaaacaaggcaaagaagacagcaatgaggctatacctcaaaccctgcccatctgcactaaaacacctcccactgccactctatcaaatggacttggtcgtgggttttgagattttgctaaaaattcagtatgggtgaagtggcatgctcctgtaatctcagttacttgggaggctgaggcagggggatcgcttgagactaggagtttgagatcagcctgggcaacatagcgagaccctgtctgaaaaaacaaaacaaaataaaaattccagcagtatgagttgggaaagttaatagctctttgagcatcagtttcttcttttgtaaataaaaagaaatatgcctgattcacattttgttgagaagacttaatgtgctaattttataaaacacctagcacaatgcctggcacagagtaagcattcgataaatatgcgatccctttccctccacacagttgcacagttgcctccctcgctggactgtcatatgcatatatgcatctttgtgtccccagctactagtacagtacctggcaaagagtgctaaagtacctgggaaagagacaggtaaactctgtctacatacagtgctgattcattactctgggctcagaaatacttcttaggttaaataaaacaagtatatatgcacatgcataaatccattgtagtgtcaagtcagcgtgtgctttctcagggctggtcatcccatgcacataaagaagcgccaactctctggcaaggcatcctggtgggccactctctcagtctgaaagctgccttgatttgtttacttcaacaaggtttcatctttctgccatgttttctttttcattctggtgcgctgtgtgtcccattaccttaacaagtgatagtgcttgagttgccactaagggtccgaaggaaaagtgttgtgctggatgccagtgttcatggattgtggcagcacaaggcaagttcagtctaggaaacaggtaacaaagctcacgaggctgttagggaggtctgatttttacgaagggcttcgtgtccatcactgaagcctggaggattgactagtaattgtatgaatgggatctggaaggaactatggtctgaggcttgtcatgacttcaggggttggcaccgtacaaagccccataaggatcacgcaaaggcacccaaccgtgctaattcaccctttccgggaactcagctcccccgcccagtattgcttgccagggtgtgcccacaggcactccctgcatgtggctgcaggaaccaactatgaaatccacctatgtgttttctagtgaatctggccctgattttagcagacagcactagctgtcatctggtttttattaaattccataagtaagagagtaattcacactctaaaatgttacactatgtaaatagtgagactgattgaaaactattttgttattttctgcttttctctattttgtgaattttctttaatgagcattgagtactattttatatatatatgtttacatatatgtttatatatatgtttatatatatatatatatgttttaattcaaaggataattcatggcagaaacagaagtatagggacagaaatttccattaccggaggctttgagaaccatattcctgcagctctaatgaacagaaagtcatttcactgggatgttttcctccattttctgtgaatttgagtgagcttccttccaagaatgcaattgaagactgggacatacatattgtaaccagtagcatgagttattgattgaattccctggcacttcctttagtttgaattctaggtagagttcttggaaagtgatggcttttcgagagctgggcttccctagcatggaatgacaagtcacataacagctctttgtccagtcatatactgagcatcacctgcgtatcaggcactgtgctgggcaccaaagatggaaagataattcgtgtcttcactgtagtaaggtagataggggccaggcatggtggctcacacctgtaatcccggcactttgggaggccgaggcaggcggatcacctgaggtcaggagttcaagacctgcctggccaatgtgatgaatccccgcctctactaaaaatacaaaaattagctaggcatggtggcgcgtgcctgtaatcccagctactcaggaggctgaggcgagagaatcacttgaacctgggaggcagatgttgcaatgagccaagatcatgccattgcactccagtctgcgtgacaagaacgaaactcagtctcaaaaataataataataaacaagaaaaaaataagaaaggtagataggaacacaacatagctgtactaggggtgagttatgtacaagagggtgtgggtgagtggccagagcaggtttcacagaggccaggacatgtcaacagtcttcactttagagtaggaatttgctaagaagaccagaagtctggttggctggcaaagagatgggtcagggtaaggggagtccagcagaaggaaaagtatgcatacaagcatggaagcatgaactggctggcctgtgggatcgtcatgaccccaggatcaaactcatataagtttctccaagacataacagttcttgtctcaagtaagacactaggagagtaggccactaggagccccaattccatcaaacacctcctagccctgtcatgcacccagcataagcacaggggatgatacaagaaaacagtgtgatatcaccatcccaagttgctgcggatcagagagctgtcttactgtgatgcttaatttttggtgaacttacagaaaaaaattcaaaaagtctgaggctgcccattaggaatgagaaattgcatatgagggttagcatgctaattatgttttgtgtaacctactggacacactgggatggcttttcctgaaagaaattatctgagtcctaccttaccacctagacaaacgggaaaggaaagggggttgattccaccaacagtgtgtgcttgtgacttaggcggctttccagtcgaagaaatacaaataattgtaaggcaattttaatctttactgaactctcttgaagcctatcaaacggaatcccaaatgcacagcaaaacatcttaaaattgcctttccctatctctctcaagtcatatatatcacacgtttatggctctctcctcctaatttttttcctccctctttccatattcctcccaaactctcttaagctcaactacaagaacacttgtcttttcaccccagccccattccccgctttctggatttattcctctggtggctagtagatctctctcctttctaaagtaaatcaatttcacatttctgcccccctacaccaatcaacaccacattatttttatatttgtggcagaggtttaataggtagaacaaggggatgctttgcagaggctagaacactcaagagaaagatttgttttctttgtcatttgaacagcaagcatatataaaccatgctggtaaagtttctttctggtggctcccatattttaggttactggccaccctaaaaacctaagccctaaaaacctgttaccttcccatgtaacagaagcttaatgtaaatgactttcataagcctgtattcctttaacttatttttttcttctttatccatagcagatttaagtctggattccttgactcatccaaagtggttaagtgcaagaatgctatttttttttaatgcctgtcttccccattaactcccagagggcaggggtattggccatctaggtgaccattagcactgtccctggaaaatggaatacactcattaattcttatatttagcatttgttgaagggaatttgaatgtgagcataaatttcttaaaggatctttcagtcccttgaacaaagtgtgaaccaagtgtcatccaagttatacaacatggagtacatacaattgcatttcactctaattcaagcctaagaacaggtgacccaagaagcaatctcaacccctcaaagatttttctccaatacctaatctgcaagccaaggatctttggggtacagaaaaagtcatttttttttctttcctttgagggaagtgacagatacaaagttttcatactcagctcctaactgcccccagctcatcctggcagctgaagagttaatctgctgccacctagtggttcttggccaacctgcgggaaccccagctcacataaggtgagggtgaatggggtgggtgtggactgtctccatgaagaggacaaggttctcaagtggctttgtcttcccacccccaaagtttatctctctctttctctctctctctctctctttctctccctctctctctctgtctccccctctctctctctctcttctctcctctctcctctctcctctttctctctctctctccccttctctggggcctgtttcctgtagacctgaggcaaagcagtagttcaggctgggatttcttgcaagttttccactgtggggtgccgcaacagctgtgaccctggcttgattttgatgtagacttcaagggcgccgtccccagcggggagaacatttttacctcaggagcctattcacattggtagccttggcagggaaagttccagaagctttgattacacaaatacctttgctaggtacaggcccgtcttggcaacctggggagagagaatgtgcacatgggctgattaaaccaaacgacccgtttcctttgccggggctgggggctgggggtcttcggcttggaaatgattttttccttggctgtgttgcctggaaactttgagggtttaattaggactggggaggtttttggctcccgcagctgcctctgctctcccccagggttactgagtgagaatgtgtgcatgcgtgtgtgtgtgtgtgtgcgcgcgcgcgtgtgtgtgtgtgtgtgtcccctgcagtgcaggccaaagccgtctggagaagttaattgtgtaccaaggcagatgtggctctttttatttcaattgatttcagttaataacttttaacctccgaaccgcagtgaggctgcgtgtggtttatgtatcatgtactggagcccagacaactgagtggaaatggtagctattaccttactgccgccatccatctagggccaatcattggaaacttttctaaatgttctcaagcaaatccagaaaggacatcctccatcagtgtctctctggctctgtgaattcctaggaagaagtaagacaagagccggcccgccccaaagcagttatcttatttggtcaggaggaaaaagttggagtaaacaaattaaaatgaaacatttttcatcctttattgacttcagtattctttttattaacctcaacattaccaagcagttactctcccatttggagacttggagaaagaagaagaattttcttttctgcttttctttgatatgtatatatgtttgtatttatttttcaactaccaatgttatacacaaacatgttctggttatataaggattaaatacagaagtataagcccccttgctcacaggcagattttccagctggggtcaaggcaggtgcaggcgcattgtgacccaccctttttcttccttccctcccttttttcttttctgctttcctttcctccttccttcagaggaagattcagagacacaggtctttccttcatggagcatgtggaaatgagctcccacataccatgtgtatttgtttgctaggcctgctgtaagaagataccacacaaaggtctaatatccagcatctataaggaacttaaacaaatttacaagaagaaaacaaccccattaaaaagtgggcaaaggacatgaacagatacttctcaaaacaagacatacatgtggccaacaagcatatgaaaaaaaagctcaatatcactgatcattagagaaatgcaagtcaaaaccataatgaaataccatctcacaccagccagaatggctactattaaaaagtcaaaaaataacaggtgttggcaaggttgtggagaaaagggaacgcttatacactatttgtgggagtgtagattagttcaaccattgtggaaaacagtgtggcaattcctcaaagagctaaaaacagaactaccatttgactcagcaatcccactactgggtaggtacccagaggactgtaaatcattctaccataacaacacatgcacacgaatgttcattgcagcactattcacaatagtaaaggcatagaatcaatctaaatgcctatcagtgagactggatgaagaaaacatggtacatatacaccatggaatattatacagccataaaaaaagaacaagatcatgtcttttgaaggaacatggatgaagctagaggctattatccttagaaaactaatgcaggaacagaaaaccaaatactacatgctcttacttgtaagtgggggctgaaagataagaatttataaacacaaagaaggaaacaaagacgctggggtctacttgagcagggagggtgagagaagggagaggagcagaaaggataactattggataccgggcttaatacctgggtgataaaataatatgtacaacaaacccctgttaccggtgtttacctatgtaacaaacctgcacgtgtatccccgaactcaaaataaaagttaaaaaaaataaaaatacgacgagtaaaaaaaaaagaaaaaaagaaagtaccacagactgggtggcttagacaagagcaatgtgttgtctcacagttccagaggcagggttgattccttctgcgggctgtgagggaggctctgttccacgcctctccctgctcctgtggttcgctggcaatctttgctgttccttgactcgtagacacatcgccctgatctctgccttcgttttcacatagctttcttcctggcactgggagtgacatgacttgactgttttctagggaaccctcactttaggcttctcctcttgagttggtcagatgcccagagaagactcttcaatcccctatttgaagaatgtgtgtgcctggctgctgtgttccgggagccaagtgtgagaagaaggctggaacccaaatattcagtctgctcctctgtagtctttaatccctctgttttcagtacagcatcctcccagacctccgcactctctggcttctctagttcagaaatcccctggttactgtctctagaaaataaatctctcctaccatttacggcagtggagaaggagccatgtgactgcgtggcatgaggggatagggcacggggagagatctaactgcttctaaaaccctttccacccaccctcctttttcagccccatcttcactctcacctccagaggtaccagatgccaccagtcctgcgctgtttcactgctctgaatgtgaaccgagttgcttttggcgtttcccactgcaggctccgtgtgcagtttgatggggtctggcaggccggtcgccagtcttccacagcattttaactttcaacattttgctgctttctttgtttccactttctttgtttttgtgttagtgggtttcaggaagaaagagagctaaatacatgtgtccaattttccagctttacctttaaggccattcttgtgttttaagcagcatgttccagagacattctcaaacccaaaaggagtcatcctatccctgggttatctggaagttttgggtaagtttaggacaagagagtcccttccaagaccctgccatttgcaacaacatgactgaacctgaaggacattagtgaaataagccagacacagaaagaaaactgtggcatgatcttacttatatgtggaatctaaaaatgtcaaatacatagaaacggagaatggaatggtggttactggggtggagaggaggaggaaatagggagacataggtcaaagggtacaaagttgtagctatgtaggattagtctagagagctaatgcacagcatgagaactttagttaagaatactgtattgtggccaatgtggaaggatcgcttgagttccagaccagcctgaccaacatggcaaaactccgcctctaccaacgaaacaaaacaaaaaacaaaattagccaggcatgttggcacgcacctgtagtcccagctactcaggaggctgaggcgggaggatcgcttgagctgaagtcaaggttgcagtgagccatgatcgtgccactgtgctccagcctggatgagagtgagaccccgtttcaaaaaattaatcacaacaatactgtattgcatactggaaatttgctaagagagtagattttagatgttctcaccgtccccattcccccaaaaaaggtaactgtgaggagatggatatattaatttgctagcaatcatttcactatgtatatgtatatcaaaacatcatgttttacaccttaaatatataccataagaggctgggaatggtggctcacgcctgtaatttcagcactttgagaggccgaggcaggtggatcacctgaggtcaggagttcgagaccagcctggccaacatggcaaaaccccaactctcctaaaaatacaacaattagctgggtgtggtggtgtgcgcctgtaatcccagctacttgggaggctgaggcacgagaatcgcttgaacctgggagacggaggttgcaatgagccaagattgcaccacttcactccagcctgggtgatagagcgagaccctctcttgaaaaaaaaaaagaaaaaaaaaaaaatatatatatatacatacaccgtaagagagggccttcaatatgctttatttagtatatgaacatatggatgcacattcgcacacacaaacacactcacgctgcctattttctctacaaaatctacagccaacctgggtggaatatttggattcaccagccagattcttattttgttctagatggaattctctaagattcccccagttccctcttttcccccctcaccaatttattcttgacactacagccaggatgttccttttataaagtaaatgcaattactgtatatccttcccttacttcagagccttcagagaatgtctcctcttcatccttagaataaagtccaaagctctacccttgtcctctaagtcccctcccacagcctgggccctgacgacctgtccaccctcttattagtcaccccttccttgctaagctttgtcttcttggccatttctcagttctgttaagcccttgcatgtgctctattctctgcctggaaagctctctcccctcaggcccccacatacaccaggttaaaccccacactgcccgctgccataacaccctgtacatttgcttccataacactttagttacatgtccaggctagactggaagcatcgtgagcacagtggatttttctgtcttgttcacagcataaccttagtgccttagcaccagacctgacaacatgggaggtattcaatatatttatctaatgaattatactttttaccttaggtttttctaatctttgcgcttagcctcactcccagcacacacttcattctaactttacagttataatatgggaaaacattagctcaatagtggaagtttctggcctgaaacgatgcttgtaactctatttctgaaaaatggggcttagtgcctctccaaggagaaaacagtcctagatggcctcaggacactggaggaggtgactagatatctctacgcttattctgctggctctaaaagcagaggatccccatgattataaagacttaatttttgtttttcataggcaatcagggaagttgcctgatttatgaggattctcataaaatcaactgaacagagatctctgttgcagaattatagttgcagtaagacgtgaaaagatcaccccacatttttttctcattgctttatttacatgaaaaataatttatcccactgtatatgacaattgaaagcttgaaactgaaactatttgtttcctcatctgtaaaatgagaaggttgaactaagtgccctcttaaggctgctctaaaacacgatgatcttattctgattctttataagagctattcacaaaaagcttctgggtttccgaaaatacattgctcttgagggaatcaaatttttattgtggggtttttaaaaaatataaacacctttatggacttggcagggaatcaagtgaagaatagtatggatttcagatctgccaacaatggcaccattctaaagagttcaatagccagcattttaggactcagcatagaaccacctaaaggctagaagggctgaaatcttcagtagcagctttggaattttgcatctttgcacagtagtaaaactgaaataatacctgcccaaatgaaaaggattaagttgactcaaacgttatgaaaaacaaataaataaaaagactgcacaatactttgtactgttatttaataaatatctactcccctcctcttgccaccatgggtacctctctcccccaactgatgttgaatttagccatgcaatttgctttgactgataaagtgttcgtggacatgacgtgtgccttaaatgtgcatgcttggcttagcttcaaccttgtgcactggtggcctgccttgacaggcacatgccctgggtagctaccgtttctttagcctagacaccaaaaaaagcaaatatggagcaaatacaagcacagaacttcccagatgacctcagccaaactcagccaaatcctggttgatctgcaaacctttgaacacagaataaatgtttgttgtttttaagccactgagttttaaggtagttattacgtagcattattgtggaaaaagctgactaatacagaatgcaatatggattcttgtgagatactataacatcatgtttaagagtgtggctggtttttttttttttttcttttttgagatggagtttcgctcttttgcccaggctggagtgaagtggcaagatgtcagctcactgcaacctccacccaccaggttcaagcaattctcctgcctcagcctcccaagttgctggaattatagatgcctgctgccatgcccagctgctttttgtatttttagtagagacggggtttcgccatgttggccaggctggtcttgaactcctgacctgaggtgatccacccgcctcagcctcccaaagtgctaggattacaggcgtgagccactgcgcctgaccaagtgtgtggtttttcaacttgttagcttgaaagtagggtaaacattttaaaaagagagaagaaaaagagtgtggttttcaaagtgtagcctatctcttatttttttgttttgaatcaggcagcccctgaaccagaatagattcagagaggctcctccatatcttgttttgaatctcacttctgttacaatggagattattacggtaccaatctcatagcactgttgtgtgaaccaaatgagaccatgcatatcatagagctaagacagttcttggtacacagcgaggatccaatcaatgtttgtattaataacaataataataattgtcttttctataaagggaattgtactttcctgttaacttacaatataaagctgtatgtattttttcttgtaaaactggatataggagaattctgggaagatggcagagtagggagcaccaacaatctgtctctctgcttagacaacaattatactggcagaatctgtctgatgcaactattttggaactctggaatctattgactggaatctgttaaaggtttgtgactttcagaggaaggcttggagggtaattgtagttaatatcaatcaatttcaactcttatcacagtagtagctactcatcaccctccacctcccttacacacagcttacaggaaccgtggtggggaaaaatcacctgtcctccaaatatcataaatctgttatctgataactggttgctgcttccaaccacagagctacaaagaggctggaagtcactgttgttgcacctccccacattgttgcaagccccttgtcctccaactgaggtggcttctataggatttaaggggctagcaccctctctcccctttcatttttctcttttaccctttttggaagccagacattaaagaatagggcattcaaaacaactgcatatatggggaaaattagaaattgactatgcatgctcagggaaaggcaaggctcagaaaagacctaagaagaacttaaatgtataccttagactgaaccttggcacagagatagcctacaatatcagacaaaaacaaaaacaataaataaaaacaattgtaaaaatcggtaagctctggaggagaaagataaaatgatttcctgagttacattattaaattcaaatgtccagtttttaacaaagaagtcagaactcacacaaagaaattgaaaagtgtggcccatttaaagaaaaaaaatcaatacaaactgtttctgaaaaatacctgatagtctatctactagatagagactttaaaacgactgttgtagagatgctcaaagaactaaagatgtggagaaagtcaggaaaacaaggtatgaacaaaatttaaatatcaataaagatatagaaaaccccaaaagaagccaaaatgaaattccggagctaaaaagtgcaataactgaaccaaaaaaaaatgtactagaggtattcaaaggcagatttgagcaggcaaaagaaagaatcagcaaacttgaagataggacagtggaaattactgcaaattagccaggcgttttggtcagtgcctgtagtcccagctactcaggaggctgaagcggaagaatagcttgaacccccgaggcggaggttgcagtgagctgagatcaccgttgtgttgcacttgcctacagtactcagtatagtaacatgttgtacaggtttgtagtctacgagcaataggctataccatatatcctaggtgtatagcaggctatactatctgtgtaagtacactctatgacgttcacagaatgacaaaattgcctgacaatgcagtgctcagaatatatccctaccactaagcaacaaatgattgtacataaaaattcaataatattatcatcagatttcttatcaaaaactttaagggcctgacggctatgggctaatatattcaaagtactaaaagaaaaaaaaaatctgtcagctaagaactctatatccagcaaaactgtccttcaaaagtgagggagaaattaaacattcccaaataaataaatgctaagagaggttgttaccatcacacctgccctgcaagaaatgctcaacagggtactaaagggtgaaatgaaaagacactggacaataatctgaaaccatatgaagaaataaagatctcaataatgggaaataaatggaaagttataaaagctagaagtattataacaatctttttcttttttttttgagacagtgttttgctcttattgcccaggctagagtgcaatggtgcgatctttgctcacctcaagctccgcctcccggcttcaagagattctccttcctcagcctcccgagtagctgggattacaggcatgcgccaccacgcctggctaattttgtatttttagtagagatggggtttttccatgttggtcaggctggtctcgaactcctgacctcaggtgatctgcctgcctcggcctcccaaagtgctgggattacagacataagccactgcacccggcctataacatccatttttatctccctttttttctatatgatgtaagacactaacatatgtttaaagtattcgtctaaaagctagtattattgtaactttggaatgtaactccacattttgttttctacataatttgagaaacaaatgcatttaagagaatcattagtttatgttttggggaatacaatgtataaagatataattttgtgacattaacagccgaaaggggtggggatggagctgtgaaagagcagagtttctgtatgttaccaatgttaccctcgtattaattcaaattagagtgttacaactgtgggatattaaacgtaatccccatggtaaccacagagaaaatagcaatagaatataaacaaaaggaaatgagaaaggaatttaaatgtttcactacaagatatcaactaaacacaaaattggacagtaatgcaggaaataaagaacaaaaggccgggcgcggtggctcacgcctgtaatcccagcactttgggaggctgaggcgggtggatcatgaggtcaggatatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcaagactccgtctcaaaaaaaaaaaaaaaaaaaaaagaacaaaaacctacaaggcgtagaaaaccaatcacagactaacagaagcaaattcctcgttatgagtaattactttaaatataaaagaattaaactctccaatcaaaagatagaaatcaacagaatgcataaaaattattatccatccatctcctgtctacaagagattcacattggatccaaagacacaaatacattgaaagtgaaaggatggaaaaatataatccatgcaagtagtaaccaaaagagcaggggtagctataccaatatcacacaaaacagactttaaattgaaaaagtttagaagaaacgaagaaggacattacatgttaattaaaagttcaatacaataagaatatatgacaattatagatatttatatacctaatgacacaccatcaaattacatgaagcaaaaaactgacagaaatgaagacagaacagacagttctacaatactaattggaaacttcagtatttcactctgaataatgaatagaacaaacagaggaaagtaaggaaacagggaacttaacacaataaactacataattgcatgtctactagacatatgcagaacatttcagtatagacaatatgctaagtcgcaaattaaatctcaatagatttgaaaagacaggtatcataaatctaatcacaagataaagtcagaaatcattcaaaaaagaggaaaatgaaaattcacaaatttgtggaaattaaacaatacatccataaacaaccaatgggtcaaagaagaaatcccaagggaaattagaaaatactcagaaatgaatgaaaatgaaaacgcaacatatcaaaacttatgggaccctgtgaaagcagtactaagggggaaatttataagtctaaatgcttatatttataaacaagaaagatttccaatgaacaacctaactttacaactaatttaaggagctagaaaaataaacaaaacccaaagctagcagaagagaagaaataataaagattaaagcagagataaacaaaatgtagaacaacaatatttgaaaatcaatgaaaacaaaagttggttctttaaaaaatcaacaaaattgataaacttttaggtagatgggctggaaaaaaagagaagactcaaattaccaaaattagaaatgaatgcgggacattactactgattctacagaaataaaagagatcgtaagagaatactatgtgcatcaacaaaatggataacccagatgaatgaacaaatttctagaagcacaaaacctaccagcactaaattatgaaaaaatagaaaatccaaatactgtaatgaggtaccatcccacaccaattaagatatttagtattaaaaaaaaacaggaaataatacatgtggtgaggatgtccagattggaatccttgtgcactgttggtggaaatgtaaaatggatcagccactaaggaaaagagtgtagcagttcctcaaaaaattaaaatagaattaccatatgatacagcaattccacttcagggtatgtaactaaaagaattgaaatcagggtccagaagagatattttcccatcgatgttctcatcattcacaatagctaaaacatggaaacaacccatgtccatcagtgaatgaatggatacgcaaaatatagtatatacatacaatggaatgttattcagccttgaaaaggaagcaaattctgacatatgctacaacatggatgaaacttgaatacgttatactaagtgaaataaaccagtcacataaaaacaaatactatacgttggtgcaaaagtaattgtggtttttgctatttttaaaaaaacaagtaatcacaaaaaccacaattacttttgcactaacctaatacatattgcctttatatgaggtacatagagcagtcaaaatcatggagacataaagtagaatggtgattgccaggagctgagagggagggggaaattggggagctattgtttaatgggtgtagagtttctgttttacaaaagtaaaagtgttatggagatgaatggcggtgactgttgcacaatgttatgggtctgtttaataccactaaactgtataatttaaaatggttaagatggtaaatttatgatctgtgtatcttgccacaattaaaaaaaaatggaaaaattcctaaatataaaaacttatttaaaaatatttggcaaagaagataaatatcctaccacaggtctaataaattccatataatatgaaaagttacttgtacatgggaagtttattttctaccaacgaagtctgtgtgtgtgtgtgcgctcacatgtgcatgtgtgtgtgtgtaaaacgcttacgtactgctatgatgtgaatgtcacatttctcccaaattcatatgaaatcctggttgaaatcctaaccacgcacgctgccccgtgtggtattgcaagactaagtactttgccacagtttcccaaatctgagctacttttaccaccagagtttacattcccatatcccagagtctggagtatgaagtatggtgtcaagtattaacagcctgggtctgattccatactctcagcaccaaaaattgttcctcagagttcacatgtgatagttcagtgctgtcatgctttgccattcatgtatttaacaaatatttgttaagcactaggcattgcgttaggtactggaagtagagagataaataagacacggtctgcgcactcatggcatacacagtgtacctacagaacagcaaatatgtttcactctggtgtcaactctgatggatttagagggttgcccagagcactggttaaaaataattccaggcagtatttgaatccagtggggaaaagagccatagacgtggaaagaaggaatagctttgaatgttcgttcaactaggtttagctggggacagacacatataaaacaaaatataatttaatgtggtaaatgctattcatgagataagaacaaagtcacatcaaagcgcagagaaaggagttaattaattttgccacgagggaaatagagtaaggaaagacctcactgaagaggctaaattgtagctgggccttgatggatgactaagaatccagtaggtggtgaagtggggaaagaagattctagtccaagaatacatcatgagcaaaggcacggaggtgtgtaagcatgtggggtatggagacaacagtgagtagtcctgtttggtgagaacacagggtgtggagatgatgctggtagaaatgaggctgtatcatagtagattgagaccagattctactgccttatcctataagccacaggactcattgaaggcttttaatcaagagactgtatagccaaatatgtgctttaaaaaagttactcaagaagaactagactggcagtagagaaaagagaaacaggcggtggggggcggtggggcagaaaggaggcttctgcagacaagggacagtaagtgcccaaatgggggtggcgtgggatgcgggcatagagagaaggaaatagcaccacctcatagcgcaaggatgctcttgaaaatgacctatcataagagctttgatcaatataaagaaaattcattagtctaattttttcattgctcatgttctaatattaatgtttgcatatgtgtatacataattaaattacacatataaatgggagttccaagagtaatctcagattttaaaatttagcctcatgacaatcctataaagtaggtactgttactcccattttacagagaagaaaactgaggctcagtgatttaaaaaacccaagataagtgatgtgaaatcacacatcttctaagtgtcaaagatggcatttggacccagagcaactcaagattaattactattctataccacgtgaacgattaatttgccaatgttattatccacctgtaatatatgttgaatcgcctacatacataccacttcttttcacttatatatatgaaaaggtagatgtgtatgacccgtgttgaaagcaggagaaaattaccaagaaacatgaaaataacagtgagtgagcccaacatctgtagtaacccaaatgagttggacttgcagtttaagaaaagctaataatttttttcctgagtgctgattcatcaagtaattttgattctcttactctactacaatcaacgtattaatcaatctcactggcagtgtacctagcattgtgctggggaaatacatcgtacatcttcccaggagaaagatcccgggactctgagacaggagacatggttggcagccctggctctgccattagcctgccacacgggctgggactatccacttgacttttaggagcctctctttcaccattggaaatagcatcgatgatcacaaaggtccttatcatgccttcaatgttctcgtgcctgccttacaggattcatttcgagaaaaaagagtggttagtactcaacataaagtatagtaataaaacacattcaattgccacgactggtttagtaatcacttggcctcctctgaaacaacctcctaaatatgcaaggggagtgtttatcattcctgcgcctaaggagcctgacacttcactgagagaatgagctttataatttcttactttttcaaaaatgcctgcattgaaatcttgcaggatgtttaaaatggcttttagagaacctgaggcactttgaagtgggtggagttgttcaatgccttattcctccttccatttcatcttacgtagagaatccccagtggtgatttttatacatgttaaggtacttaatcgagacctttggagtttggccagtgagtagtttgctctgagacaaaatattctgaaagatggctggatacacatgctgtttcctagaattaaagattgcaaatagatgtatgcatctggtttcttgcaggggaagaccaaccataaggtgaatggaacataaacttgcttttgccgcttcaacagcaccatccgttcttgctagcatcttttttacttccagagggtttgaagaagcacgtgttgtcttgcaacagtgcagtccctgctgtcttccagctctaattgtcaagatgctagtctccagagagcgagggctccaagcagttattagagatgatggcattcctggagtgctggggggcatgctctgccctccaaactaaacagttctcttatggcttcaccctatgcattcctccttatattaatgcaggagctgatagattggttgagaagctgcaactaatatttttgagggcataaaagatgattgtgttagttctaattccagagcccatctttttagcagattatgatggatgactcgccgtggtggtcagcgcctcctgtatattttaggtggaatgctttcttttgacacatactttacagagacacatgtgtatcctattttaattaatggaagaaatgattcactcacaagtgaaagatttaattaaataaagggtcagcactggtcagccatgaatcgcaaaatacctcaggtgtttattagtctctctgccatctctgcatgctatctggagtgccacatggcagtaaaagcaggccttgcaaagaaatgaaatgaagtttcattcattcattcatccaacaaatagtaattgagcccctactgtgtttgaggcactgtgttaggctctggagataccatggggaagaaagacctagtttttacccttatggtgactacagtacagtgggggaggaaagaaaaaaatgaggaaaggacaaaaaggacacagttattacagattgcaacatgcttcatgaagtaaaaataacagtttgtgggcggttttccttgcaatgttttgtaatcattttttaaagaaattaatactcatctttacaatgccatacttgtttaattttggaatatatacctgaaatcaatctggcccccatgcagtagataaaatattttattcctatgagcagcagctatacatattgagtttcccaaacttaggatcattgttattttcaggaaatattggagaacacaattgcttatctcgttagctccttcctctaagttggtcaaccttgtgctttggaatcagacaaccctggattcaaatcctgacttcttgacttgttcactttctaacctatagtattactttgcttttctgacttcagagaataataataatagtacataagacactgagtcattatgagataatacatagagtaccgaatacacaaaaaggactccattgatatttgtagttcatgttcttgttatattattattattattattattattagtagtagtagtagtagtagtagtagtatttttccctctcttctggaactttccacattctacttttttctagttgttcatgttattttcttattctgtcatttggttacagaggtcacaactcttttagcactgaacccaggtgatatatggttaatactcaataaataattgctgaataaataaataaaagtatttctacctctttttggaactgagtagagaacaagttaacaataaacaaagtctcccgaaagcttcccatgacacttggaataaaatataaatgccttgtcatgctaaacgggagcctacaggctttggtctctgcttacctttctaatctcaaacaccaccacttccccttccacactggcatcagccactggctttgcctgtctagggaatgcctttcctctagaactatgtatggctcactccttccagtctttctgctcaggtatcttctcctccaagaagtcttctctaatcaccttacctattcattttctatatccttatcttaatatagtgccttatttttccttaaagtgttattgctgttggaaattaaattatagatttttgaatttacaagttgattgtatatctcccccacttataacatacaaattgctgagggcaagagacttgtctgtccttgttcagccctgagtcatcatgccattgaatgaatcagacaaatgaagaatctatttttattttcctgagaaaatataggtgtaagaactatccaaatagtttccaaagtacagtagcctctaaaatataagaacgttccctaaaatttcttgcttgcggcaggcacttctgaatttaatttcagaatgacaggaaagggaaaaataaattattctagtcacatggaaaatgaagaaaaaaccaaaaggaggtctcccaacccccaaattttaatagatttcctaaacagttttgctttctcaccatgagtctaacctttttgtaacacttcctttgcgattaataagtagctggttactcttgttctccaagccaggaaacatggattttctttagttttcacatgatctggcccaaagcatcgagcaggaaacttggatgtttcacttggcatatttcactgactgagaaccaaagaactgcaaacaagagagatgtctccatttgcctaggacgtcttcgtggtagaggaaaggcgagaatcatgtataccaagatactgtccaggaaataacaactgtgattaactcccactggaatggaagaaaggaggggaactggtagattttcttctacttctaaaaatgtgagccatcagagcctgggtgtgccatgtacaagttgttgcatggtgtggggctttgctgtggttgtttggagcgttttgtcccggaagtctctccaaagagccttgccggctgttcctggcaacgtcgggcctggcttactcagattagtgttttaggagaggtgctttggggtaacagaactggcttcatttccaccatgaccacatcggccctgttttctgctgtgcaaaaacaaaattctaaaaaatgttaccataccaaattgtaggctgcttttgttttataaacaatttttttagtctgtggaaactgtaataaagactaatgacatatccagttgttttccagagcgccaactcaacttgggggactttttctctcagcatgaggtcctgtctttctttcctagcagatattcctgaaattcatctccatgcggtcaagtacgtagcagtggggtgaagtacttggcaccccaccgtggaaccatgagcttctttctgcctctgaaagaggaggttttggaaccaccaatagagcaccagtgggcaccagctagagtcaaggaagtgttcttggagcggatctcagttctgccaggcaaggaagaggctcccttgtaaagggtgtgatgcatttggggctcacatagcccacgggcagtgagaatatttcacgaaggctttgttattcccagatgcctagacaattccctgaagttcattgctttcaaatgcctcgctgctctgagtacgatttcatatgagggaagcaagatgaaagcttacaacaggatgtcactgatttttcaaacacaaagcaggccaaggtgataatactaatggaacaaatgtgctctaggagaaaatctagtagattcttatcatttacacacatgaaaaatcacaaaatcgaggtgagcgccagaagcctttcccttgtaaccaagaaaacttgggctagctgctctaatcgcctgaggacagatcccatttacaactgattccatctacagctgagggaatccgtgcagtgttttcactcccagattgcatgaagccatggttaagaatcagactgccatcccatgattgtgccttaaatttcacgtctataaaaacagaaaaataataaacttatctaaaagtgttgttataaaaattaaataaactaatctacaaatgtgcttggcatagagtctagtatatagtgagtgctcgataaatattacttacaaaataaaattattattacagttataatttatggcattattattataattttcactgtcttttgaattgagattgtcttgtagcctgtatattaagaggtaaaatacaaaatcactgttcttcaaggcaaatttattggaaaaatactacaggtgatgctacagatttctttaagtatattcttaacattctcttctactaatagtctataagtccccttttaatatcttctttactattctttcttcagtgcctgatgcatgagactcctcaaaaaaaattgctaattttttttagcaaataagtgttctttattcatacagaaaaaattcattcatactttcaacctaagaaagctgattgaaaacaacagtaataactactgcctgagtaacctctactgttcttccatctaacactttttcagcaaagaaatttccctggtgagtataaaagttctaagattgatgtcattgtgagcaagtgagctctccatccttgcatttcactcttcctggtggtctctgttaaagagatctcgctcttaagaacagaacctacaagactggctagaacatctccttagatacatcatttgaaacactgactcattattttaatagcatctttcttaaattagggtcagaattcttttcccagcatcatcctttctatctattttaagacagagccatcactgtctcatgtccccactaattggataagtgggtctttctgaccttgcaacaactaagtagaaagcatacttagtgactgtaaaattgacaggcttctctttttctaagtggcaggtataatctaggactttttgaacagcactttgagttcctacacttttctataaaggggtttatatgtgagttggcagaagatggggagttaacaatgcagggatctaccacgttcatttcaagccatgtgcaaggggtttccattgcaccacatggagagagtaacatgttggcagataccaccatggcttgtattctgacccctagccgggaaatctagaagctgggccatgggataaccggcctttttgatggtggagtcaggagacggcagctgagactccagagagctttccccgctcctcttccatgtgaggatataatgagaaattagctccctagcagctcataatgaggctgtcatctactgcggtgagagggcagagaaagttaaggtcaaagtggccaagcaccagaaaaggttaaatgaccaaccaaagcatatctgttatgcagggtcagggccttggctgggaaacaaataggactgaacacttggaatcatgtggttgaatgccccttcaaattttgaactcctagacttctctgaattctttcagcctgagaaatgtccattcctccctaataagagcaagaacttctccttgcttgaagacaatgaagaggcctctgatctgaaagacaacatatagccccctcaggacctgttcccaatttctcccttaccagtaggcctataactaggatcaggtcacgatataatcccaccagcgttagaccatccaaggcttgataagggaggaaagggactattccccaaaggtactacaaaacatagtcaatatgtaccagcagaagctgggcactcagtactgggctgaattctgagggtgcttgatcaaggaggctggaacataagattgaatggggtgggcttattgatttcagagcactctgacaaaatacaagatttaactttctggcaagggccccaggagatgatgtaaacaccttctaggatagctcctaaaagtaaggaacaagcaatggaccacatcaaatgaagtcaaaatgccataattgctgtgccagatggttgcaaaagtgattaaaaggctcagagaagtaggcatgctggagtggacatagtaaataaaaccagaagattcactaaatgattgtgtttcatgagaaggccaagaccatttaccaagaccagaaggaatctgctggtgagaatggcagaaagctgccacagtaacctctgtgaatcaaaagtttgacccctgcttaaaactctttccattcttctgagcatcaacaaaatgttccagagccctcctcagaaggaggtactagtaagagaggttatttcataaatagacttacaaagcaattggtatgatgcggtccccaaagcagtgaaggtctggtggtggagcttgaccgccagaagttaagtagacacaattatcacaatgaaagcatggcctcagtggcagccaagagggcctaacctgtggagatgcactgaaatacctaacagaacatggcgctcatcgaggcaaaagagatgggcagcccacaagggtcatcaccagcatttacctccaaataaatcaaggacagatgacaggaggctgagggcagatactctaaacaatgtcacaatctcttgtccaatttctggacttgaatctgttttcaaactcagactcactagctgaactggaggccagttctccaggagaagggactctgtaacaccacagcaagtgtacatggtcatcatttccccagtccttccccaaggcacctatggccatgtacttagatagctacacactgaagaaaaagaaatactcaaatatttcaagggctgttggacagagttgacatgaatacttagcaatcagaaccatcaccatgccctctatctcagggtgcaggactacagggctaggcaaaagatcaaatcctagtcagggtccagtttacagtgtgttcactggatccatgaactcacacagttgtccttttccctgtccttgaatgtataaatgggtttgatatacttggaagttggtgcaacttctatactgggtccttgatccataagataaaagctaccatagtgggtaaggccaaggagaggtctctgaaaatgcactgccctctcctctatcaaaagagtaaatcagaaacaatattgcatcttagagaaaaggcaaaaattcattgaataatctactgtcatcatccagtatccatttggtgtattcagggcctagagtggcaaattaaatggagatatcatgagacctccatgaagggggctaccaagctgactgagaagcaatcacaagagaggtgggaaaagaaccaggagagagtgaagtcatggaaagcaagggattaaagcactaacaccagcagagaaacagagtaaggtctgaaggtgtccattgaatttggtgaacactgtatcactaatagccttagaaatggcaattctagccaaatcattcactcattcatttaacaaatatgtattgcatgtgtcagtggggaggagagaagaggagaggagaggagagggagaagaagggctccaggcagttgagataggatgtccaaagctcagcagttgatgcagggaagagtgtgttttccttttccagttacattaattggtgaggaagggaaaagtctatagaacttatgtatgatttcctcaatttcttgatgaaataggagcagaaccatcttcatcataggagatggtctcatggtatctgggcagccaggtatgggttggttgtgttcaaacaaaatgaccacagactcttcctcagcctaatggggatgactgttgtattagctggggtccattcaggaaaacagaaaccaagaaaaccaagctggatgttacaaatagagggcaattaaagaactggttgcaaagaactggttgcaaaaaattggaagtctaagaagacaaaaaggcaagcatggatagcccaaatattcgtaactactggaaacagctattagtcaaaggttagggaaacaaaggagaacaggtctaaaccctaagtcagaggagggcccccacctacaggctggtgctcagacctcaggaaagggcgtgactggccggtgcaggttctgcaaagagggaatagtgcaactggtttggggggtgccaactgaaactggggctgaagccatagctgcattttgctgctgtttttgccgtagcgacaccaacgctagaaacagaaaaagtccctcctcttttcatcgtctaatctccctcttcctattagctaatctcccactggctaatagagagccaaccagaaagagtttctgggaaatgtattttgcagaccccgaccccaccatcacagaacagaccatagaacagcggtttgggagctgaaagacaagagctgaatgctctggtctgaatggctgtgtctctccaagatctatattttgaaatcctgacccctaaggtgatggtggtagaaggcagggcctttggggggtgattagatcatggggtctaattcagtgtctcgtgagggcctgttttctggttcataggtggcacagagccctcatgaatagaattagggcccttataaaagaaactccggagagatccctcgcctcttctgccatgtgaggacacagtgagaaaacgccatctatgaaccagaaaacaggccctcaccagacaccaaatctgccggccccttaatcttgaatttcccagccaccaaaactgtgagaaataagtttctgttgtttataagtcgcccagtttatggcattttgttatagcagcccaaatggactaaggccataaataaacaccacaactatatcagagtatagagatgactggagggatataaacaaagaggctggtgttctgtgaccccaaggccaacaagtgtgggtgcttttgcccaccagggagcccagcagttgtgagctatgaccaggcatttcatttcctctttggtggctggtattgccatctgcagagaagccacagagcctgacagcagagagaacacagcattggcaatggtcctgagcacatgtggccagtgctctttgtgattgcagaacctggggttcaggaaggctctccacagtctcttcctcgttattacgattttcctaggtagaaaagcattcgaagggcttcctagggcagccagaccatatgaactaaatttagaggagaataaattgcaagccatgtttggaagagagttgaaacatctccttttttccctcctttacaatatgggaaggaaattttaaacataagtgaatgtttaaaaatcaatagctttcttatgttgcaaaggtagctaattagaaaatacaatagaaaagtatcccattcttaatatcaatagaaattataaatatctaggaataaacttaacaagaaacatgtagaatctacttatagttgaaaaaaactttgaaaatttaaaggaccgaaaatagcactggaataagaaaagagatgtagtctactggaagtttaaatatcattaaatataaattatccaccaactgatttagatttttaataacgttacaaagcaaaaccccacagcagcttttaacctaatatatgtccaaatatccagaaaaataattttatacaattttgtaagaatataaatgacagaattattctaaaaaacaggttggctatatgaatcaaggattcttttaaatcaagtctggatggctcatggtcaggagtctgagaccagcctaggaacagagcaagatcctatctttacaaaaaattgaaattaaaatttaaaaaaagagaatcttaagtaagatatttatacagacaattaaaaggcatattatcttgagtactcaaatatgtggggcaggcacaatggcttacgcctataatcccagcactttgggaggctgagatgggcagattgcttgagctcaggagttcaagaccagcctgagcagcatggcaaaactctgtctctacaaaaaatacaaaaattagctgggcatggtggcacatgcccgtggtcccagctactcaggaggctgaagtaggagaatcacttgagcctggtatgcagaggttgcagtgaactaagatgatgacactgcactccagcctgggtgacagagtgagaccctgtctcaaaagaaaaaaaaaaaagatacagggaaaagttcaggataaatgtttaacagaactcagaacacaaacacctaaatgttaccaatggttaaccctagttaatgaaattctcagtaatttttattttattttattttattttattttattttattttatttttttgagacagtcttgctctgtcacccaggctggagtgcagtggcgtggtctcggctcactgcaacctccgcctcccaggttcaagctattttctgcctcagcctcccgagtagctgggattacaagcacctaccaccacacccagctaatttttgtatttttagtaaagacggggtttcaccattttggccaggctggtcttgaactcctgaccttgtgatccacccacctcagcctcccaaagtgctgggattacaggcgtgagtcactgtacccggccatattttagtctttatattttggggtgtgttttaatttttaccatgaaaaccttatttaaccagaagggggaaaaaaactatcctttcaaaaagaggaaacaagaggcacttgatttcctctaaattttctttcaaaaattcaacaactctaagggctgatatgtgccaggcactgtgttgcagtctgccatttgaaggtcagaccactttgatcagagttgagggtctacattaggatgtaggaaaaaatggggctagaaagatggattgaaccaggttgttcatggcattttaggtcagacaagggaggctggactctactttgcgagctttgaagtgtaaaggtgattatgataaagaaaaactaggaatgtagcaatcgcctattgaaaaaaaacaaaaaacaaagatagactttgattccatccttcttcctacactgtggaggaaattaataagcaccactccatcttttatatcattgggcagctatctctaacttgtgaagactaagccaataaaatgtaagtattgaaattccctcctttctgtacaaggcccatagagatagaagcaaactgtaccaaagcagtatcagacataacaaaatcacaggagcttcagacagcaggaagggaaatgaggttaaaagagatggacttttagctgggtgaggtggctctcacctgtaatcccagcactttgggaggctgaggcaggcagatcacttgagctcacgagttcgagtccagcctgggcaacatggcaaaacctcatctctacaaaaaaatacaaaaattagcagggcatggtagtgagagcctgtagtcccagctactcgagaggctgaggtggaaggatggcatgagcctgggaggtggaggttgcagtgagccgagatcgcaccactacaatccagcctgggcgatagagtcagagcttgtctcaaacacacacacacacacacacacacacacacacacacacacacacgacagaggtgcactttttatgagagtgaggcatgaagggatcatgagaagtcatcttgtttgtccctctgtctattgtagacaggaacatcttctgcaatgtctctaatgaggccatccagcttctgggagcatgtcagatttgcatcataaagatgctttccaaacccaaattcatgattttttgccaaaaacttctgattgtttatgttggtgaattatggcaccatctactgaaaattgataatcatgtcagactcttctctttctctcaccaacagcatccaatcactcaccaagtcctgccaatattatctcctgagttgcattatttaaatttaagtcttcaggctgggcacagtggctcacacctgtaatcccaacactttgggaggccaaggcaggcggatcacttgaggtcaggagttcaagaccagcctcgccaacatagtgaagcctcatctctactaaaaatacaaaaattagccagcgtggtggcatgtgcctatagtctcagctccttgggaggctgaggtaggagaattgcttgaatccgagagatggagcctgcagtgagccaagattacgccattgcactctagcctgggtgacagagcgagactgtctcaaaaaaaattttttttaataataataataataaaataaaattagatcttcatcatttttcactcggattactgtgacaggtctctccccccagtccatttccctcttaatctatgctgccatcaacacacgcttgggccgggcacagtgactcatgcctgtaatcccagcactttgggaggctgaggcgagtggatcgcttgaggtcaggagttcaagataagcctggccaacatggcgaaatcccatctctacgaaaatacaaaaattagctgggtgtggtgtcaggtgcctgcaatcccagctactcaggaggctgaggcaggagaatcgcttgaacccgggaggcagaggttgcagtgagccaagattgtgtcattatgctccagtctgggccacagagtgagactatgtctcaaatacacacacacacacacacacacacacacacacacacacacacacacacacacacatgcttgaacaaataacttgcctgctttaaatatttcagatcccttatgagtcacttagacccttcatagtctggtcctgggtgcttcttcagcctctttccctgacatttcccgggaacatgctgcattccagccatttcaaactatttcgagttcctcaaatagcccttaccctctgacatggccctgcttttggttgtgctgtttctgttgcactcccccattcgctcaataatccctgtttgtttgcccatcaagattcaaccaaggggtgcaccatccaggaaaccaccactgatcccccaaatctgagttctaagtccccactctgtgttcatacagtactctcctgcattagcattcatttaactgctgtagctgtttaaacgtccgtctcactcaccatactgagagcctagggaagagactgtcttttattgtgagcatcagttatactgttctgcccaggaccatccttttcactgggaaagtgctactcctttatcccatgtggttcagctgagactattaatcacacttccctgtctacctacttgcaacaggcttgggcacgtgacccaggcctggccaatcatggtaccatatcttcttaacaataatgtctgatccaagcactggcaaattgaagagagtctttccatgacattaatatatggatccaggaaagagaagattcttcttttactttagaattgaaaaatgatagtggccctggaccatcagcagccatctttctcccctcatgaaaagagcacatccatggatttaacttaacattagaggaggtacaatgagaatatggaaatagagcctaaataattttattttgcccctagatctagcatatgagaagcaaatatgttctgcatttcccagtttataagccaataaattctcctttgtgcttaaagcattcgagttacattctgacacttgcaaccaagaatcctgacaaatacatctttggaatttgtatctcctctgaattacagtgactggtacataggactcaaaaatatgtacataggactggtacatagtacagtgactggtacataggacttaaaaatatgttacatggatgaatgaacagcttagcaaaaggtctgggaatgacctctgcgtaaagtgaatttctgctgcccccaaaactgcctagtgtgtgctgttcatcaacaatgcacccacttcttgcactttgatgtagagaggccataccacctgtgtctacatgtggttactacttaaacaatacttacatagttagcgagtggccaaaatgtctattaatctgtaaacacttggaaagaatccagtttgtattcttattttcctggtttaaagtgctaaatgaaccaaaagttagggaagctcttttcagaaaagccatcatgcctgatccaatccactgaacaaaagatttaggagctctccatctgatattagtctttggaatagccttgacttaagtgtgcttgagcctgtgactgtgggtgaaagtgtgtgagcgatgattttccttcttgcaggtaccaatcgggtaaattctcaagtgtgtagctactgaggactctgcctcaaatggaagaaggcagagcttccaaaccattagtaagttaatctctgtccttgttttttggagaataaaatgtgggctttttttttttaaatgagcaaattttgtttgatgttaaaatgtttttctccatatgaggtaaatgttctattcaaagttatttctctctttttaaacacagcaaatcaaatcttcttttaatgcacatgtgaaagtcatagcattttacgttctaaaaacaatcctaggttctctacatcagaaacgattctgcttgaatccacttaacttattcaaatatttagcaaggtcagcaggatgcttctgaaattttttctttcaattattccttaaggtcaataatctaaaattgccaaacatgtgatgtatttttacagcaaaaaatatgtaaagaaaaatgaaagcaaaaattagaactggcttcttgttcatgtgcttttgaggggttagtaaaatctaaaagtatatgaagatttctgtttgaaaattaagggtcatgaaagagccaaaactaggcatgacccattcccacccagagaatgagaaggaggattttcaaagaaagtagtggcttgtacagggattttgaagttttcacagagttcccacatttacaaagaaaagtcaggggttgcagggatttggaataaggtagagagggttcgattgctttgtgtagacaccgggaagaatctgaaacagccttttggtttctgggaagggtgtagatgagagactgagcagatgagggagaaggaaggagagaaaggaaaccatgggcaggcagaagggggaggggggcagacaaagaacttgtaagaacaagcctactggctgggcgacagtggttcacgcctgtaatcccaactatttcaaaggttgaggcaagaggatcacttgaacctaggagtttgcaaccagcctgggcaacatagtgagaccttcactgcgttgtctcttcaacaaaattaaaaaattatccgaggacggtggtacatgcctgtggtcccagctatttgggaggctgagacaggaagatcacctgagcccaggagctcgaggctgcagtgagccctgattgtgctactgcattccagactaagagacagagcaaggcattgtctataaaaaaaaaagaaaaaaaaaaaaaaaagaacaagcctattagttagatgcattcatttatttaaactgatagctaacgggccaggcatggtggctcacacctgtaatcccagcactttgggaggccgaggtaggaggatcacttgagcccaggagtttgagaccagcctgagcaacataatgagaccctgtctctacaaaaaaaaaattttcttttagttagccaggtgtggtgggacacacctgtagtcccagctacttgggaggctgagatgggaggatcacttgagttcaggaggccaaggctgtaataagccatcattgtgccactgcactgcagcctgggcaacagagtgagcctgttgagcctgtctcaaaaaataaatataaataaataaataaaatgacagctaaaagttgtatatacttatggcatatgacatgatgtttagaaatgtagatgcactgtggaatggctacatcaagccgattagcatgtgccttacctcacaggcttatcattgatttgtgatgtggacacttagaatctactctcaagttttattttaagctatgttgctacatctcccattgtcttaacaaactttaatttaccctacatatggaggttgtttgtgattaaaacacacacaacagaaaaaaaaaaaagcaccagagaggctggtgtggaatgtggaacggtaaccttccaaatcatagtggaaagagggaaaagtttataagggcaattgtgaagggtaataaataacgatagacaggcttgagcggaggaaatctagattgaaaaaatctacatatgctatataggaataaaaatgtattaaagtcatatgattatttcactatgtatgtaggcacatcatttgtaaatacagctagaaactgtaattatagaaaacatttcacatggtctttaatatttaattagtctccccactggaaatcaaccacgtagaaaagaaacgctttctcaataggttaatattaattacttaacaaccctgacatcgatatttatggaatacttatgaaacaagctttcatgaagtggaaacatgttcatccatctactgggaggcttacggcatttttcaaagtgtcaaattcactttgcgctctgcctctttatgttgtgaaaatttgaaattactgttgatttgaaggctcttcaaaagactctttttttatcccagctgagaataaaaaaactcagaacagattaatctggtattcttaaagtatgtcacttcctaatcttgcaaaagggaaatgataaccatatgagacaaagaagtcttacgaagtagaagaaactagagagataacgccaatgtatactgtcaacgacacaaaaatataaaattagaaaccagtcttaggaggaagtagagaaagacagtaagtatctgacatggtttgaagaatgttaggaaagatgcctcatcactagaacaactttgttcagaaccacagcacagcggtgcctggtgatcatttatgcttacatccattctttcagcaatacgtactgaattcccactctgccctatcttgaccttggtgctgggtgcaatgacaaatacaacccagtcactgtccttgggagctcattgtccaggtgcagaggcacacaagtaaaaacagttgcaatacactgtgctaagcatatcacagagacactggtgagagtaggaattttagcgaggcacggcatctcacgcctgtaatgccagcactttgggagactgaggcgggtggatcacttgaggtcaggagttcaagaccaacctggccaacatggtaaaaccccatctctactaaaaaaaatacaaaaattagctgggcgtgctggcacatgtctgtaaccccagctacttgggaggctgaggcaggagaatcgcttgaacctgggaggcagaggttgcagtgagccaatatcgcaccactgcactccagcctgggagacagagtgagactctgtctcaaaaacaaaacaaaacaaaacaaagaaaggaattgtaggtaaggagtgatgacaactttgtatgtaaatgcatgctaaatatcaaataaatacacaattcaaaacacttttttctctttaatacttgcaggttcctctattgactaatcctgttatgagagtttatatgtaattgggcaagatgcactaaactccaaactgattccagttctgactctgccccttaccagccccaaaacccccagcaagtccagtgaggcctcagagccttaatggcctcttctacaaaattagtgcatttgtcctgatgatctataagctacttgtccagcttgacagtctaagaagcttcatttaaaatgtaaatgttatcctcaaagggtgatgcatgaagccaatgggactgtattgtgcattagttaattaaattagctagccagtcaccttgcagagccctgagaaaaagggacacaggtaagattcatctcaaaagatgggggaagagctctagatttgcggtgggtaagagaattggagatcttggcaaatagaggcagtgaaaggcattgagcccctggaggatgtaacagggaggaaggagaaccacagacaaatttttaacatattataggaaagtgtttctcagccttgctttcaaaataaagcattagaacatgtaatatgatcaaagactgcaacagcttcaaactatatagtaagggcttgggccagctgtctggttgaaaagagtcgctcagggaactttcttgagggtatgtttgcattacatctgcacaaaccacttttacttggactgtaagtttatctaggatgatgggtatgtagggggagtgaggatgagattatatgggacagtttagggcccagccaagtgactcccttgacaccgagactgaccaaagaagaagaaaggaattgaaaattctcttccttttccttagaaagcaccttccacatctctacttagctcaagcagttagctcagacttcacccctctgctcaccacatagcttcccacactgaccacatcgacaaaagtaagagaactttccaccttccctgacacacaaaagcccctgcccagatgctatgagcttagcagccctagcaaaggacagatgtaaaggcaggttgaagctgggtgcagtgactcacacatgtaatcccagcactttgggaggctgaggcgggcagaaacttgagcccaggagatcaagaccagcctggccaacatggtgaaaccccacctctactaaaaaaaattttttttttttttgagacagagtctttctctgtcacccaggctggagtgcagtggcacgatctcagcttactgcaagctctgcctcccggattcacgccattctcctgcctcagcctcctgagtagctgggattacaggcgcccgccaccatgcctggctaattttttgtatttttagtagagacgaggtttcaccatgttagccaggatggtctcgatctcctgacctcatgatccgcctgcctcggcctcccaaagtgctgggattagaggtgtgagccaccgcacccggcctaaaaattagccagctgtggttgtgcacacctataatcccagctacttggggggctgaggcacaagaatcgcttaaacctgggaggtggaggttgcagtgagctgaaattgcaccactgcactccagtctgagcgataaaggcaggttgcattctgacctagttacctgcttttggtcttttttgcataacctagcccaaaagttttgttcttaccatattcacttctaagagtagacatttttacagtggatacaaccttattgcattattttccccaaccaaagataacttacttttcagggcaatacaaagagccatatcaacaatggctagagttaagttatggagatctgatggctagcagaaatggaagaccctgtgtacaaatgaggtttaagcagcgccatgttgagtcctggtaacccactgggtaacactgatccagtgttggtcagtttcacacatttacaagagtgtagaactctgatcgcagagtagttgtggaacagcattcatattttacataatacatgttagattatatttgtcctatgtaaactctgacaccaacctgtttaaagtaatttgaaagatgagatgcccccaaataagttcttcatttgaaaaaatagaaactatatccacatccagtcgtctgttttacaaaaactgctcttgtatgactgaagcagacacgcgttcacctatgattatgctccttgatttctcacatccagcagagtccttgcatgggtcaaatctttgcacgttcaaggtcctggctttcctcagagtaagcctgctccttttgcttttctgcttggggtcaaccctgatgactgtcaccctgattcctgccttcctacttcctccagagcttgtctcatcaattgctcctagtgtcctatcctacatcctcaaccaccctctccttctttgccttccccctcagcccataacaatgcttaaatctcttacatccaaacagaaactgtccctttcctctgtattctcccactagtggccatctcatctctcttttttatatataaacttctttatgctttttttacagcctcatatccattaacccttcacaggctattatcctattgctatttctgctaacaagcaggctcatgaatacatacatgagcatcaaaagcagctatggggcagtgatgaccagactcagtacctggttaacaccttcatggatgttaaacatttcaatggtgacaaaggaagtggcttcctagccccaaatacctgatctctaaatagcatctatgatgatgcgcactgagctgaatagttacagtagtggtctccggattcatgccactctagtatttccaaccatttttaaggcacctcatttatttcttttcttttcttttcttttttcaagatggagtcttgctctgttgctcaggctggagtgcagtggtatgatctcggctcactgcaacctccacctcccaagttcaagcaattctcctgcctcagcctcccgaatagctgggattacaggcatgcatcaccacgcctggctaatttttgtatttttagtacagacggggtttcaccatgttggccagactggtctcaaactcctgacctcatgatctgcctgccttggcctcccacagtcctgggattacaggcatgagccactacacctggccctcatttcttatataaaatcctctaattatataaaatctgctaatgcttcaaaagcctagagtgttttctatctcctatactgagccctgactaataaagtttgtgagactgtaagtagttatagacagcagagtcaccaacaaggatttgggaatggttatctgatttggttgggtttgaaggcagggctgattcaattgccactgaaaaatgggaaactggcagcctgtggcacagttgcaaagagttatttacactgtcacactgctggtgggcttacattaagtgcctcttgaagcatgccttttggtgtatcagtatggcaagaatggggcaaccaaggactacggggcaggctgaatacttctgagtccccgaagagcttaaagaaaggctcaggcctttacgtttctttaaattctaagctcaaggcaaaattagaagattggagagtttctgtaactgccatcaaacaatctctaatctcttaaactgaatgggatgatgtccaaaagtaagatgccaaagctgatcatgcgagttttaaatcacaaattaaattgaattcacagcctcactgggtcttctatgtgcaagttagactttggttaagaaagagtggaactttgagaactgaaatgagaacagttgcgcaaattcagatgaatatgagtccttggagcccccaatatccactgtgccttgctcaccagcagaagcaacccttcttccccacccaatcatgccagttctgctttgcgtggagaccctgcagtgacctccccgagatagttaccttcaagaagatgccaaatatcttcatgttccaccacaacaattatcattgtcttgtgacctattaaaaaaagccaaatcccatcatgcctcagggagacaagaaagtttagctatttaaatatttgcaatttcctgcttatttatagctctagaagcccagggaatatgtgtgatcatggacccatataggggaaaggctagatcaaacagaagggattattatcatcatggattcgtttgctagattttgaattcagtgatctaattcaagagaattcagttatctaattcaagaagatcaaatgaaatctggtttcaaaagaggcctaccctaagtgttatcaaaaattccttgacataatgtagaggcaaaaaaaaaatccaaagacttggggagttaataatgttaaaatggaaatactatgcatgacctgttcattcaccttccgtgttggccaaaagagaccaaagaatgtgctcccttcactaagacacagagaagtacatctgtggttcaagcaccaatatcctttaaaacaatacagtgattgccaaggttttttgtttttgtttttgtttttgttttgagatgaggtcttgctgtgtcacccaggctggagtgcagtggtgtgatcatgtttcattgcagcctcaacctcccaagctcaagtaatccttccacctcagcctcaaaagtagctgggaatataggcaccaccacacccagctaattttttttttttttttgagatggagtctcactctgttgcccaggctggagtgcagtggcatgatctgggctcactgcaagctctgcctcctgggttcacgccattctcctttctcagcctccccagtagctgggactacaggcgcctgccactgcgcctagctaatttttgtatttttagtagagacggggtttcaccgtgttagccaggatggtcttgatctcctgacctcatgatccacccatctcggcctcccaaagtgctgggattacaggcgtgagccaccgtgcccagccacccagctaatatttttttatcttttgtaaagatggtgtctcaccacgttgcccaggctggtcttgaacggctgggttcaagcaatcctcccaaagtgttaggattaccagcatgagctactgcgcccagctggtagggctgtcttatgtaggagatactgctgtagaaacaggctgtctgagttcagttgtgatgataggattctggagtggcagaggacaaatggcagcagtaattgtctcccatgtaagtggcaggaatatagtggtaatcagaatgttttgaccctcaagaatgaggttatgtattatggtcttcctaggattgaaagagatggacagaaaaaatgtcaagaaaaaaaagtcctaaaagtggtggactgatttgagttctctcaatgaaaagtcagatttccttacccaatttccagaaactgatccaatttacttttgatcccactgaataaagaagccagatatccatgaggaaggatcctatggcactgtcccaagtatgaattgtaaacttcttgtctccttaagaaaatcaaaggtatttgccagggtaattgtgcactggggaaaaggaaatatctagactttgggagtattactggacactggttcttagacagtgttacccctagggacacaaaaggcaactgtgatccattagtagaagtaaggacttaggagggtcaagtgatacatgcagttttggccagactccatcttggccaagagggttcgtgaacccattctgtggttattttcccattccagaacacaaatttggaataccattttggcaagtggtagaatctccacgctgatttccttatcatggaaggaagggacaagtgaagtgaaccaagcagggaatcaaaaacaatatcacatccctgagggattatgtataaataccactgtcaaaaactcaaaaggtgaagataggggcagcagtgacagcatagttttagatcttgctgaatcttcccataaaaacgtacagaaaaaattggtataaaaccaaacacaaccaatatttacaacaaagctaagtgatgaggtatccccacaaaccccaaaacacaaatgggtgggggaaaaaaagaccaacagtaacaacaagatgtacacgttatcagcatctgtgttggagaaatcagaggaaagcaacaatgatgcaactgatggactgagaattccccaataaggcaacagatactgacttcaagtgcagcgggctgatttgagaatagcagtagaaattccaatagtggctgagtgtaaggagtaaggcctttaagtggctggagcagtcaaatccctctgaacccttcaaacaggcccaacaaggcttccttccagaacagaaccacacaggataaacttctgggagtgaaataggagaggggcagggtaggagcaacagagttaaatgaaaaagaaggtccagatcgaagtgcaggaggggaacagagccaggaaatctcagggaaaaaatgaaaaaaaaaagaaagaagaaaaaaaaaagaaaagagagagcctttgtaaagtgaaaaaaaaaaaatctcaaacaaacatcttttttaaagttcaataaaaccaaaaccaaatttacattaaaatgagtaacaaacaaagtatcaaaatcaaataccatacaaggtttctattaaaaggtgaagaaaaagaaaaagaaaaagcagaaggagaagagaaggagaggaaaagacggaacagaataatatcgctatagacaatgaaagcatatctgaaagtcatgctcaaaaacagatcaacttggaaggctgaggcaggagaattgcttgaacccaggaggtgaaggttgcagtgagctgagattgcgccgctgcactccagcctgggtgacagagcaagactctgtctcaaaaaaaaaaaaaaaaaacccaaactattacatactattttaaaatgagctgaaaaatattaagaaaataatacaatataaataaaataacaaatcacaattagaaaaaactcagaaatgacataacagacttcaaggaaaaattaccaataaaaggaaaaaacttttttataaagtgaagattaccaaaggggaaaaataaaagcaaataaacatgacaagtaatgccttaaaactggggggtagaaggaaggaaaaattttacaataaaaaattaatgaggaaaaataaagtcaagagaaagtgactaatgttgatgatgggcagataaaatccaacatatggatcacaggagtacctgaagcaacccaaagcaggggaacagatcagatactgaagtctttccttaaataaaaaataacaatatttgaaattgcttactgaaagagcacactgtgtgcttagtaaaagatctaaaatggttgtgccatttatatcattactgtctctctctcttttttttatttattttttttgagatggagtcttgctctgtcacccaggctggagggcaatggcatgatctcggctcactgcaaactccgcctcccaggttcacaccattctctcacctcagcctcccaagtagctgggattacaggcatgcgccaccacgcccggctagttttttgtatttttagtagagacggggtttcaccgtgttagccaggatggtctcgatctcttgaccttgtgatccacccgcctcggcctcccaaagtgctgggattacaggcgtgaaccaccgcgcccagccctctcttttataataaattctcacctgggtgtgggggctcacgcctgtaatcccagctctttggtaggcaaaagtgggcagatcacttgaggtcaggggtttgagaccagcctggccaacacggtgaaaccccatctctactaaaaatacaaaaattagccagccgtgatggcaggcgcctgtaatcccagctactggggaggctgaggcaggggaatcacttgaacccaggaagcgcaggtttcgatgagccaagattgcgccactgcactccagcctgggcgacagagcaagactccatctcaaaaaaatcagtaaataaatattctctgttgtaattattgatgtggtttctgtctcctgactggacactgactgatacagaaaatggtaccaggacatagaccctaagatctcaaagattggatttggagattgatttttggccgtgtctgtggactggaaaaaatgctcaactctttgtcaatgaaaagtgggattctaggtaatccatgtcatgcagtggcattcacaattaataaaattatcatctctggtcaatgtgacgaagtgtctactgaagcattaagtcatattctagtaaaatgactgagctttaagaaaaaagaaaaaaaaatctttcaggcttctaggcaaatagtgcacatgactcaaagggaaaaaaattatattatcatcagatttttcaacagtaactttttatgccagaagaaaatggagtaacgtacttaagatcctaaaagaaagaaaatgtgagccaaggattttatatacagcaaaacagacctataaatataaaaggagcaggcaaactgttaacatgcaagaactcaaggaatattgttcccatgaacccttcctaagaaacctactacctctgagctgaccaatacggtagctactagccacatgtggctatttatattttaatttgaatgaactaaatgaagtaaaattaaaaattcaattcttgccgggcgcagtggctcatgcctgtaatcccagcactttgggaggctgaggtgggcggatcacaaggtcaggagatcgagaccatctggctaatacagtgaaaccccatctctactaaaaatacaaaatattagcggggtgtggtggcacacgcctgtagtcccagctactcgggaggctgaggcagcagaatcgcttgaacccgggaggcagaggttgcagtgagctgagatcacaccactgcactccagcctagtgacagagcgagactctgtctcaaaaaaaataaataaataaaaattcaattcttcagtcaaactagctatattccaagtgcttaacagctgcatgtggctaatggctaccacactggacagtatagatatggagcatttccatcatcacagaaaattctatgggatagcaccatactagctagcaagcttcagaccaccaaatgattggagagtcattgacataagaactaatggtgggtattagatgtatattcaattgcataactaagactaaataagggttaaaagggagggattacattatatgtctacataatctggcaagctagatatacaaaaaccattaaaatgagggagatggaaatagcataggcaaaataaaagtatttttcagttacgctttcggtaatcatcattcatgatggtagtactagtattgctattctgagactattatatgtgtcatgtgggacaaagcaaatagataattataggatattctacttctatcttgtccttgagtagcaggattctcggtgtggaagaaaggagatacaggtgtagcatagaagaggttaggtaaaacaaaccctatagcctgcatctaaattggaaatatcagtacaaactagaaaccacgatcaccccagtaataatgagcttcccttgggcccagactgtggttttgaaataccatttcccatttaaagaaagcgtggatttttggagaaatggcttacaagatgtgccttgaacatgttgacatgccagatggcaaggaagctatcaaagacccctgggatcatgccagaaagattcaggaggcaacttgaagaggctcctattgaccaaagatgggacaatttcagcttcagtaaaaactgcaatagattaaagttcatcaaatatgtttaaatccatgagtttataataatattaaagggaaaagcaatgaattgctcaccttgtgaggataaaaaggaatccaattcacttccttcagaattaaaagaaagaagcctttaccttgcctattccatatgaactggctaaccacatggtgcataaagagaagggtctctttataaaattatttcagctcatatgaaaacaaagtgatagaaagtcacaattttaaaacctctaataaataaatgagtctaggccttgagcatcacttgctgctaaaatcacaaaaagagcaaaaatcagatagatattatatgccttctgatgaaagaacattgcctatcgtattgccagaggaattgaatttgagtccaatcaagcctctggatccagctgccaacttacagaaaatcagaggttagagaaacacattgaattgctccatgcatatgcaatttaaaactgtaagatgttgggaaagatttaagactttgggaaactctacagttcaaataggctggtataaattgtaagaaaaaaaaaggaggcacagagaaggaggcttaggttaaaaatgactgaaacatataaattttaaaatgggcatgattaaactataatatttaatgatgcacacttaggtgataaaagctttaaaaatgcaaggaactgatcacttcatagaatttaagatcgttgttacttttgaagggaaagagagagctgcgattgggatgtggcacttaggggtttctggggtggctggtaaacttgaatttcttgactcgttggttacaagaatgttcaccttaaagtaattcaataagctattaaaaataagatttgaagtcaggcatggtggctcacgcctgtaatcctagcattttgggaggctgaggcgggcggatcacgagatcaggagatcgagaccttcctggccaacacggtgaaaccctgtctctactaaaaatacaaaaattagctgggcgtggtggcgcgtgcctgtagtcccagctactcaggaggctgaggcaggagaatcgcttgaacctgggaggcggaggttgcagtgagccaagattgcaccactgcacttcagtctggcaacagagcgagactccctctcaaaaataaataaataagatttgaaatatgctgaagtcatgatttttgtcatagccccatttaattcaccaccatggccactgctaaaaatgtacgggtttgttttgctttgttttgttttttagagacaggatatcactctgtcgcccaccttggagtgcagtggtacaatcataactcactgcagcctcaaaactcctgggctcaagcaatcctcctgctacaacccttcaagtaactgggactacaggtgtgagccactgtgcctggatcgagtttttgagaatgacaatggattctcttaagtttagttatgtggcgcgtgtcaattgcaattactttttcaaatatgttctctttactagagtaaatcaacacagccttggcacttggaatgcaattacggatctgataaatgctttgttctctatcccaataagcagaaaataccagaagagttcactttcatctggcaggaaagcagttcacctgcactgttttacctgaggaccacagcaactctggctctgtaaacatttagccaacaggccattgatcgcctcccaatcccatgggacatcatggcagttcagtacattgatggtatcgtatccttaaaacactgtaaataagaagcagctgtaatcctagatgccttgataaaatgcctgaacatgaaagggtctgagggaaacctcacaaaaattcaaagctctgccacctaagtacagagatgctcagacggcatcgtaggattttggagcaactcataccacagttggataagctgctggatccatttaccaaataacacctaaggctgccagctttgattaggtacccaagcacgtgacaactctccagctggtccgggatgcagcatatctagcagaatcatggcactcaaagtgtgtaaaacagatgaggacactggacagataactccaagagaataatcagaatacaggcacctgggggttagagcaaagccaaaaaaaaatttatgatcaactagatcaggaactcagccattcttccacaaacacatagcctttttttaagaaacatctatgttttcactaatagagactaactgtttggccatgggacaccaagggaccatgtgatctgagctgcctgttattcactgtgtattatctaacatgtcaagccatcaaattaggcatgcatagcaatactccaaaattaagtggaagtgtgggatgtgagagtgtactaagggaggtggtaaaggcagtggtgagctgtgggtcactcatgctcccagtgcacctattccagtgggactgctgcctcttattcagctcactctgaaagctttgtgggcaatcgcttacaagaagtaacttgaggaagcaaaaaaatctgcaggactatacaccagctaaaagtggaccacaggagcttgatgccctacttaagggtgactccaaaggacagtagaaaagggtattataattatttcagtaggaaaacttcaaatggtacatatgactgtcccctttgcctggaaggaaacagataaggtacagatctacagcaatttgtggctagtgctgaatggtttagctagatggttagacttaggagaaacaaggttggagggtgttaacaagaatgaatgggagagcattgtaataatgcacctcacagaatggccccagagtgtaggaatatttgtattctgcatggatgttcatcaaagggcacccactgcagaggaggtctcaacaacagtaggaaaaggatgatctgatctgtatcagtcagcatctttcctattcatgccagagcttgcccattgtgttcacaaataaagtgtccatagcagtagagatagctgctattcatgggttcaataatacagaaagatttctcccatcttgttgggtctggataccactgatgctgagtgcttactctcccaagtcagagactcaatttagccctctctatgataccataccctagggagaccagagagtcaactggtttcctcagtaaaatagaaatttattctagtaatcccggcactttgggaggccaaggtgggtggattgcttgagctcaggagtttgagaccagccttagcaacatggtgaaaccccttatctaccaaaaatacaaaaattagctgggcatggtggcacacatctgtggtcccagctactctggaggctgagataggagggtcgcttgggcccaggaggtggaagttgcagtgagccaagatcgcaccattgcactccagcctgggtgacagagtgaaactctgtctcaaaaatacataaataaatctgttctaggtatggatttacctagagtaaaggtattatcaccatactctaccttaagaagaatcggatagtgatgtttaaggcagggatgaagggtaagaagatcgaccaggcctgacagctcacgcctgtaatcccagcactttgggaggccgaggcgagagcaatgcttaagatgaggagttcaagaccagcctaggcaacgtagcgagaccccccaacccccatttctacaaaaaatgtaaaaattaaccaggtgtggtggtgcatcccctcatcctggctactcaggaagctgagacaggaggattgcttgagcctaggagatcagggctacagtgagtcatcatcgcgccactgcactccagcctgggtgacagagcaagagattctacctcaaaaataaatcaatcaacaaggataggaagatcaagtacaaagtaccattaaaaaaaaaaaaacccaaaagctacttaaagtcaggttatatctgccaggttatatctgccacaatccctgtaacctccctgctgtcgagcttctcatacttcatgatcatggacactcatgagaacaggtgcagtgtccctgttgcttgccattttatttgctagtgcttagcacgttcctgggacataggagagctcaacagatatgtactaagtgttttctgaatctcatacattttaatatttatttgctactacttagcaccgtgcctgggacataggaaagttcaacagatatatgataaatgctgaatctcttatatatattaatatttatcataatgctttaaaaatattttggtctatgcaggtactcaacagatacttgttaagtgaaaaaaaaaagattataatcaactaggtcaggagtcagaaaactacagcctgtgggctcgccacctgttttttgtactgcccatgagctacgaatggtttttacatttttaaaaggttggaaaaaatcaaaagaagaataatatttcacaatgcataaaagttatctgaaattcaaatttcagtgtccataaataaagttttattggaacacagccacactcatctgtttacatgttgtccagggtgattctgcactacaacagcagaattgagtcgttatgacagagatcatatggcctgcaaagctgaaaatatttactatctggtcctttacagaaaacgtttgctgacccctgagccagatcttccaaaatgtggaacacaacagtcttgaagaagatggttaatatagtgctgtttccttctttgcccaatatcactccttcacctcaatttctactaaagaaaacaaactggttttcttatattccatggctctgaggtaaggtttattctgaaacttgccagtacccgtaggctcctcttggccatgtctgaaataattagatatacagtagccaagatagataaatacacacagagagatggaaggagaatgactgagaacatcagaggaaaagatggaacaccacacttgggtgcactaaatccataagggaaatttttcttctgtcagtatcaattcaaaactatgtaattaacactatttttattatagtgagatgtttattgcgattactgacagaactgtctcaaaactgatatttagtatagtagggtttgacctgtatttggagaagctatgttttaaaataatacattgagattcaccaaggaaggaaccatcaactcttcccaaagatagaaattgaagagtttcttttcctgaaataattatttcattaaatgttacaagttgatatgttttagtgatttaacttcttcatcagtctctgcaaaatgcatcattccatctctctactactcatctggaggaaacacgtgctagtaactgacttccctttatttttctctacattccagattctttatcgtttaactttattacaggcaagcagagcttggtccgtattagagtgacaaagactatttccttaattactgtacagagataatagcatttattctggcagttcccgtgttattcaatcaggcaagatccaatacaaaaaaaagctgatttgccaaaagggagattagcataagtgcctacagtcacattctattttttgaagtttacggctttcagggagcacttcttgttggaagttctatttaaaaattatggaaggattatgatactagtgtccacctgatagaggaaaacaaggaaggcaagtgggccattttagaaatcacaactgttaagctaattgcaattttgaaagtaaacctaatggtactgcagaaaacaagaagaacgactctaatgtaatcctggcagcattgtgatttcaaactgctaaaccatgcaatgtatttacttttcctttgtgtgggcttgcatatttaccttcaccaaggatatttctctgtttcgtggttatacattgcagcactcatgactgatgaattattgtcaaggacaaactaaggttcttgctttttaccaaaacgactttttataaaacacaaaacttttccacaggggaaatgcagatttagcattatgcattttcgttaacaggtttaacaggatggcctactacaaatggtgaataaaatgagagcaaacttgggaaagcaactgcaaaggtaagattgaattaagggtaaatatatgcaaattgtcccagccctaacgctgtcttctgaggaaaatgccagtgctactgattattttttggaatttaaaatggcagtcacccaattgttttgccctttactgcgatcactagaaggaaatacttctaacccaacccaaaatgtcacttctaaagaaaaagtatgtacatattcccataataaccataaagcatgggaatattttgttttattttacttctttatcttttcaagctgttaagactatttcttttttgttttttacatttttaagatacatatggggtctcactatgttgcccaggctagcctcgaactcctgggctcaagcaatcctcccatcttggcctcccaaagtgctgggataacaagcatgcaccaccacaccctacatccccaacaaacctcttctagggttccttgtaatcctatctacagtatcatccagaaattctcattgagtccatttcaacacctgaaaagacatgcgatgtacaggtacttctctgtaatgtgatacacatcctcttggttaaagggttttaaagtatctcaggacttaacttacaaatctcataaataaatactgtagcctgagtttggcctcaaaaaataagaaaggatacataaaagaaaaaaagatctgatggaaatagggaaaaaaattattatttgttaatcctgagtggtgggtacagagatgtctgtcattttctggttttctgtattggaatgcttcataactttaaaaattgtttttctaaggccaagaaaagctaaagaagttaccaggtgctcaaattctaaatgaagaaacgagaaggactagggaaaattgcactgcatttttctttttcggggtagtaaattgaagaaaacgctgaactgcagttgcattgaagggacaatgatctagggggtccctgggagcagtattcctattccattgaaggaggtgagccaagatacttataagctctagagaacctttaacacaggaagctatttatcataacaagcttggttgatactgttcccatactgaaccaattaggttcgcctatttcgtcatacttcataacttgggatgataggtttccaagtatggtacagtgtagtaattgaattttgatcaaacacacatggcccataacccactatgtgaaattttcagaacagttcacagcttttaaatatccagtcaacatgttgccaaaagtacaggatgtacttgatgcaagggggagagaaaggggagggctgaatcttggtagagttgtaaaacaaatatttttgttcttgttctcttcttatttttcaaatagcagtggggaaaggccatgggatatcatatcaaaactcaagtcttccccttgcttgttccatgtgcgtaaacatccttaagtctcatttcagatcagcattttcttttgcatgaaactattttcacgtcacaggcctgttacacacgacctgctagcattctccttccagcactatccaaaaagtatttcttgacaacctactatatgttagatactgggtctcctggtaaactcttttgaacaaagagacatgatccctgccttcatttgatctactgtggatggagagacagacataaaatacataaaaacatcaataattttttataattgcaaccactaataagtaatatgaaggaaaaatagggcatcaggagtaacgataatggggatgtgatttatccagaaaggaggaagtagaaaggagaagcatggactgcatttccaaggcagtgccatgtatgttgaattctgaaagatgagaagtgatccaagagagtgaacgctgagagaaagtattcccaaaagaagtaggcaagtaagcatatggataggccttgaagtaggcaagagtttggcaagttcaaggacctgaagtctagtatattcagtgagagagccgctaaaaagatactgggggccagaccacacaaggccatgcaaaggattatgcaaagtgcagtcactgaaagctggtaagccagggaatgacatgatgggaggcaggcaagactagaagcagaaagactaactagaaggctttggcaattgtccagctgggaagtgataatggcttggaacacagcaatagcaaggatggagaacagtgggcagatctgggagatattgtggagaagaactgacatgatttggtgataactggatgtgggaagtgagggagagggaggctccaaggacattttcaggtttctagtttgaatgacttaatgagtaaagtctaatgaataacaacttgttagtataatccgcaagactacaccaaagcagtaggagagctacacaactttcacaagctcccatgtctgcaggagtgctctgctctctttggattctgtaggaacagaggcatcaatcaggtgctgggaatacagaaattttccaccaacgtgctcatcaaactttcctttaccgtaagccaaaagaatgtctctgagctatgaacatcagactttaatataaactttaaaatcttactctcagctctacggacatggttataggtgtctggcaattgaactaggagagcctgaaagtaaacacattgtctcttggaaattgatgaaaaaaccaagcatgtttctttattcattcaaaagattttactgagcatctttagcctgagaagtaggaggtaaattagacgtgttccctgcctgggcaaagagtatattctattaggggagaaagaggcataccaagatgtgcgtaacacagttatgcagtacgtagtatgttacatagatctagcaagacagcgacatttaacagatgacagggagggggtggaaattcggtgcatgggcacggctatgaaagatttcaaagaggctgtatttgagacaagccttgaaagaccaacaagagtttactaagcagagaagaggatgggggagaaattcccagaggaagaaacagcacaagcaaaggcacgagggtcctgaagagcactgggtatttggggctaaagggtaaaaagagcagggtatctgattccagattaaaatgtcatccctctattctgaaatctgaaaaatactagcagcttgatttgtccacagtcacttgtgccaggtagagaatcctaattcgtgtaggcccaaaccaacaagaacctcttgatgtgactactgcctgagtattgcagtgttcgtgggagctttaagtttacctatccagatgggagaacctctttcccgaaattcataagcagtcccacaactccgccaatgctacaggacccagctttctgaggcacctagaaagacatggcagtggcccaaggtgatgcttaggtgggctggcgaatgcacacaatagaatgtctgtctgtgacatttaatctcactctggcaaactggtgcagctgcccttgtacaacaaacgggaaggcacagtgagtgaccaccaccaaaaacaaacaaaacaagtgtgtgcgtgcgtgtgagctttaaaatttaatagctattcagacagtccttagagaaggaattggcagcttcggcctccaagactgctcccccacctgtctccaggcactgcaaacacagctgtgtaagaaggagacagtcaacgcttccaaggaaagaaatagtgcagtcttgggggtggggtgatgatgagagcacctttctcacaaacccacgtgggacagggccttgtctagcaaccgcaaaaataatcgagcaggacgtggtcaatcaagctctttataaaacctcatgttaagtaaaatcattcaagatccaactcaatggccaccttaaacccatgttttaaaagcatgagacagagcacacaattcatgctcaaaggagaacgaggtagcatgcatgctggcaagacgcgcattcaggtttgctcccggtatcaagatgagacgtaaagacgatttatgcactgtcatagaacttgtagttcctcacacaaaacacagaacttcctgggaaagtgcctagaaacttctttatctgtatttccccaggctgcaaagtgcacacatttttaaagttcaactcttaaaaaaaaaaaaaagtcagcagaggcaagatttcaacagacgccggtccaaatgttagcaattctagagtggtcaggggtttgccgctcccaaaagtaagggggaaattagaagaaggaaagaagtcgttttcgaagacgaaaaccaaagcaaggaggtatttttggtatcattttaatcacaaaatagcacgaatgcggtctgtgcctgtgcgctacccaaacgtcgatttgaataccactgaacgctagtttgaaaatttccatttttgtaatttgctttcttttgttaagccaagacttgagagaaacctggcagccgtctctaagtctggcacgatttcacctcagacgcactcggttggtttggatgttgagggagaccgcacatgagagagggagaaggaggaaaagagagctggagagcaaacctaccgctcggcggccgccgcagagagcaggcccagggcttctcagccgggggatctggctccacctacaggaatcagaaggcaaacctagtagacgcctcggcgtctgcaggaacccggtgggggctgggggaactttgataattgcctagagaatttcctagccagtaggaatgggggtcggtagaagtggtaaggattgggaagcagggatttccatgaccagattacccacagtcatatcagattcagcgattcttatttggaggagaaaaggtatcatgtcacctcctatgacctaggaattttaactggttccaggtaaaccccatttgaaagcaaaggcagcacctggtcccaggacaggcccagcacatagcatgctcaggcaataacatttgaatgaatgaatgaatgaatgaatgaactgaataatccaatctatcaaataacagaaacctaatatgataaaaagaaaaccaacccccaaccccaacactgtttttcaggtatatgtatgagttgtcaggcatttttgatggctagtaattactacaaaaatcctgcaccatgtaggctagtcgtgttccacctccgatgtgccagagcagtgattgagtaccaccgatttcatcccatgccctcatttgccaacgaataaacagaagcttgaagaggttaaatgccttttcccaggtcaaccagtttgttggtgacagaactggtttggggctaaattttcctgacctgtctggtatttgttttctaagggcaggagactcattttgcattggcctgctggatgccctcagccgattagctctcacaggaggaagttagcttcccccacccacctgttggcctgtccctgggcttctgccccagcttctgctctgggccacagcctctgctcatgctgctctactccaaaaatcaaacgctgcctggagctaatgccaatggttgctaaacttatgaattcatttcctaaagcctgagggacagaatctttgagcctgtggtttagtaagctacaaacaggcaggtgctttgttttggcaacacaggtgtcttatatacaatatctcctccatctatttacccaaagcacttaataagcagttactgagtttcccaatgatagttatagaagaagatgttatttaccaattgaaaaggaatttttgccgtaggcagttagcactcagtttccagatgaaaaggtgaagatccttctgggaagtgagatgctgtgtgcattatgtgagatgaatatgatccagggaaagatagcaattaagcagatccagattctttttttttttttttttttttttgagatggaatttcactgttgttgcccaggcttgagtataatggcgcaatctcggctcaccacagcctccacctcccggattcaagtgattctcctgattcagcctccagagcagctgggattagaggcacctgccaccatgcccggctaattttgtatttttagtagagacggggtttctccatgttggtcaggctggtctcaaactcccaacctcaggtgatccactagcctcggcttcccaaagtgctgggattacaggcgtgagccactgtgcccagcctagcagatccagattctaaccacaacctgtctataaaatggaactaacactgtcatgacctctgaatggattaaaaattaatcattattattaatcacaatattaataataatgctgaactattactaagtgcttactacattccaggctttcaaatgaccactttacatgcattgtctaacttatcctcagagcaaccccatgcgagttataattattacccccattttacagaacaagagaactgaagctcaaaagggttaaaatactcacctacagtgacagtttacaatggtaaggctagtggttggatcccaactcctatctgactcgggacttcaaaacattatgtaacacaagaaatgcctattagctgattctatgccagtggcattcaaatatcaatctctagttctgagctttcaaaggaactctgtgcttctattcccaaatgctgaaagaatatcattaattatatattccactactgtctcaaacttaaaagggcctaagccaaactctttccttcctttcataagcatttactgagaaccattcatgttcaaacctccatggtttggaatctagggcagtggttctcaactgggggtgattttgcactccagaggacattttataatgtctggagacatttttggttgtcaccactggggctttggagtgctactagcatctagtgagtacaggccagggatgctgctgaatgttctacaatgcacacagtaactcaccccccaaaagaattatttggcccaaaatgtcaatagttctgaggttgagaaattctggtttaggaatacaaggatgaattagatagctaaaaccaatcatctgatgtaagagatatacatataaattttaagcacgaattttacctagatatctgtgtgatgacaaggggtccatcaagagctatgaggtttattatgggctggagaagtcttagtggaggaggtggcacttaagccaggcatcaaaggagagataagatctggattctggataaaaaagaacaaacagtgtgcagggtgtgggtgtacatgaagaatgttggtttattttaattggagtggaggaggtgtgaagaggagtagtagagaaacgggggtaatattttgttggggccagaccaacaggcctgaatgcaaagacaacttcggactttaggtgtaagtaataagaagcgatctaacattttcacatggggtgtaatatgatcacaatgttctagggagatgaatctagcagctgaataaaaaatggattgcggagggtaaggagctggagacaagaagacatgttataacactattgctacagattttgctattttaaaataaaccacttggctatttttgttattattagtaccaaacaataactgagtgattactgtgatttaggacctaagctaaacacaatatatatataatcttacttaatgtttctcactttcataaggatttccccattatatagataaggtaacggggtcttagactggataagaaagtggcagtcagtttggagtcaagctctgactaacaaagcctttgctccttactgctttgtgtgctgggcacatggtctggattcttaacctcttgatcaaaccagactgttctcatttataaggtgggcaataaaaccaaacagctcagacccctactgggaatgggacggtctaggacaaacagcctcgggaaatctgctcctccttggaggctggagctaactgtagggataaaaggagtgtttctctgggctttgccgggtgtggggagcatagacatatgtcctattacaaatacacctacataatagcttccttaagtctattttaagtctattcctcccaaggagatggaaagtaagagtgaaaacgggcacaatctgggacatctgaacaaaaaatcagacttctcatgtcaggcctctcctgccatgatgaggttgcaagcaggggatatgaagtggggaatagaagggctgtgactccgaaattccttgttgacttggctcctgatcagattgctaactaggttcaggtgtgagctccagttttgtttcagagacttttgggcacaggcgaggaaggagaggaaaggcatcaaatgtatctgtaggcagagtgggtggcagcactagaattggagggtgtgccaacaaaggcattgccatacgtgcctgctggcaccaagtggcagtgacaggcctctagtgggcctgcaactagactgtgtttgctgatccaggactccagcttttgttgtgaaagaagattcattacaaggaacaagagaaggaaaggaccaaaacagtgtccaccactgagcacccaaggaccaataaatgaattacacgtgagaacctccttgaattcttccagaactgtcagatagaaaaagatggtggacatactcacagagcagacagggcagagccagagagacactgtttgatggccacctctgctgttctacctgactccttccaatgcaggataatcttgaaactattttggaaagttcgtgatctacaatttaaagatcaagcactgcagaatttcaagattccaattattctttctaaaatcccacaaatttaaagaaacgtaagttcttgccacacctcttagattttgacattctaatgaatatacttttaaaacaaatcaggatacagactccctctctagccttgatttcctcaaggtcaatgattaaatctgcagcactgggctcaggaggtgctcaagaagtgtctgccaggtttaacagagtgcaacgtttgcccaaagcatcaagaatattcactacatgaattaatataattttaatccaacttttactttcacctagttataaaaaaataaccttatgcatcaatatgcctattttcacacagcctttgcccacagtctgtaagctgtcctaatactaagaccaaatgccaataagcaaatgttttttccttgagaaaatatggaagagggaattacactaaaacatactactcagaaggatctgttccactggttttgctggtagaagtggcataattagacctcttcaaaccaaacagtgtcctgagaaaagagtgaaaaccagaaatccaggttctcattgatatggcctcttctccattctgctgcctttcatgagctattctttacggaattaaagcttgagactaacagcactgctatcaagacatgagggtctctagacaactggaaacatccctggtcacttcacacaccccacaccacaaactctcttgcttgaatccaacctggtagataacatattacccaacattgaagtatcaggttggctttgaatccctattgaatgtctactatgcattcagtgaggagtttcaagttatagagattaagaagaaaggccctaacgtttggcttataagctagttgaagaaaacacagtgcatgcagaacagtggaagacaatattccttcctcaaacactactgagtgcctactttgagctaggccctgtgctagacaataggggtgccaaaagtaaattgattccattttgttcaattcaactcattattcatttggcatttattgattgaatgctcttgtactagaccactgcttttcaaaccttaatgcatatgtaaatcacctgtggattctgattcagtaggtctgggatagagcgtgggagcctgcattgctagcaaattcatagggtatgccaatgctgctggcctgtgaaccacactttgagtagtaaaggactgtacaatatcctagtccctggctatacagaggcaaataaaatagccatgacccctgccctactgaagctgatatgctaacaaggaatgtaaatatcaaacaaggaagtagagtcagcgctatatttccacaggttccacattcatgtattcaaccaatcacagattgaaaacagccagaaaacaacaacaacaacaaaaaaaaacactgcaacaataaagaataatataaataaaaaatatagtataacaacttatttacatagcatttccattatattaggtattatgagtaatgtagaaatgatttaaagtatacaggtgccctctgtcaatggcattctggcaaaaaaatattttttaaaggtaaaaatgtaaaattagataagagagtaaagaattttaaaataacataaaaatagagtatgcaggaggatgtgcataggtgatacacaaatactatgccattttatgtaatgggcttgagtatcagaagattttggtatctgagggggtcctggaaccaatcccctgagaatatcgagggaggatcattcaataaagtacaatgctagaggaagtccaaagttatgttgggagcattgtgtgagggcacctaacttcatctacagatcaaaaaaactttcctgagaaagtgatatttagattgataagaatttgcaaatagtgaaggaagagcatttcaggcagagggaacagcatgtttgaaggcatggaggtgagagaaaatttagatatttaacaaatatttactgagttttcccattgccaggctctgtattgggtggaagaccctggcacggaggagactacaccaggggacacagatatgggagcaaatgacttcaaaataatgtggtaggagctctaacagtggtcagcaccgggcaccagaggagcactgaagagattgcctaatccatcccagaagggatggtattggagctgagccttgacagacgagtgagaataaagaaggagatgtggcaaggtgggagacctggtccttgcctctatggacatagtctagtggggaagttggcaagctgactgtataatactgattatagtgcagtacaataagtgtctaggaacagtgcctagcacatagtaggcacttattaaatatctgttgaataaattaatgtataaatgctgtataatactgattatagcgcagaacaataagtgtctgggaacagtgtctggcacatagtaggcactcgttaaatatgtgctgaataaatgaatgtataaatgctgtatgatactgattatcatagagcacaaaaactgtctgggaacagtgtctggcacatagtaggcattcattaaacatgtgttgaatgaatgaatttataaatgctgtgctagcggtggatacaatcaggtagtcctagaaacaattgggtactaaattaagagttaccaactccaagtgcccatagagctcagagcacaaagagctccaaaagggtgaaacatgaaccagacttgaaggaaggatcaactctgtgggatgaaggtcggtagacattcatcctgagaaggaaaaactaccattgacaccgctagaagtaaagggcgaagaaaacaggaaatgagcacaaagcaggatttcttaatccagggtccatggtacttctggggcttctatgaaaccccagagattataagcaaaatcctaggtatgtatgagaaaggttattttactggggaaaaagactagaactttcgtgaaatagtcaaaggaatccaataagcctaagtaggtcaagactgtctcggggagaacagttaacctacttcagatagcctgtgaatcacttcattcgtgacaaataattatgccaatggactcccaacacaaaaaaccttgggactgagtgagcagcagtggtttcagccctgcctttaagtggcatttttagcatttccttgctgctgcctatcaatccagacctatccacgttgtcagggtatccttagcagctgatggagatgcctctttccaaaggcaatttacatgcaccaaagtccttcctcctaatgattttccagtagggacaattccctcttgttagaatgtccattgtttacatttatctgatcttttctcacaatttccattgagcagcagttgctacaaccacctgagcatcaaatgggcaattaattggaacagatttaataaatgtactagagaagggagctgtatgtttatggactacagtcctttcatggtcatgcataatggaccagacacttttccacccagctgcttatgctaccacagtgaacacaaaatttacatacctggaagaaaacagcttctgaaacattattaatgaatgtagcgaatttgtctgttaggataagctatggtatctccatggcttaactttgcaccatcctattcttggttaaaaatatctacagtgtctccccttactgtcttctttctaaaatataattttatattttaattgaagtggccctttttcaaccaagaatcagggcgttgtgaaagagcaatgtgcattccccctgtttgaaagcacagggaatgtttaaagtttttagaatacaaaataactttagagcggaaaccttagcaactaaactatactagtaggagtgtaatgttcaaagagggggacaatggtcccaatcccctcagggttagacacaccacataagaaatatttgtatccagtacttgatgccacatccttcaagggataaccataggcccatgaggctggtaggtgctctcaaagtgaaggcaaatggcaatggctaacattccatggagttcttgttaagtgccaagcactgtccatttaatcttcacaactaccccataaataaacaattaggggccgggcgcagtggctcacgcttgtaatcccagcactttgggaggctgaggcgggcgaatcacgaggtcaggagtttgagaccagcctggccaacatggtgaaaccccgtctctactaaagatacaaaaaattagctgggcatagtggtgggtgcctataatcccagctacttgggaggctggggcaggagaattgcttgaacctgtgaggcggaggttgcagtgagccaagatcatgccaccgcactccagactgggtgacagagcaagactctgtcccaaaaaaaaaaaaaaaagaagaaaaaaaaagaaactattaggttggtgcaaaagtaatcgcagttttgccattgaaattaatggcaaaaacctcaattacttttgcaccaagttaatattattattatccccattttacaaataaagaaactcagggtcatgcacatagtaagtgaaggaactcagagtgccactcagttctgtctgatttccatggaccctcagtgtaagcagttggtatatttttaattaatcttgctagagataattggtaattatgacactgaaatcattgcaactgtgttgtgtgtgcattagtcttgtctcaccaatcagaataaacacactgtgaaggcagtgaccacattaattacacacgtttactttccaggctaagcacagagctggacttaagcaggtctttcttacatcttttgctgaataaaataacccattttgaaatgcttcaaaaaccaatttacccatgagattattgaaggtgttgggggaaaggacactctggggatatgaatcgttagggacattttagaggacactttgttcataattatcaaaatgtaaaatgtgtaaaccccttgacccacagttatgtgtctaggagtctactcaaactattctatagaaatgctgatacatatatgcaaaaatagatagaacaatgtataaagatacatacatatatatgcaaaggtatataatatatatacacctaaatacgtatataaatattcatatatttcttttttgttacagttctgtttattttagcaaaataaggaagaaacaacttaattgcccatcagcaggggaattgttaaaaaattaggctacaaccacaccttacaatacaatatagccactaaaatactggagtagatgtattaggttaaccatatgaaactgccaatgttttactgctattgacataaataacaatttcatatgcttcaacgtaatatatgtacagatgtgaaaagatttataagaatattggtagttgaaaaaagcaagttgcagaacggtacctacagtatggcatatttatgtttaagacataagacaaacctatagagaataaacaagaaaggtactcaccaaaaaattaagatggttatttctgggcatggcagttttcatattttactctataaagttctacatcgttttactccttcgtgatgaaaattttttataattccttggctgggcgctgtggctcatgcttgtaattccagcactttggggggccgaggcaggcagatcacgaggtcaggagatcgagaccatcctggcctacatggtgaaaccgtgtctctactaaaaatacaaaaattagccggccttggtggtgcatgcctgtaatcccagctactcgggaggctgaggcagcagaatcgcttgaaccagggagtcagaggttgcagtgagctgagattgtgccactgcactccagcctggtgacagagtgagactctgtctcaaaaaaaaaaaaaatgatactttttaaaaaaaatttgtttaatacaactgattccaaagtatttacatattttgtaaacattatttttctgatctacaagctccaaactctcaggaactcaccatgtttcttcactgggccagacaaggagagtaataaagaattaaccttaattattcaaagaaatccagatggtgagaaaagagtaaaaagcagaacttcaacttggattatctcaagacgattgcctgaaaatttcctgcttatttttcctgtttaaacctggcttttcagatgaatgtgaggtgatctgcttttctgtgattcagaacttcatagaatttggcaggccaagaattacaaagaaaggaagaaaatgaaaggaggaaagtgaggtagtgaaagaagatgggcagaacttgagaaagctttataaagtaacagaacacaccccacaccttttgggaacaaaggaacaaagctgatggaacacaacagatgttctccttcccaaaccataaaagcataacactctacaactcctcctcactccaaggagtggccaatgctccttactggaatatctgtacaacaacggtttttgttgttattattgtttccttagaacatggataaaaaggaaaaaacaccattaccagaaactgtcaagtgtggtttaactgtattatcattttatcttgattcttgtttctccctaacaaatttcattgaggtatagtttacatacaacaacatgcactcattttaattgtactcatccatgagctttgacaaagcaatacacctatgtcaccaccactgtaatcaagatatagaacatttccaacatccaaaaagattcctttgtgtcaacatgctttgttcagagtgaaattgaaaaaaaaaattaaaattaaacaaaaatggccaggtatggtggctatgcctgtaataccagcactttgggaggcccaggcaggcagatcacttgaggccaggagttcgagacagcctggccaacatggagaaacctcatctctactaaaaatacaaaaattagctgggtatggtggtgcacatctgtaatcccagctacttgggaggctgagacacaagaatcacttgaacccaggaggcagaggttacaatgagccaagactgcaccactgtgctccagcctgggtgacagagcaagacaccatctcaaaacaaaacaaaaacaaaaccattcctttgtgctggtctatccccactcacaaccctagcccctggcaaccactggttggctttctgtcactctagattagatttttctttagcatttcatataagtagaatcacatggtatgaactcttctgtatgtgacttctttcactcagcataatgtcgtcgagattcacccatgttgctgtgtgcattgatagttcactcctttttcttgctgagtagtattccactgtgcggctaggccatgagcacagttgatccattcgcctattggtaaaactttggttgcttctaatctttgactactatgagtaaagctgctatcagcattcgtttgactcttacttttgaagtgaaattcaaacctagccgttttggtgaggcatggagatgagagataaaactagcatttttaaggcacctactaagagctgggtgcagaagatgaaagacgaggaaagaggggagcattctttccatctctaaagaaagcacaataaggattgccctggccaggcacggtggctcaggcctgtaatcccagcactttgggacaccgaggtgggcggatcacctgaggtcaggagttcgagaccagcctgatcaatatggtgaaactccgtttccactaaaaatacaaaaattagccaggtgtggtggcgctcctgtaatcccagctattcgcgaggctgaggcaggagaatcacttaaacccaggaggcggaggttgtagtgaaccgagatcgggccattgcactccaggctgggctacaagatcgagactgtctcaaaaaaaaaaaaacaaaaacaaaaactttctaaaaattgagcaaggagctggagtctccggaaatgactaaggcccgaaatattaaatatttctgctcatagttgaagacaaaaccttatccagccttggcggctcctttccccctccccctttatcagggacttagttcatgattaggactgcggcatggagggcggcctggagcgtgctgtatttgtgctgacctgggcctcctggcctcgctgctgtcgccgagctgcatgctggtcctcaacgcccgcaacgacgatgcgctgcggcagctggaggccgagctgggcgccgggcggtctgacttgcgcgtcgtgcgggtgcccgcagacctgggcgccgaggctggcttgcagcccgctgcttggggccttgcgtcagctccccaggaccgaggagctgcagcaactgctcttcatcaacaacgcgggctctcctggggatgtgtccaaaggcttcgtggacctgggtgactccactcaagtgaacaaagactgggcgctgaacttgacctccatgctctctctgccggacttgcagcgtctcgaaggccttaccaaccagtcctggcctcaacagaactgtggttaacatctcaaccctctgtgccctgcagcccttcaaaggctgagcgctgtgctgtgcgggaaaggctgctggtaacattctgttgaggtcctggcgtcggaggaacctaatgtgagggtgccgaattaggccccaggtcctgtggacacagacgtgtcccggaggttagcccggtagacctccatggacccagacatgcgaaaaggctgcaggagctgaaggcaaagggagagctggtggattgcagggtgtcagcccagaaacggctgagctcgctgcaaaagggggtgttcaagcctggagcccacgtggacttctactataaataagcccatgtctttggcttcctgaacctttctgcccccactttcagacacacccccagagccccgtggctccccacaccctgccatggtggcagtcctgccttacacagataaacactcatgtctactgtcctaccttcacacatagcctgctgtgatgagcttccaggtcgctggccttaccagttgtcgagagtctggatgtggcaccctggattatgaggaggcttaggagagaggttatgggtattcatgtctctatccccaggaatagaatttaagggatgggaagagcaggaaaagaagctgaaacacacaagagaagaggttgtgtctcctgctcatagctagtccatggggagagggaagagtgacctgagtcaaataggagaacgcatgcagattcgcagatggcctggtagggaggaagagcagagggtacaagtccccgctcacacagatgccccttgctgaggggagcagcagcttctgttgaactttgtgtcctcactctgatgtctacttcctccagaatccaccaccccttccccaggctgggagaaggggccgttgggtgtctatgtacatggccaaggcagatacaaataaaattaaaaaaaaaaaaaaaaaagggagagggttacttaaccttttcagttaaggcaacattgctacctttcaaggagtgagtgattgaagtcaagaaagaagccctgcttgggattagagaaactgaaaagaaatacgatgactcattaaaacagtttgaaaactatagaaaggtcaacaatttaatgcaaatattaattaaatgcctagaaaaagaaaagggaggcaaaagtgagtgaagaagaacatctattgcccttcatatgtgtcaaccactgagctacgagctttacctatatgaattgaattgattttcataaccctataaggcaagtactatttttatccccattttacatatgaagaaatcgtgccacagagaagtttaataacctgcccaaggtaacacacagtagagcagtcaggattccaattcactaactactgctttatcctcttccttggcactacataccagtgactgctggggcaacaaaaatgtagaaaacatggtcccagtctttggaggactcatggggaaacaccatacaatattctgactttgggaaagtgacctaatatttctaattaaaatggaaattaataacccctttaatgtcctccttacaaggttcatttatttatcccataagttcttactgaatatctattatgtgccaggcacagtgctgaaagttcctcatggagcatattttctagaaagaagacaaggcaatattcatgtaaaaaatagccaccgggcatggtggctcatgcctgtaatcccagcactttgggaggccgaggtgggtggatcacctgaggtcaggagttcgagaccagcttcaccaacatggtgaaaccccgtctctactaaaaatacaaaatacaaaaatacaaaaaattagccgggcgtggtggtgcatgcctgtaatcccagctactcgggaggctgaggcaggagaatggcttgaacctgggaggcggaggttgcagtgagctgagatcatgccattgcactccagcctggacaacaagagcaaaacgctgcctcaaaaaaaaaaaaagagccaggcacattggctcacgcctgtaatcccagcactttgggaggccaaggcgggtggatcgcctgagatcaggagttcgagaccagcctggccaacatggagataccctgtctctactaaaaatacaaaaaacaaacaaacaaaaaaaaattagccaggcatggtggcaggcacctgtaatcctagctactcgggaggctgaggcagaagaatcacttggacccaggaggtggaggttgcagtgagctgagatcatgccattgcactccagcctgggcaacaagagggagacttcgtctcaaaaaaaaagaaaagaaaaagaaaatagatatataagtaaatggggggagaaagaatgggggcagaaagagaaggaggaaaggagaaagggaaagaaggaagaagttatttttggacagtaacacgtgctatgagaaaaaggaaactgagtgatgggacgaagggcgattttaagttcagaggtggttgttactttgcctaaaagcagccagagatgttctctgtaaagtgatgacttcaaactgataactgaaccatgaaaagtagccagccatgtgcaggtctagggacagtgaattccagttggacagaaaagtaagtgcaaaaattgtgagtcagacaggtcatcttatatttgtggaaaagaaggcacccagcatggccaaaacatgatgaccaagggggagagtaggagataaaatcacagaggcaagcagggaccagatcatgaaggaactggaattagattttttttgtaatcccaatgagaagctgtgaggaaggttttgaataagaaagtgatgattttttttttttttttttgacagcgtttcactctgttgcacaggctggagtgcagaggcatgatcttggctcactgcaacctctgcctcccgggttcaagctattctcctgcctcagcctcctgagtagctgggattagaggcacctgccatcatgcccagctaattttatgtattttttgtattttttttagtagagacggggtttcaccatgttggccaggctggcctcgaattcctgacctcaggtgatccgcctgcctcagcctcccaaaatgctgggattacaggcatgggccactgcacctggccaaagtgatgatcttattttcatattttatacacttccctggctgctctgtagagaatggatttggtgggactagagggaaagtggggagagcagtaaggaggtggttgcaggctgggcgcagcggcttatacctgtaatctcagcattttgggaggctgaggttgttggattacttgagcccgggagttcaaggtcagtctgggcaacgtagtgagaccctatctcttcagaaactaaaaaaagtagtcaggcgtggtggtgtgcatctgtagtcctagctgcaaagggaggcaaaggtgggaagtttgcttgagcctgggaggttggggctgcagtgagctgtgattgtgccactgcactctaacctgggtgacagagaaagacgttgtctctaaaaaaaaaaaaacaagaacaaacaacgacaacaaagcaagaaagtagttgcattaggctagataagatggtggtggcttggttaatggtagtgactatgaagtggaaactagttattggagtcaggatttattctggaggtgtagcccatacgacttgctaatgaattgaggaattgagaggaatcaagggtaactttcagaatttcagtttgggcagctgtttgaatggtggactccttagatgacaatggaaggagcatatttgtgcttaattttagaatgaaaaagcatttgcaaattataaaatgctctccaaaagtatactgacactgaagaagtaggccaccatgagtcttatagctgcaaggaactgaattttgtcaacaatctgaataatcttaaaagtcgtctttcccagtcaagcttccagatgagaatacagccctggctacctgattgcagttttgtgaaatcctgagcaggggtatcaagtaattttgatgcaaatctaaaaggcagggaccaattcagtcccagctggccccagtcgtatctggctccccattcttggtgggccatgagcagattttcctttagggaaagggaatttgatgactatgtggccctctcaggaaaggctatttgatgacaataatctttgtcattctctcttgttgacccaccaaaccagtcacaaatgctgggttactctgttcttttctcaatcaccacatttgatttcgctgaacttgtaaaaatctattcaacccaggaaaatctgcatctacaaggctggcatctcttctcctagataagaaacagttcccccaaaactgagaccacaactcccacctgcttcttgaaatctttccagaccacaggaccccaaggctgggtgggaccatgatggtcacacagttaattctcctggcagatgtctgaatcctccacagcctatctgccatggcctcttgcttaaaacttccaaaaaggaattgtggagacagataaacctaattctaaattctgactccatttcctgctacctgtggatcatgtacaagttccctaacatccttgggccttagttttttcatctgtaaatgggggatagtaatacccttacagagttgttttgatcgatctaagtgaagcactaactcttgcttctccctgtctccctctagtgatgaaaaactctagcccagttttctctgatttcttttacctgttagtctcgttaacaaccatttttgacacctaataatatgctatgtttcattgttcttcaattgctttgtaagcatgggtcatgacctcccaagaaggctgaagataagcagccatattttatatttcttggggtctcccaaaggatttaggtcaatccagggcatgcagcaagcatacagtgaaacagtaaaacctgccaaattaaattaacaatccatcattatgagaataacttaaaactggctctcccaaatgaactgtcatttaattgaagtttgtcataaaaggactgcctttctaccatatccattttcaagttaaaaaatactgagtgcaaagtcctttgcttttaaaaagaaatattttcatgcacctcacgtttgcatttgaaacaacctcctaaccaaacaaaaaaaaaagagagagaaaagaaactaaaaatgaagcatcctaaattgcacaattccggtgttgtttcctatccctgagaccaagacatgctgaacctcaggtttgcccctttcttttctcatttgcctacccatttgtgtatccaagagttaagattttaaaagattgatttttttttaaagaaatgaatcccaaatctacatacgaactgtaaggttctcatttcaagtagatacaggttacagtatgtttgaccataaaagcagaaaggctagggtaaagtgctgtgaggaatctattggaagaaatgggatcagatagatgtggcgcacttctcttaagtgcatatcacttaactgcataatcagcttgtgctcctaagaattatgcagtctctgtctggcccccattagattgaatgtgttgctactccagttaattgcatatcagcaaattgcataattcaactatacgcaccctgaactgagttccaaatgccatccaggacaatgtaatcaaactagggcagtgaagagctggaatacttatgagattctgcccatttgtcacatttggtttggatggtctgtgctgtgaagaaggcaaaccactgggcatagaccttgtgccctggattcctgtataacctctcccccacaccacaaccactgcatgcagtccccatcccagaactaattaaaatgagtccaaaagaaaacaggatgtcatcatacggaagtgtgattaaaaagtaaaaactctgactcctaaccatggtgctctccttcccaggactgacattactgataaggcagaccagaaaaagcagcagctatttggttctaccaagaactagctgagcaagtgtattagtctgttctcacgctgctaataaagacatacccaagactggattatttataaaagaaagaggtttaggccgggtgcggtggctcacgcctgtaaccccagcactttgggaggccaaggcaggcggatcacgaagtcaggagattgagaccatcctggctaacatggtgaaaccccatttctactaaaaaaatacaaaaaaattagccgggcgtagtggcgggcgcctgtagtcccagctacttgggaggctgaggcaggagaatggcgtgaacccgggaggcagagtttgcagtgagccgagatcgcaccactgcactccagcctgggtgatacagtgagactccgtctcaaaaaaaaaaaaaaaaagaggtttaattgactcacagttccacatggctggggaggcctcaaaatcatggtggaaggcaaaggaggaagaaagccatgtcttacatggaggcaggcaagagagggtgtgcagggggaactgccctctataaaaccatcagatctcatgagacttattcactatcacaagaacagcatgggaaatcccacctcccacagggtccctccaacgacacatggggattatgggagctgcaattcaagatgagatttgggtggggacatagccaaattatatcagcaagtcttttcgtctctctaggccttggttttgtctaccacattaagctgttatgagggttaaatgcaacactgcttgataacctacaaattaatgtagaaacctattacgagatgcagcagagtgaggataatgtgcattgtatcaaggaatataaagagtccaccaagctgatagaaacacttcagaaaagatctgggccacagaaagtggtaaaatagaaatgaaatggaagaaatggtactgaccctgcggcaaactcttcaaagattagatattgtccttggttttgtttcggttctcactctgtaaagattcagtgctctttctcatacacacatgcacacgtgtccttcagtgggatcctcattatgttgcttatttagcagaaatggcagcacatacacattatccagcaataagcttaggggctagttttgaagaaaaaagtacccaccatacaatgctcaaaactatccaaatatcccaaggaagattttgacatgcaggtgcctgcatcttggaatatggaggaaatgctcaaatgccaatttgcgctattggaatgcagccgaaagacttcagtttcccactgctctttgcagatttcctctacaggtgctttattctcaacttgtgtctattaacactaagagtcatattttttagacacctttcctgcgtatatattattcttcctgaatcacctggaggagtatctaagtcactagctgccaaattacagagtagttgactgctcatttattggctgcggaacggtgaagaagagatgattcctagttcagcctctaactatataatcctgggaaagttacttaatctcattaagtctggctttccttttcccacaaaatggggtcaataatataatctaccttctagggcttttgcgaggtttcagtgagatctcatatgcataacatgaggcacaatgctgagttgtgttacaatttgctagcacagaactcacgtattatccaagatggactaatatgagttatgcatcaacattttcacagaatactgaaataatgtttgtttcaacaaaaatttgttttttggggggtttggggttgttttgttttgttttttttgagacggagcttcactcttgttgcccaggctggagtgcaatggcacgatctcggctcactgcaacctctgcctcccgggttgaagcaattctcctgcctcagcctcccgagtagctgggattacaggcatgcgccaccacgccccactaattttgtatttttagtagcaacggggtttctctatgttggttagactggtctcgaactcccaacctcaggtgatccacccacctcagcctcccaaagtgttgggattacaggcgtgagccaccatgcctggccctttattttattttattttattttattttattttattttattttatttatttatttatttattttgagacagagtcttgctctgttacctaggctagagtgcaatagcacaatcatggctcaccgcagcctcaatctccagggctcaagcaatcctcccacctcagcctcccaagtagctaggatgacaggcatgcaccagtatgcctagctgattttttctttttttaatttttagtagtgatgaggtctggctatgttgccctggctggtctcgaactcctgagctcgagcgatctgcccacctcggcctcctaaagtgccaggattacaggcatgagccacctcatccggccaaaatttgcgattttaagtcatttaatctgcatgttgttttggctcacttaagtgcctaataaagggcttttatttggaaggacagcatcatggtataaagcaaaatgtgggcacaaatcattctagaaaactggcaggaaaagaagtgactcagtatttctgctctaatcaatattatcaggtgcagccgtatttcaccattgaaaggacaatgatcgtgtgcctgcaaggagcttgcacagagaaggagcttaaattgagtttaattaagtgctggttgacttgaactaaggacagaaattcaactgaccaattgttccaaatggaagagtctattatttctcaacaggtggatcaaaaactgaacaagaatgttagtctaacattcaaaatcttccaaaatctggctcttttatgcatcacgatgcccctagaacccagtacagcgccccatagataatgtgttcagtgaataattgttgaataagtgaattaagtaatgtctccaacctttgcttccaatcttatcttccactatgtcccagcatgagacctccactcatggtttcctaaatactaacttattcattcctacctgcaagcctttgctcacaagacttccccacatgctatgttcactccttcttcctttatgcaaatttgtctcactttttcttttcttttttttttttttgagacagggtttctctcccgccgcccaggctggattgcagtggtacgctctcggctcaccgcaacctccacctcctggcctcaagcaatcctcctgcctcagcttcctgagtagctgggactacaggcacaagccactacacctggctaatttttgtatttttagtagagacggggtttcaccatgttggccaggctggtctcggactcctgacctcaagtgatctgcctgcctcagcttcccaaagtgctgggattacaggcgtgagccaccatgcccggcctgtcccgcttttcaaggtgtgatggttttgaactgtgtcaacttggttaagctggaaccacattttccaggatctcttttcctgtatgattccaggtttaagttgaccaaaagagaaatttgcaagagttctggaaagaacctcctgattagatgtggtgagagacataaacaaaggggttaacaagttcaaactggtcctcgaatctcagtgttctgagagcagctctcctacctgactgctggccctgatgaccacaccaactccccgcacccatcaccagatgcagagtcaacaaccttctattggcttctccatcagttctctatggtagtcccaccccagagctagatacctgtggcttcccagatttcccttgcaagctcccactcatccacccatggcagtgtttctgatcattgaaagcatggatggcagaaaagaaaagaaaaaaaatctgtgtgtttattccaatgggtagaaagtaaatttaaaagtttactctattgggtagatgatggccaaagtaaaccattctccctaatccttgcaattactcacatacaacctccatgctaaaaagaaataaaaagtaataagtagcaatttgatatctgatcttccagctttcctttctcgaccttgtttccccagatgcttccacaattatgtaatatctaattgttataatcagttcctcattcataacactcatagtggttctgcttacctgatcaaaccttgactgatacacgaggctcagttcatgtaactgctattccttgatcccttctctgactattctagagcaatttctctatgcttctttggtacaatgtgtttgtggccctccactggcattagtcatatattagcttgtactgcatttacatcgacataggccttcatggttctaagtgtatggttggtatttaggaagagtttaatgaataaatgaaaatttacacagcctatgtgtcaccattctcacacatagcaaacattatttattgatcccacctcttattcccatgacgcttgagctaagccttacaatccttttcaacacagtgctacagataggcagttggaagtggcatggatgaggaaaccagtttttcatgcagtttccgtaagtctgagtatgaattatactttttaggcaaattaaatagcgtcaaaggtcatagtgcatgtacagattgaagctcagatgctacttcccttccctacttcccactctactgcccctatttttcacatagtagatccccaataagtatttgttgaatgagagaatgttagtgtaaccttcacaaatgagctgtgtgagctctacaagccaaagtgactcaacgaagttccaatcttttttttttttttttttttttttttctgagatgtagtcttgctcttttgcccaagctggagtgtggtggcccgatctcagctcactgcaacctctgcctcccaggttcaagcaagtctactgcctcagcctcccaagtagctgggactacaggcgttagccactacacccggctaatttttgtatttttagtagagacagggtttcaccatgttggccagactagcctcaaactcttgacctcaggtgatccgcccgcctcagcatcccgaagtgctgagggattacaagcatgagccactgcacccagcccccagtcccaccttttaaaataatgaataagcaaaaggccagatagagtgagcctcttgcattttaagaagcccattccagccataacagtcctttctgagctaaagaaggcaaagtacaaacacatccaggccccaactaacaacaaccaaaatgtcacatgttgtcaggtacttggaaagagggaaaacctttctagcttttttccttctggtgttattagcccactgcttggcaatgacatagaaggaagactgtgaagaagaaaagaagttggagggaaagtttggattcaaaggagccaggtagaattaggtagaaaatacagggtctagagaaggatattttttgttcatttctgaaaaagggacccaaataagcacgattgatttgacacttggaaatactatttttggttttctctcttttccttaattttgccctatcaaccaagacccatatctctaagaattctgtcaggtacttcccattcctgtgttcattctcttatttcctattcctgtgaataaaatcagatgatgcctctgataatcctggaaactgatcactgaaagcatggatggcagaaaagtaaagaaaaaaatctgtgtgtttattccaatggctagaaagtaaatttaaaaggttactctattgggtagatgatgtccaaagtaaaccattctccctaatgcttgcaattactcacatacaacctccatgttaaaaagaaataaaaagcaatactggtctttcctgttctcattctcacttgaaaattgtgtgtctggtttctgttggtttctcattggaagagaaattttaagaatacctcaattcaattgatgtgtactcacatgctgaagtctggggtatgcacaagctaacaagagctatgctagggtggggtgtggtggttcacacctgtaatgtcagcactttgagaggctgaggtgggagcactgcttgagcccaggagtttgacactagcctggggaacacagtgagaccctgtctctacaaaaaaattaaaaattagccagatgtggtggcacatgcctatggttctaggtactcgcttgagctcaggagatcaaggctgcagtgagccatgatcatgccacttcactctagcctgaaagacaatgtgagaccctgtctcgaaaagaaagaactatgctacattcattttctgctgctccatcagtcaaaagagcactaaggcctggttaactgttaaacatgagatatttttatttcccttccacatttttggaaacactatcataagatagatccactgccgacagtttctccattcgaatgaaagcagcattagggccagatattatttttgtgtttgcaaccccagggactaaagcaaggcccgacacagagtaggtgatgagtaaatgtttgttgaataaatgaatgagttttactcttttagtatagcgagcagaataaaggccccctccaggggtgtccacatcctagtgcccagagcatctgaatatctttttttttttttaagtatcttatcttacatggcaaaagagactgcggatgtgattaagaattttgagatgagaaaattaccctggattatctgggtgggcccaaggtaatcacaagtgttcttataaatgaaagagagaggcaggagtgtcagaatcagtgaaagagatgtgacaatggaagcagaggtcagagtgatatgtggccaatgaaccaaggaatgtgagtgtcccatagaagctggaaaagaccaggaaaccgattctcccctagcgcttccagaagggcacagccctgaaggcactttcatgctcagttagacccattctagacttctgacctccagacctgtaagataataaatttgtatttttgaagccagggaagtttgtggtaatttgttacaacagcaacaggaaataagtacaagtagcgctaacattaagaggccatacaataaatcatttgtaatggacaataaccaaaacgatagccagcatgtattgagaacttagggagaagtgcagtacaagatgctttacagacatgccttattctaattctctaaacgagaccataagacaggtattggccaggtgtgatggcttacacctgtaatcccagggctaaggcaggcagatcgcttgagctcaggagtttgagaccagcctgagcaataaggcaaaactccatctctactaaaaatacaaaaattagctgggtgtggtggcccatgcctgtagttccagctacttgggaggctgaggtgggaggatgacttgagaccaggaggtggtggttacagtgagctgacatcacaccactccactccagcctgggtgacagagcccgaccctgtctcaaaaaaaaaaaaaaagaagaagaagaagaagaagaaaagacaagttttattattattctcaagttatagctaaggaaaccatggtttagtaaagctaagtgactcgatcaagatcacagctaccaagtggcaaaacaaggatctgaactcaggcaatctgactccatgtcatactatctcccatgttagtgctgagaggtgtgaaaaatggtcttggtctataagtcagtcctggccctcaaggaacaaatagaaaggaaaagaccactctaacataaacgtcagattatagagagtctaatacagatcctaaattatctaccacctacatttaatgaggaaaaggggagaagaaagctggaatcctcaggactggatggagccggacttggaagtgtgcttcagttatggacaggcacagtggaggtccgttacaggctggggaaaggaatgagtgaaggaatatttggcgcaaataaacatgaaaatggagaaagaaaatactccacaaagcctgccaggggaaaaagtctgataaagaaaaacaagaaggccaggtgcagtggctcacgcctgtaatcccggcactttggggtggctgacacctgtaatccctgcactttgggaagctgagggtggtgaatcacttgaggtcaggagttagagactagcctggccaaaatggcaagacctcgtccctactaaaaatacaaaaaattagccaggcatggtggcatgcatttgtaatcctagctactcaggaggctgaggcaggagaatcacttgaacccaggaggtggaggttgcagtgagtcgagactgagccactgcactccagcctgggggacagagggagactccatctcaaaaaacaaaaaaaaaaaaaaaagaaaaggaaaaaagaaaggaaggaaggaaggaaagaagagaaagaagaaaggagagaaagaaggaaagaaagaagataaaatacttaattatttttattggaatggtaacatttatggagcacctattccacctaaagggcatattcacatttgttatttaatttaatactcacaaatcccaactaaatgagtattattaagcttcatttttacaaaagaggaaattaaacatccagagagattaagtaattgctgccaggcacatacccagtcagtttgattctaaaattcatgttctttgtttttgcccccatgataatttcagcccttctctgagaaggagcatgtttccattaaagtaagaataataggcagagctgtctgaaaaaaaaaaattggaaagcgttgcttcagaaggtggaaagttaaaagcagccaagccgaggcttagtttcagtcaaccagatagctgttcaatgagcatttactgacaatccctgtgctaagcatctggaatagagaaatccagcaaaagggcacctcaaggcaccaactgtttagtgagggagacaaatgagtaaaaagacctccacaccagcttcaaagtagtgtttaccgctagggagggaaggtagagaaaggattgggaggagtgaaactttacttatgtctataagcttgtatttcttcagagaaataagagaaatctgaaataaatatggcaaattactaacatatatttaatctcagtgctgagtagacaggtgtctgttacaacatgcctcttcattttagctttgcttttggggtcaggcacggtggctcacacctgtaataccagcactttgggaggctgaggcaggtggatcacctgagggcaggagttcgagactagcctggccaacacggggaaaccccgtctctactaaaaatacaaaaattagctgggcctggtagcatgcacctgcagtcctagctactcaggaggctgaggcaggagaatcacttgaaccagggaggcagaggctgcaacgagccgagattgcaccactgcactccagcctgggcgacagagcaagactccatctcaaaataaataaataaataagtgtagttattgcttttaaaagagattatcataatatctaaccagtgccatgctagcgggaagcacaggatactaacaaaggactggagaggcagctaacccaatttaaagaggaactggacacagccataaaaaggaatgaaatcatgtcctttgcgcaacatggaagcagctggaggccattatcctaagtgcattaacacaggaacagaaaatcaaataccacatgttctcacttatgagtgggagctaaacttcaggtactcgtggacataaagatggcaagaatggacactgggaactactagagtggggagggagaggagggcaagggtggaaaaactacctattgagtactatgctcacttcctggatgacagatcaattgcacccagacctcagcatcatgcaatatactcatgtaacaaacctgcacatgtacccctgaatcagaaataaaagttgaaattataaagtttaaaaaaaaaggaactagaaaaagcaaggaaacagattctcccctacagcctccggaaggacagagccctgctgatacttttgttttagcccactgagaccagatttggacttctaacctccgaccacatcttcaagaacctgaaggaaatccttccaaggaggtgagcagagcagtttcagaacaagcagcagcagtaagcaaaattctcaggctaaaagagaccagggcacattccagtcatctcaaggggtcagcagaccaagtactcactgtgaggggacagggcagggtggctgggactcaatcaggataaaccttttaagccagaaaaaggaatctggattttatcttaaatgacataggtagcttcttgagggttttaagcaagagacagagatgatcgctttcttttcggaaccatcagtctggtatggtaggagtaggaagggtgacggagaggaaggtggagctctggccaggtaaccaaggcaggagtttatcagaggatcctagatgagagatattcaggagcctgaaatagcagggttgcaatgaggatgaagtaatgatttcagagtatttatgaggtggaattaaaggtttggtgatccacccaaggaagggagaaaatggcatcaaagataacttctgggcttctttcttggtggacgtgctgctatttcccctgtcataatgaataagggggaaataagtttaaaaatgaggatgagttttcaaccactggtgctgggacaactggatatccacatagaaaaagtgaatttacatgcagactttacaccctccacgataattaactcaaaatgaatcacaaacctaaatgtgagacacaaagctataaaactcctagaagaaaacataggagaaaatctagatgctcttgggtctggtaatgactttttagatacaacaccaaaggcaccattcatgaaagacataattcataagctggacatcattaaaattcaaaatatctgctctgcaaaggttactgccaagagaatgaaaagacaaaccacagactgggggaaaatatttgcaaaagacatatttgataaagaactgttacacaaaatatacaaaaaaaccttttaaactcaacaacaagaaaataggggccaggcgcagtggctcatgcctgtaatcccagcactttgggaggccaaggcaggggaatctcttgaggccagtttgaaaccagcctgggcaacatagtgagaccccttctctacaagaaaataaaaaatttaggccaggcgcggtggctcatgcctgtaatcccagcactttgggaggccaaggcgggtggatcccgaggtcaagagctcaagaccagcctggccaggatggtgaaaccccatctctactaaaaatacaaaaattagctgggcgtggtggcaggtgcctgtaatcctagctactcaggaggctgaggcagagaattgcttgaacctgggaggcagaggttgcagtgagccgagattgtgccactgcactctagcctgggcgaaagaacgagactccgtctcaaaaaaaaaaaacgaaagaaaaagaaaagagaaaaaattagctaggcacagtggctcatgcctgtagtcctagctatttgggagtgtgaggtgggaggattgcttggattgcttgagcccaggggctggagtttacagtgaactatgatcatgccactgcactccagcctggacaatagagtgaaaccctacctctaaaaaatataaaaatcagaaaacgtgaataaaaaatgggccaaagaccataatagacatcttaccaaagaagtatacagatgacatacaggcatacgaaaagatgctctacatcatatgtaatcagcgaaacgcaaattaaaatgaccatgagatacccctacatgcctgtgagaatagccaaaatccagcacactgacaccaccaaattctggagaggatgtgtagcaacaggaactctcattcattgctcatgggaatgcaaaatggtacagatattctggaagacagattggcagtttcttacaaaactaaacttgttcttaccatatgattcagcaatcacactccttggtatttactcaaaggagttgaaaatttatgtccacacaaaaacctgcacatagacgtctatagcagctttattcataattgccaaaacttggaagcaaccaagatgtccttcagtaggtgaatggaaaataaactgtggtacatccagtcagtgaagtattattcagtgataaagggaactgagttgtcaagctgtgaaaagacatgaaagaaacttaaatgcatattactaagtgaaaggagccagtctgaaaagcctacatactatatgattccaactgtataacattcttgaaaagccaaactatggagatagtaaaaaaatcagtgattgccaggagtgggggtggggagggatgaataagcagagcacagaggatgttaagggcaatgaaactatttctatatgacactgtaatagtgactccatgtcattatacatttgtccaaaaccacagaatatacaccaagagtgaaccctcatgtaaactatggactctgggtgataatgatgtgtcgatgtaggcttatcgactgtaataaatataccactgtagtaaggatcttgatagtggtgggagaggggtatgcatgtgtggggatagtggaaaatctttgtactttctactaaattttgctatgaacctaaaactgctctaaataataaagtctattattta

SEQ ID NO: 603 - DNA, 270044 bp, Homo sapiens
aagtagacagaccgaagttgaagttattctgttctatttatcaggaattacacactggagtacaatgggtgacagaacattgtgttttaagcttgctcttaaaaagtttgaacgtaatgataatgagtacatacatatgtacacatatatgtatacaatatatatgtgtatatatacacacatatatatacacacacatacaaatctgtgtatatatctctctctgtgtatacacacacacagagaaaaagataaattagatatagagcaaatgacatcgaatgttaacaactggccagtctggtgaaggagattacatgaactatttatacagcaaatttggaattatttgaaaataaattattttgtaaagtaatatatatttattgggcatttgcatatttttctattaattatctatttatattatttacccatctttctgaattgctcatttttgtttttgttttttgtttgtctgttttttttgctggattgtaagagttactgcatattttaaaactcaacgccagccgggcgcggtgcctcacgcctgtaatccaagcattttgggaggccgaggcggacagatcacaaggtcaggagatcgagaccatcttggctaacacggtgaaaccccgtctctactaaacatacaaaaaattagccgggcgtcatgacaggcgcctgtagtcccagccactcaggaggctgaggcaggagaatggtgtgaacccaggaggtggtgcttgcagtgagccgagatcatgccactggactccagcccgggcgacagagagagactccgtctcaaaaaaacaaaaaacaaaacaaaacaaaaaaactcaaccccttcccaaaacacgaaaatctttggatgttatctatatttcttaatattcttcttacaattttttaaagtttatttttggttttttacatggccccactgtgtatcttcttaaaatttaagctactttaggagacaaaacctaagctactttaggttataagtaaattttagatccacatctcataaaccagagggatatctgcatagtcacaaatattaacagaagagtatctgcatattcctggaaatttaagtaactccaaagaaatattctaactagaattttctgcctcggcaaacaggcaagagagaaattgggagagacattattaaaagccaactatacttaaggcactgttctaagtatcaaaaaagcaaaggagctttctcatgtaacacagccaatctactctgccttgagaagaggttatttgtcatcttgctagtgaggtcacaatcatattcaaatgcaaatgaatcttctttggagtaacagcactctcagaacataaactttcatgatctggaaattagaggagcctagtggaggattcaggcagttcaaaattcagaatacaaacagaaacagaaactggcattgttatggtttaatgtatctgggcatgttagtaataactactggcatggattagaaggcaataagtagaacattttttagtataacaagtcactaaagacagcatctggagaacatttaaaagagtttgatttaaaaaaaaaaatccttaaaatccctactgggccagtcctgtaatcccagcacttcgggagaccaaggcaggaggatcacttgagcccaggagtttgagacgagcctgggcaacatagcgagacttcatctctacaaataattttgaaaaataagccagaagaggtggtgaacacttatggtcccagctactaaggaggctgaggtgggagaactgcttgagcccaggaggttgtggccgcagtgactatatcactgcactccagcctggatgaccaagctaaaaaaatgataggtcggatgccatggctcacacctgtaatcacaacactttgggaggctgagacaggcggatcatctgcagtcaggagttcgagtccagcctggccaacatggtgaaacccagtctctactaaaaatacaaaaattagccaggcatggtggtaggcacctgtaatcccagctacttgggaggctgaggcaggagtatcacttggactcgggaggcggagattgcagtgagccgagtttgcaccactgcactccagcctgggcaacaaaagtgaaactctgtttcaaaaaaataaaataaaataaataataataataatccagccaggcacggtggctcacacctgtaatcccaacactttgggaggccaaggtgggcagatcacctgaggtaaggagtttgagaccagcctgaccaacatagtgaaaccctgtctctaataaaaataaaaaaaattagctggccatggtggcaggcacctgtaatgccagctactcacgggttgagtcacgagaatcacttaaacccaggaggtggaggttgcagtgagccgagatcacgccactgcactccaacctgggcaacagagcgagactccatctcaaaaagtaataataataataaataataataataatccccaccaaccaagtttttaatcgtgtttcatatcctcaagaatatgattttgaaagacgtcatcaacaagaaacatcaatctttaatcacttgaaaacctatcaattacttgtctagtgaccaaaagaaacggacccacacaacatgtattaaacactaagtcacaaaattcattctagattcagaatattactgtagtaagccctttggtaacttatgctaaatactcattgatgtaacactatatactgactttccttttcccaaatataccaacattttgcaaaagtgaccattttataccatattttaatgattcctatctgtcctctagactgagctacttaagatagaaatagtgtcttattcacctatgaatgccctggtcctagaatagcacctacatatagaagaaattcatgagataattgttaacacaaaaaagattagacattagttaagccctgctaaatgagattcctcttaagttgaatattatttatatttcaaaaataccttataatcagaagcgtcttatataaacaggtgaaaaagcatgagctatggaatcaatatctgagatcaaactttaggttcataacttactagatccatcatccttgggaaaaattatttaacttatctgagcatagcttcacatttgtaaagtgtagtttatcatactaataaaacatatgttcacttttatattatacatttattacatattataattaaatataaattacatattaaatacatacaataccaatgtggcctattacacataaaatcacatgtaataagcactcaatataaataaatgtctatattaatttattattaccattctttttaaagaagattttgtacttaacaatcagatcacgtagaaattagtgacagaagcagttcaagaataggtatgagcagctaagcagctaagcttatgagtacaggactacagagaagaatgataggggcattggtagcaaatatccacaagtggcaattttgtttgggtaagccaggtgattttccagatactctggagaaatgttttctgaaatctcaagttcctggcagttatatttacaggctagagtgcagtggcgcaatcttggctcactgcaacctctgcctcccaggttcaagtgattctcctgcctcagccttccaagtagctgggactacaggcgtgcaccaccccacccagctaatttcatgtgtgtgtatttttatagagacgagttttcaccatgttggccaggctggtctcgaactcctgacctcagatgatccgccagccttggcctcccaaagtgctaggactacaagcatgagccaccgcactcagcctacacagctgttcttaaacttaaaaaaagtaaattatctctcctttacagagatgatggtttatttttatgttactgaaattcatacaaacataaagttaccatatttcatctaatttaagtcactaattgtaaaccacacctaccactaaaaaagaaaaaagctgccaattaaactacgatataccatcaattgactgctaaatgcatcctgatttcagagatgttaaaatgtagaaaatgtatacttgtacctgataaaatgtagtcatatagtagctaagaattatttattcttacggaactgtacaagtataaaaccaaatctgcaaactaaattccacaaaccaacaaaatcaatgaaattcaagtaagaacattaattcaatatgatggatgatattctgctacaactacacactcaaaacacaaatatggcacagactactttggactagcatgcttttaatattgagcacagtgtaacgaatcaattctcccaccacttttccctatgtaaactagtacaaaacctttgctggagagatcaatgttgcctcatgatgtaggaacatatcacttactgtgaactccatctccgttgttttataatcaaacctgcaacaagcgaagtaatactactcactatgaacgctggttgtaaaacataaaaagtaattgcagaaactgaaattatactagtttggtgcaaaactaattgtggtctttgccattaaaagtaattgcatgccaggcacagtggctcacacctgtaatcccagcactttgggaggccaaggcaggtggatcacctgagctcaagagttcaagaccactctgggcaacatggtgaaatacaaaaaagctactaaaatacaaaaaaaaaaaattagctgggcgtggtggtggcttgggaggctacttgggaggttgaggcagagagaatcacttgagcccgggaggtggaggttgcagtgagctgagattacaccactgcactccagcctgggtgacagtgagactccgactcaaaaataataaataaataaataaaaataaaagtaattgcaaaaccacaattacttttgcaccaacctaatagttctctgctatccagatgtacaaatgacccagaaaatgtttatattaaatctttttagctctctgtatgaaatgaaatggaagaaactcaagataaaacaataataaagtatataccttttgaatttagtgtcatttgcatgtattacttgataaaaataatcaattaaaaatgtaattttttattctacacagagaacttgcaaactaggccaaagagaatttcggagaagtccagtttgatatacactcacatagaggtaaaaggatatagaagaataaggccataatttgtgtaaagaatatctcaactcagctatggctacgatctgcaacctattagttgactgatttttactccctgattctcagtttctccacttctaaaaagagggtaaataataccttctgccttaaaaacactctatatataaatgttaagtctgctgcagacttatctttgaattatgattatcatgtgctaaatcaaatgcatactaaaaacaggcacaatggtaagagtaggaaaatccaacactaggcctaattttgtgtgtgtgtgtgtgtgtgtgtgtgtgtgcacgcgcgcagaccgctctgcctattcaatgactatgcacatatgagggacccaacaaatcatattttaataagtaaaataaggacaaactatcttacagatgaccaaatttttacgacaaagaagcccacacagctttacaaagactaagtcactaacatgacaagtatcaattacaagttatttctcttaacaaagagatatgttctggcaatatgctttgccaacaagtaattcattagactgctagccacctgatccaaactgggccgatcggttttactctgctatgaagttaaagctaggttaaccaattagccggtagagaaaggatgtgatgcagcctatggtagccattttctggcatgcacagggagaagtagagaaaaccagtctgctgagaggaagtaagaaataaaacagatgcagagggggaaaaagtgcacataagaaactgtgggttctctgagtgactgagagaatagctagccttagttcctgctagctttccaactgcctcctcaagccaaactggagttcccctctttgggtaccatgagatgctctgtacccttataatagattctcttttctgcttttcatcacctgaaatgggttctattacccataaccaaaatagctttaattaaacccatcagatgcctattatcaaaatagaaataatatcaaatacagttacaattccacaaacattaattgagcacccacaatgccctgggatattcagaacttagatcacatctagacaaatattaaaccaattccagtttacatttttaagctaaactgtcaaaatatacaaaaatcctgggctgggcacagtggctcacgcctgtaatcccaacacgctggaaggccaaggtgggaggactgcttgagcccaggagttcaagaccagccgggacaacacggcaaaacctcatctctacaaaatatcaaaaacttagccaggcgtggtagcacacacctgtggctcctagctagtgagggggctgaggcagaaggatcacttgagcctggggagtagaggctgcagcaagctgtgatcacaccattgcactccagcctaggtgacagacagagactttcaaaaaaagaaaaaaaatcttgaccagtaagaaataatgaaatgtgaacatacgaagcaaaaaaaaaaaaaaaaagattttttttttgaaaagctatttgaggtcatcagatcattattataacattagtagcattagcaaactaacgctaattagtagcattagcaaacattagtaagatataacctctggctatcaatttttaaaaatcagcttttaagcccttaccagatgcgtctggccctacaatcttattaaaaatatatttacactttttaaaaaacaatagtttacatcttcaacagactcttacatttctactcatatttttcaaagttataaacttcttatcaaataaaaagaaaaaataaagcaagaatactaattgtcatggtggtgcacatctgtagtcctagctacttgtgaggctgaggcagtaggattgcttgagcccagaagttcaaggctgtattgagctatgatcacaccactgcactccagtctgggagacacagcaagaccctgtctctttaaaaaaggaaagaaagaaattacaagttatttctcttaaaaaagagatgttggccaggcgcggtggctcatgcctataatcccagcactttgggaggccgaagcaggggggatcacctgaagtcaggagtttgagaccagcctggccaacatggtgaaacctcatctctactaaaaatacaaaaaattagctgggagtggtagcgggtgcctgtaatcccagctactcgggaggctgaggcaggagaatcgcttgaacccgggaggtggagattgcagtgagtcgagattgtgcactgcaatcaagcctaggtgatggagcaaaacaccatctccgaaaaaaaaaaaaaaaagatatgttctggcaatatgcttttgccaagaaaaaccctgagcaacaaaggaagacatggctctataaaaaataaaaaaattatctgggctcagtggcacacgcctatggtcccaaccattcagggggctgaggtgagaagatcacttgagctcaggaggccaaaggtgcaacaagacatgatcgtgccactgcacttcagtttgggtggcagagagagactctctctctaaaatttaaaaaagattttagaggctgggtgcagtgtaatcccagcactatgggaggctgagaagggtagatcacctgaggtcagaagttcaagaccagcctgaccaacatagtgaaacccggtctctactaaaaatacaaaattagcctggcatggtggcgcacgcctgtaatcccagctactcgggaggctgaggcaggagaatggcgtgaacccgggaggcggagcttgcagtgagccgagatcccgccactgcactccagcctgggcgacagcgagactccgtctcaaaaaaaaaaaaaaataataataataatgtaaatgagaccatttttaatgccttatattgtgtgtgtgtgtgtgtgtgtgtgtgtgtgtgtgtgtgtgtgtgtgtttcattggttttgttttacatttttctcctgatgaccttgcccagcatctttcaggattttaatggtggcactaaatggcttttcttggccattccttccatactacctcacactaaatggagattctattagttgctgaggatatctattccaactattcacttaggaccataagaaacaatttcaagatgagtgtaaggaaacatatttaagtcaaaactctatcaaaatgctatttcctgactctccatatgcacctactcttactggtaggtcacagtggtattcttttgagtcaccagtaattaatggttaagtcagagccaaaatcagattttaaaacctgagtattattcccctatcccactgcacagctatttaagtaaatgtacacacacaaagtatcattagcaaaggcaagtagaaagggccatgctacatacaggggtatgtaacaggccttccaggatactcggtcttgccttctttcaatggcctctcagaactaaacagactcaatttcaaagcattcaatagaatagtttatattagattatcatcagacctggagttttaaaaaactataccaatcaaataagttactaggttacttatctacctagggatctcaatgcacatgcaaacattttcagaatttcattatcaaacatgccctcctacctaaatgtgttaaccatgcccacctagcctccgttctgctggaattttctgatccccactgagatcatgaaaaacatttcatggcatcccctcctataagcattcccagtgggacagaaaagccaataaatcccttaaaatagtctagcatttcccttgccaatccattttccctaagaaaatggtgaagagagaatctactagactgtgattacccaagggagatgataaattccaggtgatatgaggaagattaactgagcacacacaaaaaatagtgaactgttaatttacttatcttaaaaacagataagaaataaactttactagtaagtatttcttatgttgatctacaaaagcaacacaccttgtgaacacacacattctgagggaaaagtggcagctgcacaacacagcagggttgacaatgaagtcttcaattgtcctaccacttttggcacactgtatttggtattcctgtacatgggaattttacagattacatttttcttgtttacataagtttgtggattgtattataaactagaaaagtggttcccaaagtatgctcccaggaccaacaccatcagcaacatctgaaaatttgtttttttgagacagggtctcactcactctgtcacccaggctggaaatcctaactcactgcagcctccacctcccaggctgaagtggtccacccacctcagcctcccaaagtgctgggattacagcaaagtgcatacagcgccaagccaacacctggaaatttgttagaaatgcaaattcccaggcaccgctccagacattccgaattagaaactctccgggagggaaacagcattttgtgtcttaacaagccctccaggacactctgatgcaccccccacccccggcaagactgagaaacactgacccagaggttattcctctaggtcttaagtagatatttgtaatagatatgctcagaaactaacagaatctccatttagtttcctgaaccacgtagtatgaggtattctggtaggaatcaaaatctgaaagccattttggaaatttcagaagtcattaaagacctgaaagatatcaggatagtgataatgaaaacaatgtaacatacacacaaaataaaatacggccataaaggcagaccaatttaaaataatacattatttaaaaattgagaggactctagcaaagaaatcagcaattgagataaaataatcaacgcaaacaactaaagaattagtaaataaaaagctaatcttctatgcagaaaaaagttaacagcagacctgagatggctttccttagaaagggctgcttgcaaagctggcccttggctaagaactcacaggaacctggatttagggagggttcctaccaccaactggtaagagtgggtggttgtgtctaaaacaatatggcttaagctttcattatcagagtctagaatttgatatatgccagacatgcagtacctatgtgaacagctcccactaaaaaccctggatgctgagttttaaggagcttcccgggttgtaacatttcatgttgtcacaattcttggttaggggaattatgtgtgtcttgtgtaactctaccgggagaaatttgcacctggtttcctccagactttacccaatgtatcttttccttttgctgataatgcttcctatcctcttgtaataaatcgcagccgtaaacatgactaatacaatacactgagtcctgtgagcgcaccttgtgaattaccaaatctaacactggtgctggaaatatccaacacattctcttaattctattatgagctctttgacagtcatataatgataaaaacactgacagtaacttcaagtctaaaacatttgtattactcttactccacccattaataaaataaaacattttaatattattttatttccattgtcttattctttttaacatatccagtaaccttatttgaatcacatgcttagttcttgtacagtaaagaacaggacaccttcactgacaatccaagggaaattggtatgttgttaacaaacaaggtggaatacatactgggcaggctctaacaagagacgatcactaaaatcaggctatttgacaaacaaaattgacttaaagaatattggggaagcatcgcaaagaaatagtcatgatctcccacaactcaggtcctgagcagctcactgggttcctgcctctccgctcctcgccacgcaaacggctcctgccagaacccaagatggcagcttcaggtgggcaggtggccaggatcgccgaaagcacaccagtgcccaggcgaagaacagccaggggcccctccttgctcggtgcctaacagcaggggcgcagggtggggctgccatcagccacgcgcagagcccacttggttatggcaaggaaaaccctgtgacctagggagtcgccaggcttccagtcctgctggcgggaaggactggcaaggcagtggggataaaggtgcaagcaaagaaaccatggtttcggaaggataatgtacagagaggccttgtgttgacccgagcacgttttttgaaagaaattcttaatattgggtgagcgctaattctcagttcaaaaattaaatcatatgtataaaaacgaaaaaaaaagagtcctgagtaacttctgattattattttacatattaaaagataacagaaaaaaaaaagcggtttcaaatgtgagtcctaagtaaacactcaccaactctacagcttacaagcttgccatcaaggtggcttctcaccaggacaactctatacagcatgctttaaagtgagcaggagggttgggtgcgatggctcagcctataatctcagcactttgggaggccaaggcgggtggatcacttgagcccagttcaaaaccagcctgggcaacatagggaaactgcctctgttaaaaacaaaaataaaggccgggcacagtggctcatacctgtaatctcagcactttgggaggctgaggcgggtggctcacctgaggtaaggagttcaagactagcctggccaacgtggtgaaaccctgtctctactaaaaatgcaaaaatcagctgggcgtggtggtgcatgcttgtagtcccagctacacgggaggctgaggcacaagaatcgattgaacccaagaggcagaggttgcagtgagccaagatcatgccactgcactccagcctgggcaacagagcgacattccgtctcaaaaaaacagctgagcgtggtagcccatgcctgtggccccagctactcgtggtggaggctgaggtagaaggatcatttgagcccaggagatcaagcctgcagtgagttgttatcatgcctctgcactccagcctgagtgacagaccaacagcctgcctcagaaaaacaaaaacaaaaacaaaaaacaaagggagcaggagttatttatttaacagtggtaagaggtactctcatgcaattcttagggaggctggtgaatgtatttttaaaaacctgttctttatacaattcagaagaccaataagaaatgctgaaaaaatcagaaatacaaaaattaaaagaaattatcacattacttatattagatatcaacattataaataagggaatacttttcagatacaaaatgatctctaaaactttcctattttgggtaaaatactagcctaggaacatacatcatgaatatacaccatgattcagaaggggactctgctatgaaataaaaacagtgaaatactagaatatagtggcatatttgaaggaattgaaaatcatcaaaaacacaatcactcctaaagcatataatctaacaatgtcttcagggagtcctggttaacctagtatcacttgctcatcccttagccctgtgatacttatgaaaactgtttacagttttgtttaattatatcctcaggattcaaagtttttacatggtctcagaaacccaagatctacttgagaaatgcattgattttattcctcagcgctgtctctaacttacaaaaagtaatatttgctgctcaaggctacttcacaggatataatcaacgcaaagcaaccttctttttggtaggctttgggataacagtcaatgcaaatttagtgaatgcgaaaattagttgtatgagtgtgtcaaacttttggaagcacaagtaggtaaaccaaggtgccatggacaatgggtgaaaactattataaatatggaaaattttaacctggaaaccataacactgtttctgtggatttctgaagaccctacaagaattttcagagatgatatatctacacaataaagcctgtactttcgacagacccaaaaaagtttaagaactcctattgtaccctgaattttcagaaaaattagagaaagagaaaacaggaatacttaaagacaaccaaatttaaccagacatggaaatatttacattacatactatttaattttatttatttatttatttatttttttgagacggagtctctgtcacccaggctggagtgcagtggcacgatctcggctcactgcaacctccgcctaccgggttcacgccattctcctgcctcagcctcccgagtagttgggactacaggcgcctgccaccacacctggctaattttttgtatttttagtagagacggggtttcaccgtgttagccaggatggtctcgactcctattgtgatccacctgccttggcctcccaaagtgctgggattacaggcgtgagccaccgcacctggccgatactacttcattttataacaaaataagaagttttatgtatcttttaaaacacattcattttcatcacaaaaacaattatgtagataaataaaaaagtattattacccactggtataaaagagcaaagagaggtggagctttaagtgattttaaggacataattcactagaggcaggaaaaagagcttaaatccagatgtcataccataactgccttatcaggtagtaacaacttaacaccctcttaaaaaaacctatctgtaaccaacataaacttacctactaattcagaagctaatgtttaaaatgttgaaaaaagatgattacaaactatgttttaagaaatacacaggtaaagatttgaaagtatatactaaaatgttaatagtagttacctctgtaacgtctgaattacgagtgatctttttcctacctgattttctggattttccatactttctaccatgagttttttaataaccagaaaatgttaaaatcaaataaaatgctttatgttcattattaaattataaaattattaatattaagtactattatttaacatttacttaagacagtcaattttaagatttcttgctgatacttttaagaaaaagttaacttagaccctaaagaaaatgaaaccaatcctttatttacttatttattgagacagtctcgctctccaagacagtcttgctccagctggagtgcaatggtgcaatcgcggctcactgcaacctccgcctcccagttcaagcgattctcatgcctcagcctcccgagtagctgggattacagacatgcgccaccacaccctgctaattttttttttattttagtagagacggggtttcgatatgttggccagactggtctcaaactcccggcctcaagtgatccgcctgcctcggcctcccaaagtgttaggattacaggtctgaaccaccacgcccagcctcattctacatttaaaacaaatcaacattaattcttcaaggccaggccggcacagtggctcacgcctgtaatcccaccactttggaaggcctagacaggcagatcactgaaggtcggagttcgacaccagcctggccaacatgtgaaaccccatctctactaaacatacaaaaattagctggacgtggtggcaggcacctgtaatctcagctattcgggaggctgaggcagaagaatcgcttgaacctgggaggcagatgctgcagtgagccaagattatgccactgcactccagcctcagcgacagagcgagactccgtctctgggggaaaaaaaattcttcaaggcctaaattatctgctctccaagtatcctataaaattgatgatgcaatgtgatgaattgatcagagaaatttaattacatatacttcactagctttttctattacaagtgatctttaaaaccataatgtgattatgacctagtatttcaaataaaaattgctgggcacagtggctcatggctataatcccagctacttggaaagctaacgtgagaggatcccttgggcccatgagttccagaacagcctatgcaacataacaagataccatctctaaaattaaaatttggaattattcccaactcattctacaaagccagcattattctgatatataatgacattatgagaaaataaaactagaggctggacatggtggctcatgcctataatcccaacactttgggaggctgagaggagaggactgcttgaggccaggagctcaagaccagcctgggcaacatagcaaaaccacatctctacagaccaatatccctcatgagcaaaaatgcaaacaatatatatatattttttttttggagacagggtcttgttctatcacccaggctgcagttcagtggtgccatcttggctcactgcaacctccaactcctgaagtcaagtgatcctcccacctcagcctcccaagcctcccaagtagctgggacctacaggtgcagaccaccaaacccagctgactttttttaaaatttattttctgcagagacagggttttgtcatgttgcctaggctagtcttagactcctggacttaagccaacccaaagtgctgggattagaggtgtgagccatcacgcccagcccaaaaattctaaataaaattctagcatgtagaatccaacaatatgttctaaaaggtaatatatcatgaccaagtgcatttattgtagaaatggaggattgttctaaaattcagaagtcaatgagtgtaattaacgtatcaacaaactttaaaaacagattacctcaatatatccagaaaatgcattttattaatacaaaatccataagccactcctgatgtaatctctcagcaaactaggaacagaatgaaacttcctcaatcggacaaaaggcatccatgaaaaatctgcaactaacattatacttaacggtgaaagactgaatgcttttccctacaattaagaacaagacagggatatccacctcaccacttctattctgcattgttttggagagccaatgcaatcaagaaagaaaagatatttgaattggacatgaagaatagtagctgcctttactgacaacatgatccgctaccaaggaaatccaaaggaatctacaaaaatcctgctgtaaccaataggtggttttagcaagatcacaggatacacaatatagagaagtcaataggattcctatacattagcaacaatcagaaattgaatttttaaaataccattaacaacagaataaaaaattactaaatatttagagatctggcagagagttctcattctgagagttctaactagtaaatcaggattccttacacaagtgtttttcaaactgagccacaacctattaattactaggtagggaaagaacaagagaaaaaaatgatatgagagaaaaaatgactgagttaacgctcattcacacatttgtttctggcttttgggttttgttttgttttgttttgagatagggtctccctctgttattcaagctgagctctgtggctcactgcagccttgacttcctgggctcaagcaattagcctgtttcagcctcccaagtagctagaactacaggcatgtaccacaatgcccagctaatttttgataatttgtagagacagggtctcactatgttacccaggctggtctcaaactcctggactcaagtgatcctcccaccttggcctcccaaagtgctgggattacaggcatgagccatcgcacccaggcttattcatacatttaaactaaagcctataatgtatcaggtgctggttaggaaccagagacttgatttaaaactcagtctttgttttcatggagtgtagtggaggaatctgttaaacagttaagttaccatatgaagttaactactatggtcagattctgcacaagaggagcacgaagaaggacgtaaatctatcttaggatctcagagaaggatacctgaaggatgactggtaatctagtaaaagaattctgatgggttgaaatgagaaacaatatagattctggagaagagctatagtgcatgaggaaagtagacaatatagaaagctgcaattattaatgaccatagccagagttctggagaagcaaggcctgatagcaacaggagaagaactactacaaagttttatgagcaagagttacattatctgatgtcttagatcactgtggctgcaatgtgaaaaacagataccaatgtacaaatacaaggctgaatcagacagatcagttaggaatctgctaccataatctagaatgagatacaatggcttgcactaatgctgggatggagagagaagaactgggtaaagacattctcacatttagtgactaactgaataaagggattaaaaattttaccttttggccaggcactgtggctcacgcctgtaatcccagcactttgggagggtgaggtgggtgaatcatttgaggtcaggagttagagaccagcctggctaacacggtgaaaccctgtctctactaaaaatgcaaaattagccgggcgtggtggcaggtgcctgtagtcccagacactcaggaggctgagggaggagaattgcttgaacccaagaggcggaggctggagtgagccaagatcgtgccactgcactccagcctggacgacagagtaagactctgtctcagaaaaaataaattttttttttttaccttttttctcctcactgctgacttctatttcagaagagcagatctgatcccagactactaaacaaagaaaagagaactagagagacacccaaactgcaggggaggttgtagtaacaaagcagaagacaaaaggaaattccaggtgaggctacagggcaagaacagtctcattgtgtgttctgtcttgaatgtaccagaaactaccagtgttcatgatggtatatgagaaagaatctacttatttttatttttctacttgccctaaagtaataaacatgcatcacatcaagcaaattaatgcctaattatcagcaaattagtaaactatttctgttgacacctttattctctacccagtaattcaaccggcagctactattttcactaagtactgttaaataagcttgacaaaatgagatactcttacatgaattcctggtcctaaagaatttagtcctttcttcagcatacaaattaatgcatgaattcatttgctttataaaactataaaaatacagaagtatacaaaaagcaaatgtctccttttatcttctctgttcccacatccctcggggacataactactgtctccttatttagggtatttttccagtcttactctgcctttacagggacctatgtacaaaacaatgtattttttccaaataaattttaaattggcctttagttgtacagtctatgagcatattatccttgtaaaaataataaaacattaatgtggctgggcgcagtggctcatgcctgtaatcccagcactttgggaggccaaggcgggtggatcacctgaagtcaggaatttctcaagaccaggctggccaacatggcgaaaccccttctctattaaagaaatataaaaattagccaggcgtggtggtgggcacctgtagtcacagctactcaggaggctgaggcagaactgcttgaactcaggagacggagattgcagtaagctgagattgcaccactgcactccagcctgaaaaacagagtgagactccatttcaaaaaaaaaaaagtaagtcctaaattactacactcaattcccattaataatcactattctcattttggcatatgttcttccaggttttttccagaccttcacttacatacacgtacatgtatccatatttaataacatttctgtgaatctatttttacataactggtactacatttaatatactgtctttcaacttttctttcattcaaaaaatgttttagagatctttctacatcagtaaacacaaactgtcgaattaattttgtgctataaccattgtaggaatttgccatggttatttagcttgtcctctactggtgatattaagtggttttctgtttttccctattaaagagggcagccacaaacatattcatgccagcttccttgtgcacctgtacatgggctgcttctgggtaggtatcaaaagggagcacaaagaacatgaacattttttattttaagacataacccaaattctcccaaggaatttctgaagtataattctggtgccttaaaggccaacacataatgaaaaaagaagactcttagttacagttaagtgttctattttcaaccaaaacttttctaatcctagaggagtttaacaatctggcatcttgaacagaaatcaccattaatttctgcaccagttattagcaatgcaatatcttaacagtcttgaaagatccatttattcaacaataattaccaaaattaaaaacacacaaccctggccccaggaataaatggccaaattcatccaatagctatacttgcacatgtgtgagataacatatattcaaagttattcatcacagatgcaagtcagtaggtctggccaaaagtccagctaaattcaaagtgacataataaattatgatcctggaagggaattcaatgtatgacttacttcaaacagtaaattaactcaaagtttgggagctataaaatattgataaatttaaccattaaaaaattgctcaatggcaaaaaaatacacaaagcaaatatatcaaaatataaatgacaaactctacaaaaagttatttataattcacatcactaaagagcttgactctcatacataaagaacatctaaaatcagtaattttttttagagaccaaccattcaggccaggcaaagtggttcactcctatagtcccaacactgggaggccgaggtaggtgaggtgcttgagcccaggagttcgagaccagcctggacaacatagtgaggccttatctctattaaaaaatttaaaaattagccagcatggtagcatgtgcctgtagccccaggtactcaggaggttgaggtgggaggatcacttgagcctgggaggttcaaggctgcagtaagccgttattggaccactgcactccagcctgggggacaggaaggagattctgcctcaaaaaaaaaaaaaaaagccaaccattcaacagaaaaatgggcatatgacataaaaggatatttcatataaaaagaattacaatggactcaacacttgaaaagatgctcatactcattcataaattcgatgtaaaacctactaaataaaaacaattcaaaacacaatttttcgcacgcatccatagtttcaactacttgggaggctgaggcagaagaactgcttgaacctgggagacagaggttgcagtgtgcccctatcatgccactacactccctccagcctggacgatatagtgagactctatctctaaaaaaaaaaaacccacaccatttttcactatcagattggcaaaaattcagaaattcagaagtctagtaatgtacacggcaggtaagttatgggaaaatgttagccttcatattgctgctgagaatgtaaatctgtataacctgaacgggaaacgattatagaaataaaaaatgcaggccgggcagatcacttgaggtcaggagttcaagaccaacttggccaacatggtgacacctgtctccactaaaaatacaaaacttagcggggcatggtggtgcatgcctgtaatcccagctactccagaggctgaggcaggagaactgcttgaaccagggaggcagaggttgcagtgagccaagatgacgccaacctggacgacagaatgagattccatcaccaaaaaaaaaaaaaagcacatgtgctttaatcagtaaccctactcttaggaattaatcctacagatactcttacagatgtatgaaataatatatgtacaaagttacctcatctcagacctgtttgtaaaagcaaaaggtcaaaaacaacctaaatgtccaaaaataggggtgtggctaaataaattatgttacatcgtaaatcttatacatctgtcctatacagaactgcaaaaacaattgaggaaactggttgtttgcagctggacatgggcatgaaagaccagagacggggagacaactttttaaggattacaaaaatattcttaaactggactgtggtgatgggtgaacaaccctagacatttacaaaaattccataacagccaggtgtggaggcttacgcctgtaatcccagagcttcaggaggccaagtggcagtatctcttgagaggaggtgttcaagaacagcctaggcaacatagtgctaccgtgtctgtacaaacaaatttgttttaattagctgggcatggtagcacacacctgcagtcccacctgttcaggaggctgaggttggaagattgcttgagcccaggagtttgaggttaacactgaactatgatagtgctactgcactcctgcctgtgtgacagagtaacaatttgtttctaaaagaagaaaataggccaggcgtggtggctcacgcctataattccagcactttgggatgcggaggtgggcagatcaccaggtcaggagatcaagaccaccctggctaacacgttgaaaccccgtctctactaaaaataaaaaaaattaaaaataaattagctgggcatggtggcgggtgcctgtagtcccagctacctcggaaggatgaggcaggagaatggcgtgaacttgggaggcagaggttgcggtgagctgagatcgcaccactgcactccagcctgggcaacagagcaagactctgtctcaaaaaaataataaataaataaataaataaaataaatttttaattaaaaatgaatctaaaattccttgatttttacacttagaatggtttaatttttttggtgtgcaagttatacctcaataaaagttgttaataagaacacacaaggctaggcgtggtggctcatacctgttaattccagcactttgggaggccgaggtgggcagatcacttgaggccaggaatttgagactggcctggccaacgtggccaaaccccgtctctactaaaaaatacaaaaaatactaaaaaatagcccgggtgacatagcaagactgtcttaaaaaaacaaaaacaaaacaaacaaaaaaacacccacaaatgaggggatctctatgtaataataacacaaacatctcccagatgtgttaagtgacaaaatttaaaagtgcagaacagtgtgtgtaatttacaagctgaaagtaaagggtaggagagatagggaagtaagacggcaaacttgtgtttgcctttctacgtgtggaaacaatacacaaaaacaatgactgtacagaaagaagggaaatttaacaattggaggtaaaaggtaggatgaaagggtttttactatattcttttataagtattttttaaaacttttcagccatatgtttgaatattcaaaaaattaaactaggatatttggactttaataatacagatacaacttataatgtaagttgtttgcttcttcatttcgttacatattatatttcatatgattttgcaatcatcctgattgtccccaagagtctgcctttgtgaagaattgtgcctacagaaactttgcatcctcaatattctggggacagttccagtttcaaatattcaattccaatgttactgatttacaaattaataaaggctcttagaaattccaagttttggctgggtgcagtggctcacgcctgtaatcccagcactttgggaggccaaggcaggtggatcatttgaggtcaggtgttcaagaacagcctgtccaacatggtgaaaccccatctctactaaaaatacaacaaaagtagccagttgtggtggctcatgcctgtaatcccagctacttgggaggctgaggcaggaggaacgcttgaacccgggaggcagaggctgcagtgagttgagatcatgccactgcactccagcctgagggacagggtgagactgtgtctcaaaaaaaaaaaaaaaaattccaaattttccatctacagtgataggaaaaggaacccctaaaaaatctttttttcaatcacatgaccaaattaaaggttgggtaaggtaaaactcatccagaatatgcataaaacttgaactttaacttttttgattactaacaagataaatttatagatctacttttatgtaacagtaacagaacaggtacaacatggaccccaaagtctctgctgagcagaaaactggaaatgactagaaatatactgacagaagagaaaagctaaagtagaactacatagtcaagaagaaagctccgagggaaggttgtggattcaaatgaatacgtagatagctcttctaagactccacaatacattcctcattcctgtagagccagactactccttcccaaaacctacagggcagcaaatctaagatccacaaaaaccagagctcctattttattaactgctccccttgtgccaagcattatgctttagtaatctcatttcatctcagcaacactatgacataggtgctgctatcctcagtaccgaagcgcagtaactaaagatcaacatcacacaaacgtcaaagttaaggccaaaaaaatatatgctactagaggatttccacttttcctctcttattttttactatattttaaatactgatcattaacacaaacttctacaagtaaaaaaattttatataatgaagtagtacatgctcattttaaaaaccaaacattgtaacttcacaaagtagacattaaacattttctatactgtcaccagctagagaccatcactattaacttgttacaggtctttccagaccttttcttaaaagcattaacagctgatgtgccaagtcagtacaattatctacttatactatacatatgtaaatatgaggtaaaatgtctacctatagatagtataaattgtaagcaaaagcaaattgttgctcaaacctaggttaagtcaagtttggatttaactatatagaatattctaaaaagcacataaaccaaaaaaaaaaaatgatgaaagagaaggtggaaagatgaaagcaggaaagggccaaatacagtctagcaactcaattcagcaatacagccagtttgtcactacctacctacttaagagctgattctaacatctatttccatggtaactaggcattaagcaaaaaatatatatataccagacttttaggaaaagattcctttctcctccaccagaaaaatgcctagtttggcaaatttaagcaatgtaatctggaagtctgactttatgtcagaaatttcagtatattagactgtaaaacatcttaaaatagttattaagtaattggagggggtggactacaaggagtaaaactgatcatctacaaatatcataatcttagtttctaaaattagagttccagttgccttctattgacatacaatatgtccaaaacccagtaaaatatttaaaattataaaacgcaatatataaacaagaactatttactgacatctagtaccacctggccacctggaaaattgacactggactttcaaatctgaacctttaaaaattaatgtaagcataaattaaattttaagtaaaaacatacagtaaaataatacctctttcgttactgataggatatgggcagaataatgatatgcaaaccagcagcatttttttttttttttttttgagacagagtcttactctgtcacccaggctggagtgcagaggtgtgatctcggctcactgcaacctccgcctcccgggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcaattctcccgcttgaacccaggggttcaagcctcctgagcagctgggattacaggcgcttgctaccacacccggctgattttttgtatttttagtagagacggggtttcaccatgttggccaggctggtcttgaactcctgacctcaagttatccgcccgcctcagcctcccaaattgctggggttacaggcgcaagccaccgtgcccagccatatctttttaaaaatatgctcaacattttgaaaccatgtaaatattttacatcaaaaaaattgaaaaggaaaaaacagcactccttagaaaccaaaaccaaactgaagtaaatgttctattttcaactgctgacataaatacacagagaattattatttcaagtatcttaaatattaatatttatttaaaatattattttttattaaaatttataaaattttattttcatttaaaaagtattctgagcttacatccctactggaatacagcctaaggatgtaaatagacagacaaaggaatctcaaactacattatggtattgttatctcaaagctaatatgtgttatatgtataatataatgttaatgttgttaggaaccaacatttttagcataagataaaaaatgatataggccgggcatagtggctcacgcctgtaatcccaccactttgggaggctaaggcaggtagatcacttgaggtccagagttcgagaccggcctggccaacatggcaaaacctggtctctaataataatacaaaaattagccaggcatggtggcacgtgcctgtaatcccagctacttgggatgctaaggcaggagaattgcttgaacctgggaggcagaggttgtagtgagccgagatcatgccactgcactctagcctgcggggggacaaagcaagactccatctcaatttaaaaaaaaaaaaggccaggcacggaggctcacgcctgtaatcccagcactttgggaggccaaggcaggcggatccggaggtcaggagttcgagatcagcctggccaatatagtgaaaccctgactctactaaaaatacaaaaattagccaggcatggtggagggtgcctataatcccagctactcgggaggctgaggcaggggaatcgcttgaacctgggaggtggaggttgcggtgagccaagatcacgccactgcactccagcctggacaacagagcgagactacgtcccaaaaaaaaaaaaagacacaactataaaagaagttacatggctgtactcatcaagaaggcatcacaggcaaagagggaagcccctgctctcccaacgtcaaagccaaaccaaaggctctaaaggccaaaacagcagtgctgaaaggtatccgtatccacagccacacaaaaaagagaagatcttcacgtcacccacctaaggacagcccaaaacactgctgctgttctggaggcagcccaaatatccttggaagactggtccagtccaggagaaaccagcttgaccactatgctatcaagtttcccctgaccactgagtcagccatgaaaagaacagaaagtcaacaacattcttgtgttcactgtggatgtcaaggccaacaaataccagatcaaacaggctaagaaaaagctctgtggcactgacatggccaatatcaacaccctgatcaggcctgatggaaagaaggcccatgttctaccggttcctgactatgatgacgttgccaacaaaattgggatcatctaaagtgagcccagctggctaacactaaatagacatatttttcaccataaaataaataaataaatcataaaataagttaaacaaaacctctgtaatttttcatgaaaactggaaatatcagtatgaattgaaaatttattcttctctttttttttgagacagggtctcactctatcacccaggctagggtgcagtggcacaatctcaactcactgcagccttgacctccaggctcgggtgatcttcccaagtagttgggactataggcacacaccaccatgcctggctaatttttttgagctttttgtagagacagggttttgccatgttgcccaggctagtctcgaactcctgggctcaagtgatccgcccacctcagcctcccagagtgcttaggttacaggagtgagccacctcacccagccataatttactctaattaaaaaaaaaaaaaaggaggaaggaaggaaggaaggaaggaaggaaggaaggaaggaaggaagggaggaaggagggagggaaggaagggagagagtacttcctgtatctaaatactaaaaaaccatagaagtcatgaccaacccagcagcaatgagcacccttaacaccctgattgtgatctctaaaaaccatttcccacttgagaaaaccagggctacttgttcttttctttttatatatatatttgatgtcattaatgtctcagcaaccagggttccttaaagaaatagctgattccagatgcggagcaggaaatgtacaaagtgaacctgatatcccttgtgccagaaagagagtaagttattgaaaaccgatgggacaatattcaaaagaacacaggaacccatctgaaggggttccaactggccaaagatgagacaattgaaacatgaaaaacagcaactacaatggattaaaacacatcacatacataaaaatccctaacactaaaaataataaaagaaagaagaaaaatttactggtcgttttagtgggttcctaggacaccaactcattattataaaaactggcaaaacgaggtgggagaggaattaaatttttatagcctccacttctagattttaaagacagtaaatacatgaaataaaagttttctttacaaaagaatttcaactaataaatgtaggagtgatataattccaaaatcaccgttttgcaatccttatataatggatctagtcaacaatcctcagatgctgcgaaaacctttgtgtgaaagttgataagaactttataaaggatagatcaagccaacataatctaaaaccactgaccaatcccagcaatactgaaagtgaaccaacctcatgatggtaactaatagaaagaatacagcacctcttataaacaatgctcaccaaaaaaaaataccctctagaacgaatgttcagtttacaggaaattacaggggttaaaccaaaccacaaagatgtaatcagccaaacagaatgtgggaaattctacaggttaaataacagtttcttcatcaaataaagggcatgaaaagggtggagatttaagagaccatttagaaccgtatcttccaactgcaatatgaagactttatttgggtcctaatgtaaacgaacaaattgcaaagacattttagagacaggctaatctgaacatgttcttgctaccagatgccattaaggaattaatgttaatgttattcattgtgacaatggtatgacagttgtactatgaaaggaaagttcaagtgtgtcagagatacataccgaaatacatatgggtgaaatgatatctggaatttgctttaaaatgctacatggtgagggagaaaggagagaagaggggcagcagagtgaaacagataataccaagatggcaaaatattggcaactggtgatgctaggccatgaatatgtaaaacatcagtgaactttatttttgtatgttgtaaatttccataaagttttaaagctgtatcaccagcatgtttgttaccatgaagtgtattcgtctctaatcatttatttttactagtctccagaattaacaccactaattttccaaaaattagaaaatgttatgtttcaacttatatatttagtctaaaaatcaattaccgtattacattatatatatccatatatatgaatataacgtatatttatatatatccatatatatgaatataacgtatatttatatatatccatatatatgaatacaatgtatatttatatatatccatatatatgaatataatgtatatttatatatatccatatatatgaaaatgactatctgcattataaagtcactgtgcctatccacagttaaatatttgtttagcagaattgtatttacatatagcgtttcattctacttcaattttatttgagatcttcattttacttaattagaactccatatctctttcatcaacacctaatcacagttaatactacaatcagaacaatttaagttataactcaaggggcacagagatggggaaccaaaccatactgttaatgtttgccataaaagctggcttcaatccatgcacagaggcatttcattcattaaaaactgcagtctcagcccagcacagtggcatttcattcattaaaaactgcagtctcagcccagcacagtggcatacacctgtaatcctcctgtaaagctactcgggaggcagaggcaagaggatggcttgaacccaggagttccaagccagcctagacaacaaagtgagatgccacgtcaaaaaaaaagcagtcttactgtaagtctctcattatactttctagagccaccttaaagtgtgaccctaatacaagttcatgtacataagaagctttttggtgttttcctaagggataaactgtggtttggttttgttttttattgagacagagtcttgccctgtcacccaggctggagtgcaatggcgtgatcttggctcactgcaacctccgcctccagggttcaaacgattctcctgcctcagccgcccgagtagctgggattacaggagcccaccaccacgcccagctattttttgtatttttagtagagacggggtttcttgaactcctgaccttgttatccacccacctctgcctcccatagtactcagattaaaggcgtgagccactgtgcctggcctaaactgtgtttttgaaattatctgaaggtttaatacctgaagaaataataaacgctcagagttcagcctagtcaaaaattaacaccagcctctaatacatcagagagttatttactcatagaaacaaatgcttcttgcctatcagtgtttaatggtatcatttgagatctgaatcctggcactggtttttaaaagcggagcagttctctggaaaagaactctggattatgagttaggagatccaagttagggggttggtctatgccagagtttgaactcataattcttgttcattggtggttagctgcttgaagcagtagtactatcttgcaaaggattctaaagcttcatttaggagcaaccaatttttaaacgtatgatgcaaaaaatatagaactaaaaaagagtgtagcttcctgggtatctttttattgtcacagaagtaatttaagtatttagtcctgttcttaaatatccaaatgggttcctgaaacactgtccctctacccacatgttactctaccctcgctcccccataaaagaaacccagaaaaactactggtggggagaggtacttccatttgctttttcattctatccagcaaccaataagcggtgtgactgtcagaaaaacaggctctgggccaggcacagtggctcatacctgtaatcccagcactttgggaggctgaggcgggcaaaccgcttgaggtcaggagtccgagaacaccctggccaacatggcaaaaccccatctctaccaaaaaatacaaaatttagccaggtggggtggcgggtgcctgcaatcccagctacttgggaggctgaggcacaagaatcacttgaacccaggaggtggaggttgtagtgagccgagatcatgccactgcactccagcctgggcgacagaatgagactccgtctcataaaaaaaaaaaaaagaaaaacagactctggaggtcaaaattgagttcaactctatgctctataactttctctggtccccattttccctatctgtaaacagggaaaattaaagtattctcatagtgctatcatgaagattaaatgagatatctgtgcttagaagacaacataacacatacaaagcagtactcaataaacttcatcatttttaattattattattattactatatttagcttattctacattaaagatgccttgcaaggagaaaaaaggaactacaagaatacttttttttttattttttgtgagacagagtctcgctctgtagccaggctgaagtgcagtggcacgatctcagctcactgcaacctccacctcccaggttcaagcgattctcctgcctcagcctcccgagtagctgggactacaggtgcatgccaccacgtccagctaattttgtgtgtgtatatttttagtagaggcggggtttcactatattggccaggatggtctcaatctcttgacctcatgatctgcctgcctcggcctcccagagtgctgggattataggcgtgagccactacgcccagccaacaatacatttttttaagtattctttttttttttttttttttttttttagtatacagacagggtctcactatgtttcccaggctggttttgaattcctgggctcaaacaatcttcctgcctcagcctcccaaagtgttgggattataggcgtgagccaccacacccaggcgaatctactttttctactgtaaattttattaaatctaaatacagaacaagcatctctgctgaaaatttagtgcccagtgtggtggctcacgcctgttatctgaacactttgggaggccaaggcgggagaatcgcttgagcccaggagtttgagaccagcctgggcaacatggtgaaaccttgtctttacaaaaaatacaaaaaattagccaagcgtgctggcacacacttgtagtcctaattacttgggagactgaggtgggaggatcgctagagcctagaaagtcaaggttgcagtgagctgtgatcacaccactgtactccagccggtgagagtgagaccctatttcttttttttttttttttttttctccttttgagacagggtggccttgccctggcccaggctagggtgcagtggtgcaatctcagctcactgcaacctccctccacctcccaggctcaagcaatcctcccacctcagctaccggagtagctgggaccacaggtgcccaccaccttgcctaactaattcttttttttttgtgagatgcagtctcgctcttatcacccaggctggagtgcagtggcctgatctcagctcactgcaacctctgcctcccaagttcaagtgattctcctgcctcagcctcccaagtaactgggattacaggtgcctgctaccacacccagctaatttttgtgtttttagtagagagggggtttcaaaactcctgacctcaggtgatccgcccacctcggcctcccaaagtgctaggattacaggcatgggccaccgcgcccagccaactaactcttttatatttttagtggaaacggggtttcgccatgttgcccaacctggtctcaaactcctaggctcaagtgatccacccacctcggcttcccaaagtgctggtattacaagcataagccactgtgcctggctgactctgtctcaaaaaacggaaaaaaaaaaaaaaaaaaaaaaaacagcaaaaaaaaacaaagaaacaaggaaaaggaagggaaggggaagggaaaggggaaggggaaagagatggggagggggaagtgtaaagggagggaggggaggaaggaaggaaggaaggaaaaagggaaagggaagtggaagagaaggaggggaaaggaggggaggggaggggagggaaaggagtggggacagaaagacagaaagaatttagtatccaaattgagacatgccataggtataaatatacaccagatttcaaagatatagtattaaaaaatgtaaaatatctcaataattttgatatcattacatgttgaaataacaatgttttggatatgctgggttaaattaaacattatcataatgaatttcaacacctgtttctttttatttacttaatacagctattataaaagttaaaattacacatggcttgcattatactcctattgataacactgctctaaacaatacacgttagcacttgaacacctgcccactgcttctcctttctcttatttgtcattactaataactgctgtgggtcacttagtagaggccatgctaaatgctttacatggattacctcattcaatccttccaaagtaggaggtacattttatcattgtcctcatttcagacaagattaaaatttaagcatcacagaaggttacattacttgcctaacatcacaaggcagtaagtaatagtgccaggattagaattcagtttgagagtttatattcttctttttttcttttttttgagacggagtctcgctctgtcgcctaggctggagtgcagtggcgcgatcggctcaatgcaagctccgcctcccgggttcacgccattctcctgcctcagcctctcgactagctgggactacaggcgcccgccaccacacccggctaattttttgtatttttagtagagacagggtttcaccgtgttagccacgatggtctcaatctcctgaccttgtgatccgcctgcctcggcctcccagagtgctaggattacaggcctgagccaccacacccggccagagagtttatattcttaaccaatgacgctgtactatcttccacccaaaatttgtattcctgaattttatgttatctaaagacactgcccccaaaacaaatattttccagtggttctaaaagccagtccttttttaaattaaaaactagaggtgggggaaaaaaaaaaaagcaaagcaaaaaacaaagcctacacaacttgactccaagaacgaagattaggctggacacagtagctcactcctgtaatccagcactttgaggggccaaggcaagaagatcatttgaggccagaagttcgagaccagccttggcaacatagtgagatcccatctctaaaaaaaacgagaaacagccaggcatggtggcacatgtctgtaatgccagctatttaatacttgggacactaaagtgggaggatcacttgagcccaggggttcaaggctgcagtgagctatgatcatgccattgcactgcagcctgcagaacacagcgagaccctgtctaaaatacaataaaatgtaaaaagaacaaagattaaccaaagctatatgaatctgacttccaaaaattaggtgcacaggtaataagcactcttttatcataatgcaatgcacactagctatactacatattctaaattattagaaattggttatttggagacatttagtaaagtggttcatccctaactctacaatatattacaggtatttttttttggcacatataaaccaaacatgagtattttacatgcatcatcatatttaataacaaagcaagcaatgaagtaaatgttattagccacatttctcatatactgaaaataaaactcaaagaagtaaattgcctaggccaggcacggtggctcacgcctattatcacagcactttggaaggctgcggtggacagatatcttgagtccaggagtttgagaccagcgtggcaacatggtgaaaccctgcctctacaaaaaacttgccaggcgtggtggcatacacctgtagtctcagctacttgggaggctgaggtgggtggatcacttgagcccaggaggtggaggctgcagtgagccaagatcacaccacagcactccagcctgggcaacagaggaagaccctgtcccgaaaataaaaaaaaagaaaagaaatgacaacattaacttcaaaaaataccatctgagcacatacaaaacaatcttgtgtgatttaaaagtgcaattactcaaggtcccttttcattatcttctatagcaatcctttagaaaatcatgttaaacagaaaagctgcctacttaaaaagtgaactgtatcttagagattaagacagattcaaatcataaaacaaattaagagttaaggggcactcatctgtttttccaccattgtgctataaatcatcaccatcctcatcatgcaaaggtctggaaaggctgaattctaaaacaaacatctgcctttagaagagtcaggcactcaaattggagtttatcaaacccagtggttaccttggagactacccatcaccacaagcatatacctagcagataagatcaagcagaaagcatctgctaattaagtgtattctatgcatggcctgtctgtattagtacgtaatttccatcttcataaaattcctttgtggtaaatagtaaatactaatctcattttatagcgaggcctaagaagctaaatcattttgccacactaaggaaactctggtaggcagaatgcactccccctccccacaaaatgaccacatccgaatctccaaaacatgtgaaaatgttatctatcaaggggaaatttaaagctgacatggaatcagagttgctaattagttgaccttgaaagggggagattagcttgtattatctgggtgagccctatttaatataaacacaaggatacttataagtgaaagagggaggcaggagagatagtgtcagagacagatttgaagacaccaggctgctggctttgaaaataggagagaccagaggcaaaggaggaaatacagcctctagaagctggaaaagaggcaaggaaaccaattctcccctagagcctgaagaagaaatgcccagtgagacccacgtcagacctctgacttccggatttgttcaaaactcctccctctcgatacacacataaaaacacacatacacttacaactaacaactcacacagtatttggcacttctaaatgttctgtgtactaagaaaactagatatccaagtaaagatatatattaaagaggcagaaacagcattaatattagtaggagctctggtttgaagtagtttaggtttaaatcctcactatgccacttactagtggcatgaccttagttaggtaaattatataatctctctcggccttgagtttttcatctgtaaaataagaatatatctatgtacctctcagggtattttgagaattaaaattttaaatgggccaggcacggggactcacgcctataatcccagcactttaggaggcagaggcagggggatcacttgaaccggggagttcaagatcagcctaggcaacatagtgagaccctgtctctatgaaaaaagttaaaaattcgccaggcatggtggtggacacctgtactcccagctactcaggaggctaaggtgggaggatcacctgggcccaagaggtcaaggttacagtcagccatgatcacgctactatattcctgcccaggcaacagagcaagaaactctgtcttcaaataagaaaaaactacatataatgtaagaaaagactgacatatattaagcactgaataagcagtggcaaaattatcatatgataataacaaaaacaataataattacagcataaagaacatgatgaccaggaaagaggctggtgtgataaatattttaatgctatttcagaacaagacaagactgatgacagttagtttgagataaatgggatgttactttagcaataaagacaaatttagaaattacatgcctactaaaaaataagattgtgctggctgggcacggtggctcactttgggaggctgagacaggcagatcacaaggtcagaagatcgagaccatcctggctaagacagtgaaaccccgtctctactaaaaatacaaaaaattagccaggcgtggtggcacacacctgtagtcccagttactcgggaggctgagccaggagaatcacttgaacatggaaggcagaggctgcagtgagccgagatcataccactgcactccagcctgggcaacagagtgagactccatctcaaaaaaaaaaaaaattggactgtgctaattactaaagtatatgaggattaactactatttattattacagatttataatatatcatgtcaaagcatctgcttaacattccaaatgtgaatatataattttagggctctgtatgatcccttaaataaaatctctttttttaagacagagtctctccctctgtcgcccaggctggagtgcagtggtgtgacctcagctcactacaactttcacctcccggattcaagcgattctcacgcctcagcttccagaacagctgggatttcaggtgtgcaccaccacacccggctaatttttttgtatttttggtagagacagggtttcgcgatgttggccgggctagtctcaaactcaaagtaaacttgcaattttccccgcctcagcctcccaaagtgctgggattacaggcattagacactgtaccatgccaaataaaaactgtttacaatagttgtaaattacctgaacctccccttcactacctccatcaatgcagaaaaactacaattggaaagcttttcagtgagagaaagaacttgtacctacaaattacagagaaaaaaaattataatgggggaagggggaatgggatagacagaattaagtccatacaagtaaatagaaaatgtctggctgggtgcagtggctgatgtctgtaatcccagtgctttgggaggccaacaagggaaggtcacttgaggccaggagttcaagaccaacctgggaaacacagtgaggccacagcactacaaaaaaataaaaaacttagctgaatgtggtggcgcaagcctgtattcccagctactcaagagactgagatgggaagatcccttgaatccaggagttcacggctacagtgaattatgatcacaccgctaaattccagtctaagtgacagagctaggccctgtctctttacaaaaaaagaaaaaggaaaaagaaaagaaaaaaagaaaatgtttcaaatggccaaaggaaacttgcaatttaagagaaggttgactgttctaaagattcttcagccaaagaaaaagagagagagaaaaagagagacaaaccacccagattgtaaaacttttctgagctagatcatattctgtgtcatcacttggcagaagagataggttctgaactcaagggctcaaatgacctttcaaagtctcttcaggctatatgggccacagtgtttcaacgcaaaattacttgtggcaatataaccagaggattcatttttctcctactttaaaatattaactcttcaaagctttgtacaaagcctctaattttctaatttataatactaattttcctttcttttagagatagagtctcgctctgtcgcccaggctggaatctagtggtgcaatcaaggctcactgcagccttgagctcctgggctcaagctcctcctgtctcagcctcccaagtagctggaattacaggcacaagccacctgtccagcttgacactaattttcaagctagcaaagttctcccagaagaactaagtccactgtcgttcatttttatgttttttcatatgatttcttctaattttttttttttttttttttttggagggggacagagtcttgcatcttgctctgtcgcccaggctagagtgcagtgacctgatctcagctcactgcaacctccgcctcccaggttcaggcacttctcctgtctcagcgcctgagtagctgggaccagaagcacatgctaccatgcacagctaatttttgtattgtatttttagtagagacagggtttcgctgtgttggccaggctggtcatgaactcctcctgacttcaagtgattcgcccaccttggcctcccaaagtgctgggattacaggcatgagccaccgctcccagcctgattttttctaatttttaagaaacaggggctccccctccccctccccctccctctccctatccctctccccacggtctccctctccctctctttccacggtctccctctgatgccgagccgaagctggactgtactgctgccatctcagctcactgcaacctccctgcctgattctcctgcctcagcctgccgagtgcccgcgattgcaggtgcgcgctgccacgcctgactggtttttgtatttttttggtggagacggggcttcgctgtgttggccgggctggtctccagctcctaaccgcgagtgatccgccagcctcagcctcccgaggtgccgggattgcagacggagtctggttcactcagtgctcaatggtgcccaggctggagtgcagtggcgtgatctcggctcgctacaacctccacctcccagccacctgccttggcctcccaaagtgccgagagtgcagcctctgcccggctgccaccccatctgggaagtgaggagcgtctctgcctggccgcccatcgtctgggacgtgaggagcccctctgcctggctgcccagtctggaaagtgacgagcgtctctgcccggccgccatcccatctaggaagtgaggagcgcctcttcccggccgccatcccatctaggaagtgaggagcgtctctgcccggccgcccattgtctgagatgtggggagcacctctgccccgccgccccgtctgggatgtgaggagcgcctctgcccggccgtgaccccgtctgggaggtgaggagcgtctctgcccggccgccccgtctgagaagtggggagaccctccacctggcaaccgccccatctgagaagtgaggagcccctccgcccggcagccgccccatctgagaagtgaggagcccctccgcccggcagccgccccatctgagaagtgaggagcccctccgcccggcaaccaccccgtctgggaagtgaggagcgtctctgcccggcagccacccgtccgggagggaggtgggggggtcagccccccgcccggccagccgccccatccgggaggtaaggggcgcctctgcccggccgcccctactggaaagtgaggagcccctctgcccggccagccgccccgtccgggagggaggtgggggggtcagccccccgcccggtcagccgccccgtccgggaggtgaggggcgcctctgcccggccacccctactgggaagtgaggagcccctctgcccggccgccaccccgtctgggaggtgtacccaacagctcattgagaacgggccatgatgacaatggcggttttgtggaatagaaaggggggaaaggtggggaaaagattgagaaatcagatggttgccgtgtctgtgtagaaagaagtagacatgggagacttttccttttgttctgtactaagaaaaattcttcggccttgggatcctgttgatctgtgaccttacttacccccaaccctgtgctctctgaaacatgtgctgtgtccactcagggttaaatggattaagggaggtgcaagatgtgctttgttaaacagatgcttgaaggcagcatgctccttaagagtcatcaccactccctaatctcaagtacccagggacacaaacactgcggaaggccacagggtcctctgcctaggaaaaccagagacctttgttcacttgtttatctgctgaccttccctccactattgtcctatgaccctgccaaatccccctctgtgagaaacacccaagaatgatcaataaaaaaaaataaaaaaaaagaaacagggaaatttacataaaaatgtttcataccatgatacaagtaaattctaaatttaaaactttttcaacaaagtaagtaggcaaaaggtttgtaaactacacttactattcaataaagccatcaaaaagtcactaaatggcaacaactttattatttatttataataactagtagagaggcagcatggttcagtttactaacaaaagaacaggctctgtgatcagtttaatgtgtgcctgtgggcaaatcactcaacatctttacacctgcttcttcgaccataaaaagggaaaaatgttgctgacctgcctcaaagggatgttattagatataactaatgattatggaactttaaaaacgtaatgtgccatataactgtacggttaaagaattccttataaactatatattctgactttgagcatatgctggggacacttcctatagagatccattccaaaattaacgtgtttttgattttgtttttaaaacggggtcttgctctgtcacctaggctggagtacagtggctgcaatcacagctccactgcagacttgacatcctgggttcaagcaatcctcccagcctcaacttcctgagtagctggaaatacagtcacaggccaccactcctggctattttaaaacttttttgtagaagcagggttttgccacattgtccatgctggtctcaaactcctgggttcaagtaatccacccatatcagcctaccaaactgctgggattacaggtataagccaccgcacccggcccccaaaattaacctgtctaatcaatgctaacagggatcccaaagaacagcataagcttttttagaaccagccatatagcacagggatgctccctcactaatcctcatagattaccttttagtaacaatgtcatgcaatgatatttaacagttggtggctgcaataattcacagggcaagagttcaagaccagcctaggcaacatagtgagaccccatctctagaaaatataaaaaatcaacctatggtgacccacacctgtagtcccaactactcgagaggctgaggtgggaggatcgcttgagcccagaaggtcaaggctacagtgagccgtgattgtactgtgcactccagcctgggtgacagagcaagaccctgtctcaaaacaataataataataataataataataataataataataataataattcataggactataagaagctttgtatatataataggtactgggactatttgccacctactagtactaggcatccaaataagttaacaatacttactgaaggccaggcacagtggctcacacctgtactttgggaggtcgaggcaggcagatcacttgaggtcaggagtttgagaccagcctggccaacgtggcaaaaccctgtctctaataaaaatacaaaaattagctgggtgtgatggcacgggactgtagtcccagctacttgggaggcagaaacatgagaatctcttgaacccgggaggcagaggttgcagtgagccaagactgtgccactgcactccagcctgggcaacagagcaagaccctgtctcaaaaacaaaaaacaaaacaaacaaacaaacaaacaaaaacagtacctactgaatactaagcactgctacatacctgcaaaacttaaagaaacataccggtgccctatataaattatttggttgtagaaaaaataacatgttgaatgcaaataaaatcttactaaagccatcaagaagaatgacacagacttgtgtaatatgtactgatatagaagaatgtaaaagaaaattatgggccaggcatggtggctcacgtctgtaatcccagcactttgggaggccgaggcaggcaaatcacgagctcaagagatcaagaccagcctggccaacatggtgaaaccctgtctactaaaaatacaaaaattagctgggcgtggtggcgcgcacctgtagttccagctactcaggaggctgaggcaggagaactgcttgaacccgggaggcagaggttgcagttagccaagatcgtgccaccacactctagtctggtgacagagcgacagtccgtctcaaagaaaagaaaagaaaagaaaattacgaacaatatgcatagcataagcccatttcaatacagtcaaacataacaaaataaatactcatgtttgattcatatgtgcaaagaaaaaggtgtggaagaatacacccaaaaactgttgaatcaagttaccaggaagtaagacttctactgtccactgaatactactatgtaatttttaatgtttacagaaaatctttattgctttcataataaaaatttctttaattttgctagaagaactagtttagaaaaatatttctccaagttagagcaaagcacgaataggtgacttactaaatgccaaaagctctctggcttgcctttaaaaaaaacaacaacactttagcaaagaatattcagattaaaaaaaacagaaatggggctgggcgtggtggctcccacctgtaatcctagcactttgagaagccaaggcaggcgatcacctgagctcgggagtttgagaccaccctaggtaacattacaaaaccccatctctactaaaatacaaaaaattagccgagcatggtggcgcatgcctgtagtcctagctactcaggaggctgaggcacaagaatcgtttgaacctaggaggcggaggttgcactgagccaagattgcaccactgcactccagcctgggatgcacagcaagattctgcttcaagaaaaagaaaagaaaagaaaagaaaagggttctttgatgaggtatccttatcaagataaaactgaaaatgtgaaaagttgaatttttgagatgcagtctcattctatcacctaggctggagtgcagtggtgcgatctcagcttactgcaatttccacttcccgggttcaagagattctcctgcatcagcctcccaaacaggcataccaccatgcctggctaatttttatattttcagtagagacaaggtttcaccatgttggccaggctggtctcaaactcctgacctcaagtaatctgccagcctcaaacgcccaaagtgctaggattacgggcatgacccaccgtgcatgcctaagttgaattttttttttttattctgaaatagacataagccaagctgcttcacttaactttgacagcaatagtggctcctccgtgttcaggcttgttcagctttttttaactcctctctggagtagagactcgggtttagcagggctcctacagtcattcgccctacctgcctaggctgcccatgctagatcagcttcaggtggctgactacaccacatcagaacagtattctgatcaagaaatgaaaacaatttttgccatacataaaaggctatacagatggatgcttatccagaaaataagtatcttcagtagttcacctaatccataaataaccctctaggcttggaagtaaaatttacttttcccttacaaggaaagacgggagcaaattaggagagaggagatgtattatatttactaagagaagcttctgcatcagtaagtaccaggaaaataaaggttagacatgagagcaaagagttcttggaataaagaaatctggttatcaccttctactaaacattctgtttttaaggatttcagaaggaaagaataacagatttaaggcttaatcacaaaactgcaacttcaaaattaacttttaaaagaccagagtcaatctatctccccgaaagcctacttaaactcataagaatctgcacattctttctaccgaactaataataatagctacaatgtattgagaacttactatgtagtaaatcctactacatttagtcaccccaaacaaccccatgaggcaattactgtaagcatttcgtattttagatgaggacaccagtcttcttggaaagtttaagaaaaactgcctacactctggtaagcaggagtggcaattcaatcccaaacagtcttgattaaaagaatcctcactctatcagcttatttaaaaaaaaacaagacaggcttcctctaataatacaactgccacgtactaactgctcagaactatgccaagcacagtgtaaagcattttaaatatggtatttcatttcatatttacacaactttacaaggtagctgttattattctcattttacaaaaattgaaactgatgtttactttcatttcaaaaacagtaactttacccaaacctcagcagccaagtaaaggacataaaaaggactggaaataagaccactgactttccaagccatatgctcttaatcatgaagctacaatgtttactgggcactttaaacaaagacagttttcacagtcatattcaagcagtaaattaagagaggggacaagtagatttaccaagaaaagcttctgcatcactaagtagcaggaaaagaaaggttagaaacaacagcaaggttcctggaataaagaaatctggtttatatttaatttacatataaattatcttaaatgatatataacaatatatataacattttactatcagtaaaatatgtttataaatacgtatttatatatatttcggtatatacattattttggctatcaatataaagtaaatcctttctttaaataccacttgctcaaaggttttagtttataatcttcatttgctattgaagtgcattgttaaaatatgatgttcaatgaaacttactaaagttatcaatgactatgttctcataagcaattataccctgaaatcaaaaggttatcaattagcagatagcattaatagaacttttatataggatttcagatattctagttgtcacattgccaaaaatttatctataaactagagaaaaatggcttaaatgagaaaagtctacatataaagtatctgtcccattgtccaggccaggcttggtggctcacatctgtaatcccaacattttgggaggccaaggtgggaggatcacctgagctcaagagttcaagactagcctgggcaagataaggagaccccgtctctaccaaaaatacaaaaaaatttagcgaggcatggtggtgtgcattatttgtagtctcagctacttgggtgactgaggtaggaagatcacttgagcccaggagctggaggctgcagtgagctatgattgcgccaccgcactccaacctgggccgcagaacaaggctatgtctccaaaaaaataaattatctgtcccactgtccaagatatagtgtaagtaatctcacacattttaatggtataaacctactgcctaattattattctcttaattgatgacaggtaaatttgtaacttaaaagtgatataccctattttcttccttataaatgtaaatttgtaactttaaagtgatacaccctattttctaccttataaatcagtaataatggcccagagaattagcccgttctaccaccttactatcaacactaacattaatctggaaagacattagttacagggatgttgaattctatacttacgtctaactgtatcctaaagctaagcatatctggttattcacagttagatactattcttgccttagataacccgattagagtaaataattgaatatgcaaaaggtaagagtaagcatatactaacatttgtaataaatagtttcataaataatatccaatgtgccatggtggtgtgcacttacagttccagccactagagaggctgaggcagaaggatcactcaagcctaggagttcgagaccagccaacgcaacataccaagactctgatctcataaattaaattaaattaaattaataaataatcccaatttgctacagactacaattccagatttccaggaaattattttggaaattattttataaaatgtttccatggatcaaaggctagttataaatttaaaaaattcaaattcttcttaggaattcaacgaggtaaacatttcaagcaattcacattgagtatccctaactcaaaaataagtggggtgcagtggctcacacctgtaattccagcactttggaaggctgaggcgggcggatcacttgaggtcaggagttcgagaccagcctggccaacatggtgaagcctcgtctccactaaaaatacaaaaaattagccaggtgttgtggcacacgcctgtaatcccaactactctggaagctgaggcaggagaatcacttgaacccaggagccagaggctgcagtaagccaagatcgcactactgcactccagcctgggcgacacagcaagacttcgtctcaaaaaaataataatatatttatataaggctgggcacggtggctgatgcctataattccagcactttgggaggctgaggcaggaggatcacctgaggtctggagttcgagagaccagcctggccaacatggcgaaacctcgtctgtactaaaaatacaaaaattagccaggtgtggtggcaggcgcctgtaatcccagctacttgggaggctgagggagaagaatcgtttgaatccgggagccgagtgttgcagtgagctgagatcgcaccactgcactccagcctgggtgacagagcaagattctgtctcaaacaaccaaacaaaaaaacaagatacagatatacatatacatacgtaaaacacaaaaaatcagaaatgctacaaaaactgaaactttttcagtgttcatgttacaccaaagggaaatgctcactggaacattttggattttcagatttgggatgttcaaatactaagcatataaatgcaaatattccaaaatctgaaaaaatcccaaatatttctggtcccaagcatttcaggtaagtgatactcaacctgattaagcatttcacctaaatgttaacatttcagaaacaatataataaaaatttttttctgattctgcaatgatttaagcaaaaataaatttgaaaataaaatgaacagtgactagttgattactttttctttaatggtaaaagtagaaggatatagaaacaactcttcctattaaatagattagcagcagatcagtcaacagatgataccacagagctgtgtttcttaacatttgtactgtgggtttcatcaagaatctgatgaaagctatctatggctcctctcctctgaagcctacacttggactttctgagtaatatatgagcaagcgttaattaaggaaaggggaaactatgctcagagtaagccaagtattgttttaaaacttttccctttttgactctttcattatgtcccttgcttctattaaccagcttaaaataacagccactatggtaaggtgaacatgaagatagtttgtctatgctgaccttagtagacctgctttttattttctagtaaactgtttatatacttccataaactcatttttttcttccccaaatctgaatgctgtctccaattttagaacgaaaattatgatttctaaaagcacattattttctacggaaaccttgaataccagagtttcctgtactcctaagagatccaaagagccaggaatttctacctgttttgttccctgacatattccaactgactagaacagagaccaatacataataagtattcaataaatattgaattaattttttaaatgtccaactccttggtggccacttgccacaacacaaaatacatgaagttaaatactcagcactccccaggttatcacacaggtaatattagtaccctaagaactgaaaggtccactcccaggacccaagagaattaaaaatacatgttcgcacagaaacttacatacaaatgctcatagcagcattactcacaataagcaaaaaagcagaaataacccacatgtcctccaaataagtagactgacaaaatgtcgtatcttcataagatggactattattcagcaataaaaaagagcatagtattaacacttgctactccttttttttttttttttttttttttttgagacggagtcttgatctgacacctaggctggagtgcagtggcgccatcgcagctcactgcaacctttgcctcccaggttcaagcaattctctgcctcagcctcctgagtagctgggattacaggcgcccaccaccacacccggctaatttttttatttagtacagatggggtttcaccatcttggccaggctggtcttgaactcctgacatcgtgatccacccacatcggcttcccaaagtgctgggattacaggcgtgagccatcgcgcctggtcaacacttgctacttctttcacttatgggaagtaaaagaaatcagacacaaaaaggccacatatgtattacaggattccgttaacagaaaatgcccagaatacgcaaatccttatagacagaaagtaaatgctaagctcagtgtctgaatcttgtaatcccagcactttgggggccaatgcaagaggatcacttgagctcaggagttccagaccaggctagggaacatagtgagacttcactactacaaaaaattccaaaatttgctgggcatggtggcgcacacctgtaatcccatctacttgggagctggaggcaggaagatcgcttgaacccaggaggtcgatgctgcagtgagccatggtcgagccactgcactccagcctgggtgacagaatcaaaactcttctcaaaaaaaaaatttagattagttactggagggataaaagaaagggagaacagtgaatgactgctaatggataagaagtttcttgttgggaatttggaaatgttctggagttaaatagcagtgacagatagctagggataagtaacgtgcctgaagtctcagctactcaggaagttgagggggaaagatcacttgaccacaagagttcaaggccagcctaggtaacacagcaagacctcatctctaaaaaaacaaacaaaagaaattaacaaaaaagttttcaaaagatagtagtgatggatgcacaaacttgtgaaaatactagaaatttatgaacactttaaaaaggtgaatttggtgaggcgcggtggctcatgcctgtaatcccaacactttggtaggccaagatgggaggatcatttgagcccaggagttcaagaccagcctgggcaacacagtgagacctccacagaaaatttaaaagttagctgggcatggtgccgtgcacctctggtcccagctacctgggaggttgaagcaggatcacatgagcccactgaagatcaaggctgcagtgagctgtgattgcgccactacactcctgcctgggcaacagactgtggccatgtctcaaaaaaaataaaataaaagggtgaattttatggtatgtgaattatatctcattttttttaattaaaaaaacaagtgaaaggattgctcaactcaatgttcactgctcactgagaaggctaagatttgacaatgccttcatggtcatactcagttccaagaatcccatctaccaactaatcacagcaaaaagacttttttaaaaaaagggaggacggccaggtgcagtggctcacactttgggaggccaaggcgggcggatcacttaaggtcaggagttcagaaccatcctggccaacatggtgaaaccccattgctactaaaaacacaaaaaaaaaggccgggcgaggtgactcacacctgtaatcccagcactctgggaggccgaggcaggtggataacaaggtcaggagtttgagaccagcctggccaacatggtgaaaccccgtctctactaaaaatacaaaaattagccagacatggtggcacatgcctgtagtcccagctacttgggaggctgaggcaggagaatcgcttgaacctgggaggcagaggttgcagtgagccgagatcgtgccattgcactccaacctgggtaacgagcgaaactccgtctaaaaaaaaaaaaacaaaaaatacaaaaaaaattagccaggcgtggtggcaggtgcctgtaatcccagctacaggggagtctggggcaagagaattacttaaactcgggagacagaggctgcagtgagccgagatcacatcactgcactccagcctaggcaacagagagaggctccgtctcaaaagaaaaggagggagggcacttgtgggaggacatacatgtgcaagttgcagtaagtagaattttcccttcacacccaatccattgaaatccaatcatccccatcttcaaatatattcccaatactactatttctcctcaccaccatctctccccaggactagcttgacagccttctgactgatctccctacttccactcttgtgttcccatgatctgttcgaacccatgatgtgttcactacccagcagtcaaacatttttgaaaatgtttatcacatcacttcactcaacacccttcaaagggttcctaacacattcagattttactcaagtccttaccatgtcctataaggccctacaattgtactggccctttgtgaccctctctgacctcctctcctaccactccagccctgatggccttaatgttccttaaatgtatcacactcaaacatgccaagcacactccatctcagggtatttgcacttgttttctgcagggaatgctcctcccccagaaacctgaatggctcactctatcacttgtttcacagcacacttaaatgtcatctcgaaaaggccctccattatcacctaatctaaagtaacccaccctctgtcactctaacctcttattctgattccgtatcatttctcttcaaagcacttagcattattttttttcttaacgtgtgtccaccatagtagaaagtaaactccacgagggtaagaactcttgttctattcactgctgcatcctcaaaacccagaacaatgtccggtacaaggaaagtacacaatgtgttcaatgactgaattcactggctgacttggcaaaaacattcttcagtgacataggtactcacctagtattttttttaattacaataaacaaagatttagcaatttggacagaaaacatgttagtattttacaagattacctattcatctaaaggaccacaaatttatagcacaaaatttgccatgttatggatcttaaatcccttcaaatatcatagatatgaggttaacattcacaccagattaaccaagcctctgacttcatcctacctacttactcttacatcttaactagcaggtccaatgacagcatgcttcaaatgacagtaacatctatctaatttcctaagaaaaaaacctccatcttcttcctaccccaggatgagttactaggtcctgaattctacttcttttaagacagactcttgctctgtcgcccaggctggagtgcagtggcgtgatctcggctcactgcaagctccgcctcccaggttcgcaccattctcctgcctcagcgtcctacaggcgcccgctaccaagcctggctaatttctattttttgtatttttttagtagagacggggtttcactgtgttagccaggatggtctcaatctcctgacctcatgatccacccacctcagcctcccaaagtgctgggattacaggtgtgagccactgtgcccggccctgaattctacttcaaaaaggctcagatctatcctctctgctccacttccaatgcattagttcaggcccttattcattttccacttggacttcttacctggaatttccatccttacattcagctctccccttgtttttgcagtggcctgatctcagctcaccgcaacctccagctcctgggttcaagcaattctcaacaactttcaatggttccatgtagttttcaagaaaaaatttttttttttttgagacagagtattgctcttgtcacccaggctggagtgcaatggcatgatctcggctcactgtaacctccacctcccgtgttcaagctattcttctgcctcagcctccctaatagctggcattacaggctcacaccaccatgccctgctaattttgtatttttagtagaaacagggtttcaccatgttggccaggctggtatagaactcaggtgatccacctgcctcaacctcccaaagtgctgggattacaggtgtgagacaccatgcctggccaagaaaattttcgactccctcactcagcttcatctcccaccactgcccttttattcctacccaaacatatcatgctttaagttaattcagtcacaccaaattacttacagtttccagatacttcaccttgtttcgttcattttccagtacgttatcctctatctgaaaaacttttcttcccttctttgcctagcaaaagccttcgcactcagcttagatgtcaactccaccagaaaactttccatagctctctgatttagctgtcctcttctgtcctctcatagcatttcctacaattattttatgttggaatactcataaatagatatgctaggagttttgctttatttatctgcatcttctgctacactgtgggctccctgaaagcaggtcagatgcctcacccaccttcattctatattacctgatatatgaaacgggttgttgttaaatgaatgacttatgaaaggggtgagacagaaggaagagggggaaggaaaagaacagagaggggggaacgaactgacagagtggatagggagacaaacaaaggtagaggtagggggagagagagagagaacatgtacacacacacagggcattaaaaaagggaatttgtaatcaatccattattttttcatgtggcctaagccaatcattgttgaagaaagaaaagtacatctggaaaattcaatctacgtggattctaaatataaccacctttttttttttttttttcctgaaatggggtctccctgtcacccaagctggagtgcagtggtgccatctcgactcactgcaacctccacctcctaggttcaagcgatcctacctcagtctcctgagtagctgggaatacaggcatgcgccaccatgcccagctaatttttttatacttttagtagagacggggttttcatcactttggccaggctggtcttgaactcccaacctcaagtaatccacccacctcagcctcccaaagtactgggattacaagcatgagccaccatgcccgccaaagtataatcatctaaatcattcctcctctaaagattctggtatatccagcccaaccagcccattttaattgaaaatttactgctacgtaataaaagacgttaataacatgtacaatatagatacaggaaaaaaaagtttgagtttaaaaaaagtaaaaatcggccgggcgcagtggctcacgcctgtaatcccagcactttgggaggccgaggcgggcagatcacctgaggtcaggagttcgagaccagcctgaccaatatggagaaaccttgtctctactaaaagcacaaaattagcccggcatgatggtgcatgcctataattccagttactcaggaggctgaggcaggagaactgcttgaacctgggaggcagaggttgcagtgagccgagatcgcaccactgcactccggcctgggcaacaagagcaaaagtccgtcttaaaaaaaaaaagtaaaaatcaacctgacataataaaaataagtcttggaattatttacaaactttaataatctaccacctccttataatgtggtactgctgatttttattttattttatttagtttttttttttttgagagagagagtttcacttttttcgccgaggctggagttcagtggcgcaacctcagctcactgcaacctccgcctcctgggttcaagcagttctcctgcctcagccttccgaatagctgggattacaggtgtgtgccaccatgcccagctaattttgtatttttagaagagacagggttttactacgctggccaggctggtctcaaactcccttgacctcaggtgatcctcctacctcggcctcccaaagtgctgtgattacaggcgtgagccaccatgcccagccggcaccactgatttttaaaagtctatcaagagcatgaaaaataaattcaacataacaccaacatcacgatctatgttacagcacaaattccttatgtattacgaatcatattcctcaaaaacatactgtgaaaaaagtaacatagcatatattagacagtaatgggaatgtatttgtttacataaattcttaaaggtagtacatgggaaaactgctaaaacatacaacacttcaactttaaaacaacacctaaaaagtattactacataatctaactttcaatcacctcaataaactgtcacttaataaaatttaaagatttgttgtcgttaatacaacagacaattcaaacttaaaagcttgctcccaagtacaaatatgtttggtaagatccaataaatggcataaaaccttctgtagctcaatgatcatcgtaatacagaaattacaccaggcacggtgactctcgcctgtaatcccagcactttgggaggctaaggcgggagagtcacctgagcccagaagttcgacaccagcctgggcaacacggcaaaacctcatctctacaaaaactacaaaaattagccaggtgtgcctgtagtcccagctactcaggaggctgaggtgggaggattatttgagcccaggaggcagcagttacagatcgtgccagccagggtgaaatagtgagactctatatcaaaaagaaaaataaaaaagaacgaaagaaattgggaacacacagaaaaagaaacaaaatttaggcctaatacactcaacattaaatagattctgaattgcaatttttgctaaagcaaaatacaaattacaagaagcttctcatcttttatcacataagaaataaagttgtaagaaataagctaagtttttagtactaataattactagcaaattctctgagatttgctatacttataataacaggaagtacttgtatgaagttagaaatttattttagtaactttttccttttaacgttaaaagcacctttttaaaaaatgcagtagaatgtaatgctgagcacttaaaattagtatttctaaaaagataccaaaaaatttgcatttggctagtattaccaagaaacttttaaggctaaagtttccaacatactttcatttttttaaacagactacttaaaaaaaaaaaggaaacgaaaggaagaaaaaaaacattttaatctcagactttcaacttaactacatttcttttaaccaaacatttatagagcacctaagaagtgacaagcactacaacactgggaaatgtgacacattacatttactccaaactaaaccttttatttattcggcttctgaacttattatttcttactcaaaccaaaacttttcttaagaaattctcacccaacatcaaggtacatatacgagttacctaataaatgcactttcaccactgttttacacaggtgatgagagttatagctaggatttgtgactaacaaaagggattcattcctgaaacatgtctatgcttcatgaaatgagataggaataaactgtttcaggtagtttacagcatcccaaactcaaagagaaaaccttaaaaaaattagactaaacttaattactctgtatagtagaccaagatttaagtagccacagcttttaccttctacaaccacaagtattacaaattttaatttggatgcaaaattgtcaaagcagtcttgattctgaggacaagtgaaatatttttttaaatagttcaaaggaactgtcaaaagtagacaacgttgatattctaacatgctatctgttgcatttctacacttgtgaacactctacccttttcaagcacttctgaatttgtaatggatgaaaaaatacaagctagtgtctaagttccaccagttgaatccagacttttcaaaaatctaaggttttattctagcatgtgtttaaaaaaaaaaaagacagcattcatatacatattctctcaagtaacaaaaatacctgtatttttatcgttatcatttcttccaacaattaagcaaattttttgaccctattctccactcagttaacatattgacatctaagaggaacctggccatcagttttccacacatcataatgcaacagagcctctgacttatttacagaccaaccagatcaataaagaaaaataaaccatataaccccaagtcactggaaatacaagaaacaactggtatctctgaattgtgtaaaaaatcacaaaaattctctttttaaatctttcaattaaattatttttgtgacgagtcaaagagttttctgctaaaattttacagtactgttcacacaataaataagattctctttcatcagtgtaactgatagaaccacaatacagttcagtttctagggtcagattacctgacttgctttttattttaccttttaaaacactttaattcatgccgttattcctctcattccctacaaaaagagatgttcaatatgggagaatcatcttcagttgagacatcctataactgcctccaactccacagcaaagcccgccagctgaccccggtctctctggggaagggctcggtcaccaagtcaccaaacacaccttcctctgcaaaactcggaagccccacacgacgacctcgtcgaaacctcctacttcctgaattcgataaccccagagattcgttttccgcaggcaatcttaccttcatgatgactctgggaccaaggtatcctctaaaacaccaggttcagctgcacctggaggggaaacaaaagacacccagtcaacaccacaggagcccctctgcactggcggaggcggagggaaagaagcgagcgacgtccgaaccccgaagaaagagccgcaaccaggcgccagcccccgaaccatcacacgccgactcggggctccctccggccccgccatccccgcaaacccaaccacctacacagctcggcagcttcccgtccccattgtcgagacccgacggagtttcccgtctacgacaatgacgccatttctgtcagagaagaaactcacaacaagcccggcgtccggcgcagggccggccgctctcccctagggcctcggcgcccggccgagcgaatccgcgcccccacgcgccgcgtccgagcgagaggccggccgggggccaccgaggggccaggagggcctgtgggccgcgggcaggaccggcccgccacagagcccctgcccacgtcccgttccgggctcagacccgacaagtgggagcgagatcaacatctggccccgccgcggggacaacgtgagggccgagggccccggaggcggaacggcccccaccctgcccgggcccccgaccgcggccgctaaaccgctgagtgtgcggccgcccagccagggggcggctcggacacagcggctgcggggggtgggggttcccgggaggccgaggccccgaattcgggcgccgcagggaccaccaccgcgatcttcctctgctccttggccgggcccagcgactcccaaaagaacccccttaggagaccacgaaagccccagaaaatatccctaccttcctcggaggcgagatctgaccctggcacgtccagagtcccctctctccttctcccccccaaaaccagcaggcccgggggagagatggggaagaagggcggcgggtccagcggctgctgaggcagaggctccggctcctcctcctcccgcggcggcgactggtacctttgtttggcggccgctcgggctccctggttggggggagggggacgacgaaaaatcccccccggactggaggtccgggcccccaatcgcgctgccctccagaggacggcggcgatggaccctctgcagctccctccgggcaaaggtccaggcggtggccgtggcggcggcaagatgaagctcaagagtctccctccgcttcggcgaccgagctcctcactccggactcgactgacgggcaaacatcgcttcccccccaccgactctaggttccccccctttctcccctcccctagattttttttccccccctcccctacctctttcccggatggcctcttagacgaccttggattggttaaagttctttagaacccgcctatacactgttcctattggtccctggatacaaacaacgacgccattttcccaccagttctatggaaacagaaagttacgcctcaaggctttctgggaaataaagtccatactctggggccaacgcgcaaatcctcgtccgcgagaactgcaaggcccgcaatgccctgcgcctgcgtggaccggtgcgggggcgggggggaggtgaaaggggcggggcaacaaagcagtagggaggcggcaacgacgcctgcgcagtgtgaccgggatggcgcattttcttgcaccaactaatgcggtgtcgctggcggctgaggagggcggagagttctgtggtgaaatagtgggaaggattcatgtaggcatcgggaagagcctaagtccacattataaaataggaagttgatgcggggtacagttactcccggaccggcggcgtgaaagtcgtgatatcatcgttgaactgtgagcggcagtggcggcggctggggggaacccggatgggaagaagggcgggggaggctgggaggcggggcagaggaaagaaagaaaggagagtgaggacccggatgctgaaccggattgtgtatgaattttccatcccctagctttaagcgaggagggagaggaagggttggccaagtggggcggaagggagcatctgagcgaggaggaagcagaaacctcaccgtttcttcccctccggactctgtgctagcactgtatacgtttgcagttctctgcccagccgctgtggaaaatcggcctcgaagtgattgaaattccctgtttatatcaggcggcttctttcagatccatcgtctttctcccggagtatgaatggaaggattcagtatgcgcttcacatttgtatgtctctggccattctcaaaccaggcccttccctttgaaaagtcttttgcatgggatgttcacttcttagacgcaaggttgtgtgccctggtttcatcgtctaacgcgttagaaggcgctttcatttcttcatgggtgttgagcgccgaccactggggtggcctctgccttcgtagacctgcgcctggtgagacggacagatgctgaacaaaacgatgtgaaattaccgcagtggcagtgccccagaggagagttccacggtgataggagaatgagggaatttggcttctttagggagggaaaggaagggtttctgagcaagtgaggatcgagctgagagctgaagggctagcaggagttaactaaggaaagagaaaaggaaaagacattccagacaaaaagactaacttgtcagaaagccctgtggcggaagggagcttttccaatatgaagaactgagcctggagagatgggatgagggggagtgtcgaaccttttaggctttgtaaaggagttttggttttctcctaatagcaatgggatatcttccaaggaatctcaatcaaaagggagagatggctccgattggaatgtcatccctggctgaagagtagaggaagcgaaaaaaagaagagttaaagaggcaaatgcagggaacccgacgaggaggctattgccgtagtagttcacatggtgaaaagaatggagcgtttgtattaatgattatggattcactctttgaacaaatttctggcagctttttagttttgaaagtgagaagtttcagactctcactgaggtattctgtagttttttcactctaaaaggaaactagtagagttcatgtaacacacactaatgcctctttacatttaactttagtatgtgatagctgaaatttccagctgtgataaattgggaaatcctttgatttaaaagaaaaacaaaggcgggtgagggtgagagtatatgccacggtgtgtagaatcctttagactcttaagaagacacaaggcggctgggcgtggtggctcacgcttgtaatcccagcactttgggaggccgaggcgggcggatcacgaggtcaggagatcgagaccatcctggctaacacggtgaaagcccgtctctactaaaaatacaaaaaaattagccgggcaaggtggcgggcgcctgtagtcccagctactcgggaggctgaggcaggagaatggcgtgaacccgggaggcggagtttgcagtgagacgagatcacgccactgcactccagcctgggcgacagagtgagacgctgtttcagaagaaagacacaaggcaagttggttgtcgatacctggaaaaattgaagttcttatgttttcataccactgaaaatgcttgtatgtaaatatcctctgggacaggaaattgacttaagtgagtattcttaaacatctctaagtgaggaaaggaaatattttttaaagcataattagtgttttaagttgaaaaataacatcaaccacaaagctctacgaattgaaacaaagattagctctgatttctgtgcaacagggtacacctgttacaggtcctgacacaaaagggaattctgaaagtgcatctcattgatttttaagttcggtcaaatgtgttttggaggctgtgagaaaatatacaaacgtgattcttgctcccaacttgtagttgagaaaagatagatactaacatttaaatagagaagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtggaatttatgtcttagcttgttataacacaaacacgaatatttgtctgcttggcattaaagggtaaagatattccatagctgggaatcttaatctgaggtacgtgtaaacattcagggactatatgatctctgagaatttgtatgttgtaagtctttgtggcagtgtatacatttgtgttgcaacttattaacacatacaccgggcttttttttttttttttagaagattcatagctttcatcatattctcaaaaggtttctgtgacccatgagatggtttacagtatggggaagcatcaaagcacttgcacagttgatggttatatgtgtgtgttattatttcagccacccattatcatgtgcttaccaactgcctaacagtgcatacatatgtagaagttttattcttttctcctgttgccatattatacgtctcatttcacagcagaaaaacaactgcatgacagagacaatgtggttcaaaccattttacccttgtattcattgactgctacaaaacaggaacattaaatacctgattgtcaccaaattgggtagtctcagcacttctacactcgtaattgtgctggaaaagtggaatgctagcactaataattagattttggtttggagggttttttatttgtttattcttacttgtataaatttatggggtgcaagtgtagttttatcacatgcatagattgcattgtagtgaagtcaggacttttagggggtccatcacccatgtaatcacgttgtacccattaagtaatctttcatcatccacctccttcccaccttctcaccctttggaatctccattgtctatcattccacactccatgtccatgtatacacattatctagctcccatttataattgagaagatgtactatttgtcttttatgtctgacttgttacacttaaggtaagggctatccatccattttgctgcaaatgacatgatttcattttgttttaatggctgagtaatcattcgttgtatatataccacattttctttattcagtcatctgctgatggacacttaggttgattccatatctttactattgtgaatagtgctgtaataaacacatagtgcaagattttggaaattttacttttgtggcacgttgttggtatttactcaggatctttggatttgcttggctgcatgtatatgaatcagtgtgtttatttactgaaatatgtgcaaaagtcttgtctttggtggattaatttataatataaatccacaaaagtcagattctgctcctaagtatattttacatttttaaatttaatgccagcaagaagttacagtactagaattgccttacccctgagagtatcaatgatcagatcatagtatcaggtgactgggctatagaagatgacttttattacttaacattatgaagttactagggctgatttagaaatcgaggaacactggtgaaaccccgtctctactaaaatacaaaaattagctgggcgtggtggtgggcacctgtagtcccagctactcagaaggctgagtcaggagaattgcttgagcccaggaggcagaggttgcagtgagccgagatcgtgccactgcactccagcctgggcgacagagtgagactccgtctcaaaaaaaaaaaaaaaaaaaaaaaaggaacacatcctcactgttacaataaataacagtagcccacacccccttagttgtgatgtggtgtgataccatgtaagcaacctatttccagttcccctaacattctcaagcagctgtatcagaatcatacaagatgcatatttaaattgaagatttctaagtctctggcccagacttagaaaaaaaggatcaggccgggcacagtagctaacacctgcaattccaacactttgggaggctgaggcgggtggatcgcctgaggtcaggagttttgagaccagcctggccaacatagtgaaaccccatctctactaaaaattcaaaaaattagctgggcgtggtggcaagaacctgtaatccctgctattcgggaggctgaggcaggggaatcacttgaacccgggaggtggaggttgcagtgagccaagattgcgccactgcactccagcctgggcaacgagcaaaactccgtctcaaaaaaaaaaaacaaaaggacctttgagcaatcagaataacacaaagtacatgaactgaacttcattttcttcattcaaaagaaagtggccctcactcaagcaaatatattcttgtgctttatcttctggcatactgagataactttctaaagtggtttccaattccaaaatccaatgatgtgcaactcattgaacagccctaaccacaaactgccattagatgccatattacatttagcctttttgttgtagaaaagttggttagaagtgggctcaggattctaaagactaaatcatagtcccaagaagcaaaagaaagaggataaaagtaataaacttcccaaaatgtgccaaagatgctagagcagttagattcctaatatgaggacaagtaataatagaaacagatacaaagaaataaagtagagattcaacagtacagggagaccctaggaagaccatgagtgttattctaggaaatactgaaataagacagatttcagtataaaggggaatatgtttaataaatatatgcatttgagttaatgcgtattttaaatcagaaatctctgaaatggattgattgtagagaaactactagggggacgaggagaatccctttaaattttaaatacataaaacatactcatcttagtgctcatttaaaaaaggatatgtttactaattagtgtaatcagttaaatacagaggtatctttccaattctttggatgtgttttgacatttgccgtcaacaaattaagccttttgtggttgattaaaataggaaaagcttaatataagttatgtgactaagaaaacaacttaaaaaccaagacaacactttgaccaatataatcacttgaatgaagaattttctaattgagatataatttacataccacccatttaaagtgtacatttcagcagtttttagtgtattcacagggctgtgcaaccatcacaatttaattttataacattttgatccctgcgaaaagaaaccctgtactcattagcaattagtccctgttcctaaccactaatctactttctttctctgtagattggcttattctgaacatttcgtataaatggaatcatacaatatgtagtctcttgagattggcttctttcacttaacatgttttcaaggcttcatagctgtagaatcttgctttgtttttttgagactggagtcactctttcgcccaggctggagtgcagtggtgtgatctcagctcactgcaacctctgcctcccgggttcaagcagttctcctgcctcagcctcccaagtagccagaactacaggcacacaccaccatgctcggctaatctttgtagttttagtagagatggtgtgaaggctggtctcgaactcctgacctcatgatctacccacctcagctaatttttcatatttttagtagagacaaggttttgccatgttgcccaggctggtctcgaactcctgggcttaagctatccgcccgcctcagcctcccaaagtgctgggattacaggcgtgaactaccgtgcccagcaacagaatcttctttttaaaccagactaggtgtcttttcacaaacaccctgcaatacaaattcctttgcagtttgacactgaaagatgattagtttcatgtgatctttatgtttctcctttttgacagattagctttgaagtttaaatccaatggagaagactcaagaaacagtccaaagaattcttctagaaccctataaatacttacttcagttaccaggtaatacttcacttacagtccatatagggtcattttcatgcagtagtggtcgttcaaatgttagcaaatagaaaaggttagacttgctagccgttgagattttctatttaaggtgatgcgtatgagaaaaatgataaatagaacattataattttttctttattaaaaggtaatttttgccaggtgcagtgatacatacctgttgtcccacctacttgggaggctgaggcaggaggatggcttgagcccaggagtttaaggctatagtgcacaatgatcacacctgtgaatagccactacactccagcttgggcaacatagtgagaccccgtctcttaaaaagaaacgtaatttttgaaggcaccctttaaaacatatccaattatttaacatatcttgaaaaataaaaatacttaaaacattttggtatctcattggaggttgtactctttacggatattacgcattcagattccccactgtttagatattaggggaagttacgcagatttgtttaacagtagaacactttatttaccatacatgttcaagtttaccttctatgtctgtattttccagtatctcacacatacactgcatttcatatactactggttcctttgagagccaaataataatgtatctaaaatcacagtatttggaaatatagcccactttattcctgtataagggtatgccaccttggacatggcttcctacctcacgtgtacgtgtgtgtttttgttttattttgcttctttaaaaacttgtctggaggctgggcgtggtggctcacgcctgtaatcccagcactttttgaggccaaggcgggcggatcatgaggtcaagaggttgagaccagcctggccaacatggtaaaaccccgtctctactaaaaacacaaaagttagctgggcatggtggcgcatgcctgtagtcccagctactcgggaggctgaggcaggagaatcacctgaacctggaaggcagaggttgcagtgagctgagattgcatcactgcactccagcctggcaacagaatgagactccgactcaaaaaaaaagaagaacttgtctggaaatgataataagcaaaaactcatgaatataataaacaggggttattgtaataaaaaatcatttgtattagaatattctttctcatagacataatataggccaggtgtggtggcccacacctgtattcccagcactttgggaagccaaggcaggattgcttgagaccaaaagtttgagaccaccttgggcaacataacaagtccccctctctgttttaaacattttttaaaaaagaagaaataatataaaagttggtaaattatttgacaagcataaaaacctatttagccatactgtgactaaactctaatgatgctctcaattcagtctcaatagacacttttaaatttccgtgctaaagtacacacctttctttatgagcacttctctgtggtaatatgtgcatttctgttcttcatgagcctgggaaggataaaagccaaaagaatgcttgctcctgtgctacaccttggaaaccataattagtgtcatttttattttggccgaccctaatagagactcgcctgctaatgtcaatgcatgagaagaatgagggaatgacagaaatggagaattcaaagggaaggttgcccactgtttaagaaaaagccaagagactgcttttgagtgacatttatccagcagttagtaacttatttcagtatctcccagtgagaaacatggcacagtttcactttcactctacccagctcttactgccagacatcctttagaacacgctcacaaacactagctggaactgggctggcattaatagcaagccagttatcagtgctgacaaaagtctaacaagcatcgcttgaatgtctcttactctgctacttacaaagcaaggactgcctacagttacattttaaccataatgcttacttatgctgtgaccaccttctgtgacttccttttttttaattctcattacttggaaataatgttttaagacattagataacatatttaaaattatcactaggtacctcacctttttattcaagtacgttcttgatccatgatggaatacaacctcaaaagatactactaaagaaatatgacattgcactatgcacataacacacttatttttttacagagagcttcagagttactaaagtaacttagaggtgtgccaggtcatttatactgttgtaatattactcttgctaataaataataataatgctatcagtattttctgaagtcaacctggccaacatggtgaaaccctgtatctactaaaaatacaaatattagccaagtatggtagcgcatgcctgtagtcccagctgaggcacgggagtcacaggagcctaggaggcagaggttgcagtgagccgagatcacgccactgcactccagcctgggcaacagagtgagacactgtctcaaaaaaaaaaaaggattttctgaaattagtaaagaaaattatttttatttttaaatttctcatacttgctgtcatcttatgtttatgtttgtttatttgccttagtgtggggccctagatgaggtgaagggtgggattagggagagatgaagctggcagtggaggaagaagggctccaaaaagagagacaataatgtttagatcttaaagaggaagcagtaatcttttaattttgagagatctctgtgattagcctcagtactagaaattattttggaactcagccaggcgcggtggctcacatctgtactcccagcactttgggagaccgaagtgggcagatggcttaagcccaggagttcaagaccagcctgggcaacatggcaaaaccctgtctctactaaaaatacaaaaaattagccaggcatgtgatacgcccttgtagtcccagcttacctgggggactgaggtgggatgattaccggagcctgggaggttgaggctgcagtaagccaagatcacaccactgcaccccagcctgggtgattaagggagaccccgtctcagaaaaaaaaaagggggggaaacttaaaagcatcaggctaaacactagcatgtcatcagaggggaaaaaaatattaaaactgtagtacctcaaaaataagccatatattgtactgttttctatataacattcaaaagtaaaatgaaaaatgaaatttcacattgagactctgtttttcatcttcaaaaaaatgtgtttaagtgatacaggccaagtgcagtggctgacttattatcccagcactttgggaggccaagtgggacagattgcttttgagcccaggggtttgagaccagcctgggcaacagggcgaaaccctgcctctacaaaaaataaataaataaaaataaaattagccaggcatggtggcttgttcttgtagtcccagctactcaggggacttgagcctaggaggtcaaggctgcagtaggccgtgattgtgccactgcactccagcctgggtgacagagcgagaccctgtctcaaaaataataataataggccgggcgtggtgggtcacacctgtaatcccagcacttcgagaggccaaagcatgtggacgacttgaggtcaggagttcgagaccagcctggccaacatggggaaaccctgtctctattaaaagtacaaaaaattggccgggcgcggtagctcacgcatgtaatccctacactttgggaggctgaggtgggtggatcacctgaggtcaggaattcaagaccagcctggccaacatgatgaaaccgtctctactaaaaatacaaaaaattagctggatttagtggcgcacgactgtaatcccagctactcaggaggctgaggcaggagaatcgcttgaacctaggaggtggaggttgcagtgagccaagatcgtgacactgtaccccagcctgggcaacaagagcaaaactcgatctcagaaaaaaaatacaaaaaattagctaggcgtagtgacgcacacctgtaatcccagctactcgggaggctgagacaggagaatcccttgaacccaggaggcgaaggttgtggtgagccgagccaagatcgtgccattgctttccagcctaggtgacagagcaaaacttcatctccacaaacaaacaaacaaacaaaaaaacccataatcccagcattttgggaggccaacacaggtgaattacctgaggtcaggagtttgacaccagcctggccaacatagtgaaaccctgtctctactaaaattacaaaaattagccaggtgtggtggcaggtgcctgtaatcccagctacttgggaggctgaggcaggagaatcgcttgaacccagggggcggaggttgcagtgagccgagatcacaccattgcactctagcctgggtgacaagagcgaaattccatctccaaaaaaaaaaaaagaaaacagtattttagttttaactttttatgtaaccattttcctgaaaccttatctaaaattaggatgttattaccatgcattcatttagcagaaaacttatagaacatttttactaagtgaactggccatggtttttatctatcattcctttgtatgtgactacaatgacttctagtggtaacttctatccaaagacctatcttaaattagccacgcatggtggcacatgcgtgtaatcccagctactcaggaggctgaggcaggagaatagcttgatcttgggaggcggaggttgcaagtgagccgagatcacgccgctgcaatccagcctgggcaacagaatgagactccgtctcaaaaacaaaaaacaaaaagacctatcttgagctttccgtgtaagaaaaagatgatactgttgggtgaagtgactcaacgtctgtaatttcagcaatttgggaggctgtagcggccggattgcttgagcccaggagtttgagaccagcttgggcaacatgggaacacactgtctctacaaaaacaaaaattaaccgggcgtggtcgcttgcacctatagtgccagctactcgggaggctgaggtggaggctgcagtgagctgtgaacacaccactgcactccagcctgggtgacagagtgagaccctgtctcaaaaaaaaaagcaagaagcgcagtggctcacgcctgtaatcccagcactttgggaggccgaggcgggcggatcacgaggtcaggagatcgagaccatcctggctaacacggtgaaaccccgtctctactaaaaatacaaaaaatgagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaacaagaaagaaaaaaagaagatactgaaaaatagatgtccctagtcaaaataatgagattagcttttgactaaactcaggatattaaaagggaatacttcagtgcatgatgatctcatttttgaaaggaaagaagcagagcttccccatctctaaaaccttaattcaaaggagaaatagataatttcaagaggtatttttatgaggtaatagtaaaatatattttattaacagtacctatagttatgtaaaataggtagtgccaattaactgacactaaactagcttcttggcctggcgcagtggctcacgcctgtaatccaaacactttgggaggccgatgcgggtgtatcgcttgggctcaggaattcaaggccagcctgggcaacatattaaaaccccctttctataaaatatacaaaaattagccaggcatggtgtgtgcctgtagtcccagatactcaggaggctgaggcacgagaatcatgtgaacccaggaggtggagtttgcagtgagccgagatcacgccactgcactccagcctgggcaacagagcaaaactctgtctcaaataattaataaataaactagcttccttttcaaaaaaagaaataaattaggtcctaagtcctaaaagcccatcctactttaaaattgtttattcaagttcagatgaaaagagtggactagtaggcaactgaagtgctttagagtctcccgtgcctgccctaattctagaaggttgtgcactttatgatccagatttctgagtggttgagaatgagttattgagcagtgcaaggcaagctctgcagtaggtaatggattgatgaggctggatttagcaagtctgatcaatctaaaggaagtttctgaatgtgttttttgtagttaaaatactcataattaaaacacttatcacattgtcacattttatttttaaattgcaggtaaacaagtgagaaccaaactttcacaggcatttaatcattggctgaaagttccagaggacaagctacaggtattaggcaactctaacctcattaatccccaagaaattaatagctgtcgcataaaaatattcctagttcttgattgaatttagtcctcatgcaagatattattttatattgaggttgctaaatatttattagttgtgaaaattaacacacctgagactttcataatctgttaattaaactgagtaagttttgaatagttcaaataagtgaaattttcaatttttttattagattattattgaagtgacagaaatgttgcataatgccagtttactcatcgatgatattgaagacaactcaaaactccgacgtggctttccagtggcccacagcatctatggaatcccatctgtcatcaattctgccaattacgtgtatttccttggcttggagaaagtcttaacccttgatcacccagatgcagtgaagctttttacccgccagcttttggaactccatcagggacaaggcctagatatttactggagggataattacacttgtcccactgaagaagaatataaagctatggtgctgcagaaaacaggtggactgtttggattagcagtaggtctcatgcagttgttctctgattacaaagaagatttaaaaccgctacttaatacacttgggctctttttccaaattagggatgattatgctaatctacactccaaagaatatagtgaaaacaaaagtttttgtgaagatctgacagagggaaagttctcatttcctactattcatgctatttggtcaaggcctgaaagcacccaggtgcagaatatcttgcgccagagaacagaaaacatagatataaaaaaatactgtgtacattatcttgaggatgtaggttcttttgaatacactcgtaatacccttaaagagcttgaagctaaagcctataaacagattgatgcacgtggtgggaaccctgagctagtagccttagtaaaacacttaagtaagatgttcaaagaagaaaatgaataatgttaagccattcttgattggacctcatagcttattttagttaatcttttttttgtcttttagccttaccaccttttaaaaaatttgttattctccagaaacagtaaataggtgagtaggggtggtgcaagtgaattcgttttcatttagaagcccctctgtacagataatcaaaattcaaagttgaaagaatcaaaagcagccacagttatgtaggtctgatttgaatgtcataattgcagtgacaggacattgccaccaactctatcctactaccatcaatgttgtgtttattccgtcaataaaaaagacttgcttccaggaatttttatccatacactttctaactgtactatctgggcagttccaagccagtttctattagctagctggaccaaagaccacaaatctctttttttcctaaacgctgctgtaaggaatatctcacttttccccccggaaacaccctcactgaagtcttctatgaaaaggctgataatgggctgggcgcggtggctcacgcctgtaatcccagcactttgggaggccgaggcgggcagatcacgaggtcaggagatcgagaccatcctgacacggtgaaaccctgtctctactaaaaatacaaaaaattagctgggcgtggtggtgggcgcctgtagtcccagctactcgggaggctgaggcaggagaatggtgtgaacccaggaggcggagcttgcagtgagccgagatagtgcctctgcactccagcctgggtgacagagcgagactccgtctcaaaaaaaagggctgataatgataaacagtgagcactccggtcctttttcttaggttttccttttttccttcctctccaccccacaagttttgctttttaaccaaggtgtctctgcttgatgaaattcacatgctagtctaaatctttttttctcccttgtaacatttatgtgccccaaactggttagtatatgggtacagcattccctttccaattgggaagcggaaaaagagagtatgggatattttagaagggagcctttgaaccttattatatttccccatcattgatagtgacaatcttaaaagggttgttttcttaccttaagtacaaaagcatggaaaaatgcgcttttccttcccgcccacatcaccaccccgacttgaagacagtaggtgcttgaatggaaagtgagtaggcatctttaatcgccctgattaaaggaaagtgttagcctgagagggcctgactgaaaagtaaccaaaggcttaatatcaaacactaattagctttttagtgccttaaccctgacctggttaccagttttctgtagtttctacacccaagccactgaagtcatctgtggcccaagaggtaggacaaaaaaaaaaaaaaaaaaagctgatttcaatatttgatttgttgacatcccaaaatgaaagttttatgtttcccttagaaacatgttttgcttggttctatagtatgttacttaggatctatttaccatatatttgtatgagaaatcctcacccaagcattcaacctaaatctttgaaaagttgggtgctgtctttagtaacttttaaaatagtttaaatctcccattttaatagtgataaggaaacctgttaaaatcatggctattgatgttatagtatggaaagttgaactttatgaacccatacttttaaaaagcatttttaaaaatctaacactgactatagaaacaaattaaaatgtctacctttaagtataaaaattgcttaagtagatttgttccttgcctatcaaattaattttggcctggtgttcttcattattcatttgttaattttatcttgcctttgtcaataacagaaatgtttgtcattgaattgggaatttttttttttttttttgagacggagtttcactcttgttgcccaggctggagtgcaatggcgtgatctcagctcactgcaacctccacctcccgggttcaagcgattctcctgcctcagcctcctaagtagctgggattacagatgcctgccatgttgcctggctaattttttttttttttttttttttaagtagagatggggtttcaccatgttggccaggctggtgttgaacttctgacctcaggtgatccagctgcctcggcctcccaaagtactgggattacaggcatgagccaccgcacccagccaaattggggacttttaacagtcattttacctgtagaataatcaaaactcttcacttgatctgtagtcatagctattaacacagaaaaatgaatgccagttatgttgccataaaccaccttctgaacttggcaagatcttaaaaccatcaactgttctctgttcactctgtgaacttctttctactttacttccttctctacctcacctgtactctatagtcactcacttcaatgacacttaaagagcattcactctcagatcacttttctcctttccttgcccattcttatcttgccaactcccagtcctggataaatccaaacatccacgttctttgtgcatccgtgttgctcagtgctgctggggaacattttcacaactgctgttggaaccattgtgagtttacacattccagcctctgcaacgcctttattttccatctaatctttcctagcagagatttctatttgttttgttttggtttgagacagagtctcgctctgtctggcaggctggggtgcagtggcacgatctcagctcactgcaacctccgcctcctgggctcaggcaattctcctgcgtcagcctcccgagtagctcagattacaggcatgtgccaccacgctcagctaatttttgtatttttagtagagacggggtttcaccatgttggccaggctagtctcaaactcctgacctcaggtaatcctcccgcctctgcctcccaaaatgctgggattacaggcgtgagccaccacgcccggtgtcagagatgtcttattaaagatccccttcttctcttcttcctctcttctcccactaaatagaaactctcctaactttccttccctctactttaggtctgtctttacatagtctgctattttcaagaagagtttgacctgccctaggttctcatgtgcttgaatttccccctgtctattgagggccttgtcccattccatcttcccttctagatatctctcatctagataatctcaagatctatccattgattcttttttaatcagtgtactgagaggaagaaagagggcaaggaaatacatacttatgaagtatcttaccgggtactagatactttacatgttttcctcaagcatttactgaggaatgccagggccttgaatacagatcaaagtacctggctctgctgggcgcagaggctcatgcctgtaatcccagcactttgggaggccaaggtgggtggatcacttgaagtcaggagttcaagactggcctgaccaacatggtgaaatcccatcactgctaagaaaatacaacattagccgggcgtggtggcacacgcctgtaatcctagctacttggggggctgaggcaggagatttgcttgaacccgggaggcataggttgcaatgagccaagatcgcaccactgcactccagcctggacaacaagagcaaaactccatctcaaaaaaaaagaaaaaagtacctgactccttctgtacgtgctgcctttaattctctatgcacacttgaatgtgtttaaaaatttgaaaagcactggttaggccgggcgcggtggctcacacctgtaatcccagcactttgggaggtcgaggcaggtggatcacgaggtcagcagatcgagacatcctggctaacacggtgaaaccccatctctactaaaactacaaaaaattagctgggtgtggtggcgggtgcctgtagtcccagctactcgggaggctaaggcagaagaatggcatgaacccgggagtcgacatctcgttactgcactccagtctgggtgacagagggagactcccatctccaaaaaaaaaaaaagaaaagcactgatttattctaataatagcttcctttctataatctctccctactattccatctgtatcacaattatgtcgtagtggctgatattcactatttgaaatacagtcccagcactttgggaggccgaggtcaggggttcaaggaccagcctggccagcatggtgaaaccgcgtctctactaaaaatagacaaattagccaggcgtggtggcacacgcctgtaatcccacttactcgcgaggctaaggcaggagaaccgcttgaacccaggaggtggaggttgcagtgagctgagatcacgccactgcactccagcctgggaacacagtgagactccatctcaaaaaaaaacaaaaaactacaggaaaaggctcatgataatggaacctacaataatgtgaatttaaatataatgcagttggcatttggctccccatacccacatttggttaactgaagactcactgtagtcatttcattaatcttataatatttatcttactgaatatttggaccttacagtattactagactttgtactggttggtaaagaataagtgtaataagcaataatattagtaatataaatttcagtgtatatagttcaagttaattgttagaatgcttaatgaccattgattaatgagagagatctgggtaacatctgccttgtcatacatattctttacaaagtatgctttaggagaatgaccatttattattgaattatatttatcactgtacataaagaaagaaatatacactcagagatctcagagttgctataataagtaatggaagatatttggacctcagtgggtgaggtagtactaacggtaagctgtaaaagtagtttgtaaatctcaccaaaacttgtaagtcacttaagaaaaactaaaatgagaatagttaaacatttgtagactaagaacattttcaagagatttagtatttttgttttatttttgagatggagtcttgctctgtcgcccaggctggagtgcagtggtgtgatctcggctcactgcaacctccacctcctgggtgcaagctattctcctacctcaacctcctgagtaactggaattacaggtgctcaccgccatgcccagctaattttttgtatttttagtagagacagtttcaccatgttggccgggttggtcttgaactcctgacctcaagtgatccacccacctcggcctccccaagtgctgggattaaaggcatgagccactgggcctggccaggagatttagttttaaatgatattctaacagatatcaatactttatgagaaagaaatggtttatgtattaaagctgacagatttagtcagttagccatactaagttaaagaaattgaaaatgaagcagattattgaacaaaaattgtcatttgaaacaaaacaaagtagcaatttaaacagactaataattttttttttttttttttgagacagtctctgtcacccaggctggagtgcagtcgcatgatctcggctgactgcaacctccacctcctgggttcaagcgattctcatgcctcagcctcccaagtagctggagactacaggcatgtgccaacatgcccgactaatttttttgtatttttagtagagacaggatttcaccatgtgggccaggctggtctgcaactcccgaccacaggtgatttgcccacctcggcctcccaaagtgctgggattacaggcgtgagccactgtgcccagcctcttaatagattttctaataagtttttatgaaaatgcatttatggtttgataacaaaagtgaaagtataataattttttaagtttaaccctgaaacttagttattgtttattgaaccctgaaacttagttaaggtttgaaaaactccgtgaattgaaattgaaccagccgggcatggtggctcatgcctgtaatcccagcactttgggaggccgaggcgggcggatctggaggtcaggagttcgagaccagcctaaccaacatggtgaaaccccatctctactaaaaatacaaaaattagccgggcatagtggtgcgtgcctgtagtcccagctactcaggaggctgaggcagaagaatcgcgtgaacccaggaggcagaggtggcactgagccaagattgcaccactgcactctagctgggcaagagagcaagactccgtctcaaaaaaaaaagagtgactcaaaataaaatgtagcatataagccgggcacagtggctcatgcctgtaatcccaggactttgggaggccgaggcaggtggatcagttgaggtggggagttcaagaccagcctggcttgccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaccagcctggccaacatggtgaaaccccgtctctactaaaaatacaaaaattagccaggcatggtggttcacacctgtaatcccagctacttgggaggctgagacacaagaatcgcttgaacctgggaggcggaggttgcagtgagccaagatcatgccactgcactccaggctgggtgacagagcgagactccgtctcaaaaaaaaaaaaaaaaaagcaaacaaatggccagacgcagtgtctcacacctgtaatcccagcactttgggaggccgaggcaggtggatcacctgaggtcaggaattcgagaccagcctgactaacatggagaaaccccacctctactaaaaatacaaaattagccgggcgtggtggtgcctgccctgtaatcccagctactcggaggctgaggcaggagaatcgctcaaacccgggaggcagaggttggggtaagctgagatcttgccattgcactccagcctgggcaacaagagcgaaactctgtctcaaaaaaaatagtaaaaattaggccgggtgcggtggctcacgcttgtaaccccagcactttgggaggccgaggcgggcggatcatgaggtcaggagatcgggaccatcctgtctaacacggtgaaaccccgtctctactaaaaatacaaaaaattagctgggcgtggtggtgggcgcttgtagtcccagctacttgggaggctgaggcaggagaatggcgtgaactcgggaggcaaagcgtgcagtgagccaagatggcgccactgcactccagcgtgggcgacaaagcaagactccgcttcaaaaaaaaaaaaaaaaaagtaaattaaaataaattaaataaattaaaataattaaaataaattaaaataaattaaaataaaattgtagcattgtataaatgagttagcactaaagataaaatatatacaatttaagacagtattataacgattaagaaaaaatctgagtataaattctgatagttcagaggaaggcaagagaggatccagcaccgtgagaatgtcattaatattgggagaaattctcaatttattgagactgaaagtcacctatgagtatcaatttaatgaggaagttggaagaatttgatgcagtttcctgtgtcacatcatggctccaataggaatatattatttagctagtgactgctgcaacaaaccaaagatcacaccagtaattcccagctggcttggaatgtcatagcatatatggacaattaatgtttcctgacttactggatctgttctttcagcccatcttgcacacaactgccagattaatattactgctttttatgttgaatacctctgttcaaaaatcctttgtaggacaaacaccttagcttcactgtcaaagctctctataatctgcttcccgtcttatctcccatcattccttaatagggtttacttcacctaaccctatctattcattcttaactaaagatatccagccaggtgcagtggctcaagcctgtaatcccagcattttgggaggccgaggcagaaagatcgctggaggccaggaattcaagaccaacctaggcaaaatgaagaaacctcatctccacaaaaaatagacataaaaaaattagccagttgctcctgcatgtgtctgtcaggtgaatcccttgaagtcaggagttcaagaccaccatggccaacatggcaaaaccccatctctactaaatatgcaataattagccgagtgtggtggcacatgcctgtagtcccagctactcaggagactgaggcaggagaatcccttgaacccaggaggtggaggttgcagtgagccaagatggcgccactgcactccagcctgggcaacggagcgagactctgtctcaaaaaaaaaaaaaaaaaaaagatatcctacaagttctcacattcatgcctgtattcataatatgtctgacatgtttccctagccactcattaaatttgctgtatctctaacttaaagttgtaatttcttgctgaagacctctccaaatcaaaatgtctataataaataacaatgtaactaaaagaaacaaaccaatccccttcacccagatagaaaacgagtaagagaatggccttagctaagtatttcgtagagaccttacaaagcaaaacttaaatatggcctttggttaactaatggcctttcaaaggctatgactgacttaatacaaggtctttttgttatgccttacagaccaattgcactctgctggtgagacgctgacttcatagtaaggcagctggaaaacatctctttaacatggattcatggcaggatttttccaattcaaataatgtaccatgtcctttaaaagaaaaacaatactcttggacctctactgttgacctagttttttttgttttactaaatatatacttaatatataaaaggtatacttaatgcataaaaaggcatgaactctgtaggtgctattaatacccttgtttattggctattctcccatcctaattcttcctaatcacagtttaatttccttttggtgaattacctctccccagttgggcacagccaaagtaacccatacagaagccaaggggtatcaggacattgttatatctttcctctcagtgacctgtacagtcaaaggttggatacatgacctaatcttggccagttggactgtctccaaggagattcttgagtggagaaaacgcttcacttatctggcagcatatgttggccaaatggtacctgttgctgtggttctttgtctcagttctttgtcttgaacctgaacccggttctcctgccctcctattgtactctgaactatctaaaatcctactaataagttagtcaggctgggcgcagaggctcaagcctataatcccagcactttgggaggctgaggcaggcagatcacctgaggtcgggagttcaagaccagtctgaccaacatggagaaaccctgtctctactaaaaatacaaaattagccagatatggtggcgcatgcctataatcccagctactcgggaggctagggcaggagaatcacttgaacctgggagggggaggttgcagtgagctgagatcatgccactgcactccagcctgggcgacaagagcaaaactctgtctcaaataaataaataaataaataaataataagttagccagatctcccagctacatgaagacaaaaagaaagcaaaagattctataagagattatatagtaagttactatttgtgaaaaaaaaaaataaggccagaagcggtggctcacgcctgtaatcccagcactttgggaggccaaggtgggcaaatcaccaggtcaggagtttgagaccagcctggccaacgtggtgaaaccccatctctactaaaaatacaaaaaaatagccgggcatggtggcgcgcgcctgtagtcccagctacttgggaggctgaggcagcagaattgcttgaacccgggaggcagaggttgcagtgagccaagattgcaccactgcactccagcctgagaaacagaccaagacactgtctcaaaaaaaacaaaacaaacaaacaaaaaaaacaaaagaaagaaagaaagaaggaaggaaggaaggaaggaaaaagccgggcatggtggcttacgcctgtaatcccagcaatttgggaggccaaggcgggcagatcacgaggtcaggagttcgagaccagcctgaccaatatggtgaaaccatgtctctactaaaaatacaaaaattagccaggcgtgatggctaacacctgtaatcccagctactcaggaggctgagggaggagaattgcttgaacccaggaggcagaggttgcagtgagctgagaatgtgccactgcactccagcctgggagacagagtaagattccgtctcaaaaaaaaaagaaaaatatttgcacaaaatatctaggggtaggacctgggagacagaggactaggaggtgggaggagcaagagagacttctcactgtatacctatttattacttttcattttttggaagcatgtgaacatgtcatctattcaaatattgaaatttaaaaaataaaggcaccagtaaatgagaaaaccaacaataaatgctaagcagataatttcaagagtggctacttacattgggtatccggggaagacctctgagggagtagcatttaagctgagctctgaatgataagaaattagctataccacaatcctagtaaagaacatttgaaaccaaaggaatagccaacaaaggtcataaggtgggaaagaatggtgccaatatgtacaaagcaacataggtattagattgtgtaggaatttgtaaatcatagaaaggactttaggttgggttttttttttttttttttttttttttttttttttttgagatgaagtctcgctcttgtcccccaggctggagtgcagtggcgcgatctcggctcactgcgacctctgcctcccgggttcaagcgattctcctgcctcagcctcccgagtagctgggattacaggcacctgccaccacacccggctactttttatatttttagtagagacgggttttcactatattggctaggctggtctcaaactcctgaccccaggtgatccacctccctcggcctcccgaagcgctgggattacaggcatgagccactgcgcccagccagactttaggttttaaaactaactgcaacttgaagccgatggatggttttaagaaaatgagtaaggccaggtgccgtggctcacgcctgtaatcccagcactttgggaggccaaggtgggtggaccacctgaggtcatgagtttgacacctgaggtcatgagttcgagaccagcatgaccaacatagtgaaacctcatccctactaaaaatacaaaattagctggccgtggtagcacatgcctgtaatcccagaaacttgggaggctgaggcaggagaatcacttgaacccaggaggcagaggttgcagtgagggaagattgtgccattgcactccagcctgggcaataagagtgaaactccatctcaaaaaagaaaaaaaaaaagaagaaggggagtaaaggccaggcgcagtggctcacacctgtaattccagcactttgggaggctgaggcaggcggatcatgaggtcaggagttcgagaccagcctggctaacatggtgaaaccctgtctctactaaaaatacaaaaaattatccaggtgtggtggtgtgcgcctgtaatcccagctactcgggaggctgaggcaggagaattgcttgaacccaggaggcggaagttgcagtgagctaagattgcgccattgtactccagcctgggtgacagagcaagactctgtcaaaaaaaaaaaaaaaaaaagaaagaaagaaagaaaagaagagagaaaagaaaagaaaaaagaaggggagtaactagatctgaattacctttataaaagatcatcctggcatctgagtggatgatggactacagagagtcagaagaggaggtaaggaaaccaattaggagggtgtttgagtgtccagtgagagatggtggtagcagagaacatggtatgaagtagttgaattggggattatttagaaagtggagtttatatgaattactggtggataggatgtagagttaatggaaagaggagtcaaggatggtctttagattttttataagaaactgagtagatggtgataaatcataaatcagacttaggaagacagggaaagggtaggtattagggggaaattagagctgcctatcaagcatccaggaggaaatgtcactgcatgcacaggctagattcaggggagattcaagcaaggctgaagttagatttgtggatcattggtgatcacttaagcccaggattggataggttacctagagatattgtgtaagaaagaaaagaaggggcctcagcactgatcctggcatgccacgtataggagtatttttttcttttcttttttgagatggagtttcgctcttgttgcccaggctggattgcaatggcacgatctcagctcaccacaaccaccgcctcccgggttcaagcaattctcctgcctcagactcctgagtagctgggattacaggcatgtgccaccatgcccggctaattttttgtatttttagtagagacagggtttctccatgttatcaggctggtctcgaactcctgacctcaggtgatccaccggcctcagcctccgaaagtgctgggaatacaggcgtgagaccctgcgcccaggttttctttttttttttgaaacagctttgccaaggcaagatggctcccatgctggtaattccagcactttgggatgccaaagagggaaggatagcttgagcccaggagttcaagaccagaccgggcaacatagtgagaccttgtctctaaataaataaataaaagccaggcataatgatgcacacctgtggtcccagctacttgaaggccaaagcgggaagattgcttgaggtcaggagatggagaccaccctgggcaatatagtgagaccttgtctctacaaaaaaaatttaaaaattagccaagcgtgatggcaagtgcctatagtcccagctactcgggaggctgaggtggaaagattgcttgagcccaggaggttgacgttgcagtgagccaaaattacaacactgcattccagcctgggcaacagggcaagacactggctccagaaaaaaaaaaaaaaaaaaaaaaggttggatctgctggctcacacttgtaatcccagcattttgggaggccgaggcgggtagatcacctgaggtcaggagtttgagaccaaaaaataataataatgataaataaataaataaataaaagaaaaaaacagacaaacaaagagttcaagactagcctggccaacatggtgacatggtaaaaccctgtctctactaaaaatacaaaagttagccaggggctgggcacagtagctcatgcctgtaattctagcactttgagaggctgaggtgggtgaaccacttgaggtcaggagtttgagaccagcctggccaacatggtgaaaccccacctctactaaaaatacaaaaattagtcaggtgtggtggtgcatgcctgtagtcccagctatttgggaggctgaggcaggggaattacttgaacccaggaggtggaggttacagtgagccaagatcgagccactgcaccccagcctgggctacggagcgagactccatctcaaaaaaaaaaaaaaaaagttagccaagcgtggtggcacacacctgtaatcccagctattcaggaggctgaggcacaagaatggcttgaacccaggaggtgaaggttgcagtgagccaagatcgtaccactgcactcctgcccgggcaacagagcgagactgtctcaaaaataaataattaaataaataaacctgccaatagcttctatgacccaaagatgagatgcccctggccacctctaaaatctcctacaagctgatgtaactatgagaattaaagaggacccaaaactgactgagatcaaattttctgctagtcttgcaagatggaggtagaggaagaatatacattctcttcaggatgctggactgagcgtgtgttatttttttctcccttttcagagaacactaaaaggaaagtaaaagaataaaaaggttaatacagcaaaatataattgagaatgggaagggctaattatgatccatgttagtgagtaagaaatttcaggaaatttcttggccaggcatggtggcttatgcttgtaaaaccagcactttgagaggcttaggcaggcagatcacttgaggtcaggagtttgaaaccagcctggccaacatggcaaaacctctactaaaaatgcaagaagtagccaggcgtggcggtgcacacctgtaatcccagctactagggaggctgaggcgggagaatcgctggaacctgggaagccgaggttgcagtgagccaaaattgtgccactgcactcttgcctgtgcgacagagcaagactctgtctcacaaaaagaaaaaaagaagaagaagaagagagactaaaatgcagagactgcaagactgcccttcaaaatggaagagagaggcagaattgagttctctgcttcagagtcacaggctgcaatccaggtgtcagccaggtctgggttctcctcagaggctctagcagggaaggatccaatttcaggctccctcggcttggtagaattcatttgctttcagctgtaggattcacagtagattgcttcctcgaagccaggaagaaagacagagacccacacagagagacaggcaggctctagtgtcaggcagctaacaagacagtcttataaaaatgtaatcataggaatgacatcccattatttttatcattgtctattggttaaaagcaagtcacagaccctgcccacactcaaggaaaggggattagggaattatacggggctgaatacccggaggcaggggtcacagggccaccttaaagtctgtctcaagtgggtattgttttgttttgtttcattttggcattggtaaggaagagggtatcaaaaggtaggggcagctgcctgtacattggatgaaaatatgctgaaattgatgggggcgagtccagtctaaccccaccccaactctgacttcagtcatgccaaagaaagagatatggagattggagctatttcctcaccattttataacttaactgcctgcagagtactctgtagatctaatgtacagtacaaaaagatgaaacaatagaatgcggaaggctgggtgagatggctcacgcctgcaatcccagccctttgggaggaccaggctagcgatcactttgagctcaggagttcgagaccagactgggcaacatggtgaaatcccgtctctaccaaaaaaaaaaaaattaggcatggtggaacatgcccgtagtcccagctactagggaggctgaagctggagaatggcttgaacctgggaggcagaggttgcagtgaactaagatcatgccacttcactacagcctgggcaatggagtgagaccctgtctcaaaaaaaaaaaaaaaaggccgggtgtggtggctcacgcctgtaatcccaccactttgggaggctgaggcaggtagatcacctgtcaggagttcaaaaccagcctggccaacacggcgaaatcccatctctactaaaaatacaaaaattagctgggtgtgctggtgcgtgcctgtaatcccagctacacgggaagctgaggagtagaattgcttgaacccgggaggtggaggttgcagtgagccgagatcatgccacttcactccagcctgggtgacaaagtgagactccatctgaaaaaaaaaaaaaaatcagaagaggtttcggttgtattggattggactcttgtatttatgatcaaggaagttacagcaaatgggtaagagttcagaaaattttggggggagctgagataaggtggaggaagccacagcttccagacgttagatgcaaaaatgaagggtgatagggtttggatattttttcccccaaaatctcatgttgaaatgtaatctccagtgttgaaggtagagcctagtgtgggaggtgattctatcataggggtgattctatcatattaaactcattaatagtttgacaccatcctcttggtgataagttagttctccctcagttagttcatgggagatccagttatttaaaagtatgtggcacctccccactagctttctcttgctctggcttttgccatgtgacacacctgctcccccttcgccttccaccacgattgtaagcttgctgaggccctcaccagaaggatatgccagcaccacacttcttgtactgtccagaaccgtgaacaaattaaatctcttttctttagaaattacccagcctcaagtatttatttgtttatttgtgttttttatttttttgagatgaagtcttgctcaatcacctaggctggagtgcagtggcatgatctcggctcactgcaacctccgcctccctggttcaagccattctcctgcctcagcctctcaagtagctgggactacagatgtgcgccaccatgcccggctaatttttgtgtttttagtagagacggggtttcgccatgttagccaggctggtgtcgaactcctgacgtcaggtgatcagcctgcctcggcctctcaaagtgctgggatgacaggcgtgagccaccatgcctggccaagtatttctttatagcaacacaagaacagcctaacacggaggggatgggtcctggaccattatttagagtcatcccattcacccctttcagtttcacaacccatccaaagtaacctctcagtgttttgcatttttttttttttttttttgagacagagtctcgctgtgacgcccaggctggagtacaatggtgcagtcttggctcactgcaacctccacctcctgggttcaagggattctcctgccccagcctcccgagtagctgggactacaggtgagagccaccatgcccagctgatttttgtatttttagtagagatggggtttcaccatattggccaggctggtctcgaactcctgacctcaagtgatcggcctgcctgggcctcccaaagtgctggaattacaggtgtgagccaccacgcctggctatttgttttttttttatacttagcataattattttgagattcatacatgttgttgcatagatcctccattcactcccttttattgtggaggagaattccatttatgaatatatcacaatttattcattcatcttttgatagccatttgaattgtttcctgtttggggtttatcaaaagtaaaattactggccgggtacggtggctcatgcctgtaatcctaacactttgggaggccgaagcgggaggatcgcttgagcccagaagttcaagaccagccttgacccctcctggggtccctcaccctcactcacagctctactctggtgaggtggctggtgggggagttgtatctggacccccagtgggtcccaaggggttaggggctgcctcatccactggggcccctggtaggaataagcagcaccccgcatgcactacccccatttcagtatcaagctcgggttggtggtgctccccctacaaagatgtctaacactccaatgggtgatgggaacctatcctctgcttcaccaccaaccaccttcccccatgtggcaccaaacctgcctcccccatctgcccaagccccctcaacaatgcatcagcagctgggcatggtggctcatgactgtagtcccagcagtttgggaggacaacacaggaggatcacttgaggtcagcagttcgagaccagcctggccaacatggtgaaaccccgtctctactaaaaatataaaaatagtcgggcgtggtggtgcgcattcgtagccccagctactcgggaggctgaggcaggagaatcgcttgaactcaggaggcagaggctgcagtgagccaagatagtgccaccgcactccagcctgagatacaaatctagaatctgtctcacagaaagcaaaacaaacaaaaaaccccagcacattagcttctcctccaggcccggggcccctgccctgtggcacagggagagagcatctgtcctctccctgtgccacggggcagggaatgggagggtttcctcctggcccagagaacgacttgactctagctcccacagcccaccctctgccccggctccctgcttcctcttcttccgccccactgaggtttctttactcatgctctagtagcagctctgcggcagcctcctcttccagttcttcctcctcctcctctgcctcccagtaccctgcttcccaggcattgcccaggtatccccactccttccctcttgcaacaagcctctctgtccccaatcaggcccccaagtatactcaatcttctcttccagcccaggctgtgtagagccagggtcccccacaacctcctgtggcggcctcttaggcttcctccttctcctggaggccaatccactgcccacatcacccccaacacatcaccatcaccaccagcagcaacactgtggaagctccaggccccctccacctggagcatttccccaccacctggagagctgtagccacatagccccataccatgcacactcttttttttttttttttttttgagacggagtttcacttttgtcacccaggttggagtgcagtagtggcactatcttggctcactgcaacctctgcctcctaggttcaagtgattcttctgcctcagcctcccaagttcctgggattacaggcgctcaccaccataagtggctaatttttgtatttttagtaaagacagggtttcaccatgttggccaggctggtcatgaactcctgacctcaggtgatccacctgcctcggcctaccaaagtgctgggattacaggcgtgagccacagcgcccggccaatgcacactcttatgccatgtgttcctccctggggtctctttggctctatccatcagggccagcatacctggccccatctcacagccagatgtcctacagccaagcaggccccaattgccccctacctcccacggtctcttcttctctttttttcctcctctcaagggtcctacccactttcacacacctcccagggcccctacctcttcctgctggtgcctacggtcaccacctccttggctgccctttccactgccattgctattgtggcttcctcaccagcagactacaaaacagcctactcgcctgggcccacgccatagggagagaaagctgcatccccagggactagaagacaggccacacagatacaagccagggtgcctctctccatctgaaggggaccccatcgggtcaaaccagtcttgcccactgtgggacctgtcacttgtgagccctcaggtgtcatctctgccaccaccacctgtggcccctgcctcagggttacccctaagcaccagacagatcaaacaggagcttgctgaggagtatgagaccactaagagtccagtgcccccagcctacagcctccaactcctcctaaggtggtggtagtcctttccagccatgccagtcagtcagccaggtgagtgggtacgggagggtgagcctggaagggggttatgaaggggcgacagagagtggcacaagaggggctttctgtttatgtggtggtttttgttgttgttgttgtttttttgagatggtttcgctcttgttgcccaggctggagtgcaatggcgcgatcttggcccactgcaatctccgcctcctgggttcaagcgattctgctgcctcagcctcccaagtagctaggattacaggcatgtgccaccacacctggctaactttgtatttttagtagagacagggtttctccatgttgatcaggctggtcttgaactcctgacctcaggtgatccacccacctcagcctccaaagtgctgggattacaggcgtgagccaccatgcccagcctatgtggtgttttttatcttattttttattgagacaaggtcttgctctgtcacccaggctggaaggctggagagcagtagtgtgatcatggctcactgcaaccgtgaactcctgggctcaagcgatcctcccacctcagcctacatgcctggagctgggatgacaggcacaggtaggagcaactggctaatttttttatttatattttttgtatattttttttgtagagaatatatatatttatatatatttatatatatttttgtagagaatatatataaatatatatttttataatataaaatataaaaatataaaaaatatatattttttttctagagaaggggtctctatgttgcccaggctggtctccaactcctgggctcaagtgaacctcccgaagtgtggagattacaggcatgagccaccgtgcctggccttttggtgaaattttgagtcaaaaaaattttttttgagacaaggtctggctctgttgccccagctggattgcagtggtgcgatctcggctcactgcagcctctgcctcctgggttcaagcaatcctcccacctcagcctcctgagtagctgggattacaggtccatgccaccacacccagctaatttttgtatttttagtagagatgggtttcactacgttggccaggctggtctcaacctcctggctcaagtgatccacccgccttggcctcacaaagtgctgggattacatcatgagccactattcctggccttcactcaaatctttttgtccatttttctattggggttttctttttcttattgttcagttttgagggttcttaaatatattctggattgaatgggctcatggatatttatgaaatcatgccccccaagagttaaagataccagtgactgttaccaagcaaaaggagctcactgcccggtggtacagaagtcaaatgctatggcactaggtttttgagaagaaaaaaaaaaaagctttattgtgagtcagccaacaaagagacaggaggccagctcaaattggcctccctgtgcaattcttaagtcagtgctttttaaactttttattgtattttattttttagagacagagtcttgcttttttgctcaggctggagtgcagtggcttgatctcagctcaggtcactgcaacacctgcctcccaggttcaagcaattctcctgcctcagcctccccagtagctgggactaaatgtgcatgccacgatgcccggctcttttttgtatttttttttagtacagatggagtttcaccatgctggccaggctggtcttgaactcctgacctcaagtgatccacccacccctgcctcccaaagtgctgggagtaaaggcatgagccacaacgcatagcctgcaaatgggttttgttttatttatttatttatttatttatttatttatttatttatttatgagacggagtctcgctctgttgcctaggctgcagtgcagtggtgtaatctcagctcactgcaacctccgcctcccaggtaccagcaattctcctgcctcagcctcccaagtagctcggattacaagggcatgccaccacactcggctaagttttgtatttttagtaaagacgggatttaaccatgttggtcaggctggtctcaaactcctgacctcatgatctgcccacctcggccttccaaagtgctgggattacaggcgtgagccactgtacccagcctctacaagtgggtttttaaaggaaaaaagaagaggtagttcctaagttgtttaccaataataatttacattaaaataaaataagttattgattggctacacattgttttattttattttattttttgagatagagtctcactctgtagcccaggctggagtgtagtggtgatatctggtctcactgcaacctccacctcctaggttcaagcaattctcccggctcaccctcccaagtagttgggactacaggcacgcaccaccatgcctggctaatttttgtatttttagtagagacgaggtttcaccatattggccaagctggtcttgaactcctgacctggtgatccgcccgcctcggcctcccaaagtgttgggattacaggcatcagccaccgcgcctggcctattttttcttttctcaccaactaatggaaaagtgagggctttatttatgtattcattttcagatggagtcttgctccgtcccccaggctggagtgaagcagcacgatctcggcttactgtagcctctgcctcctaggttcaagcaatttctgccttagcctcttgagtagctggttttacaggcatgtgccaccacaccccacccagctaattttttttttttgagacgtagtctagttgtgtcaccaggctggagtgcatggcgcgatctcggctcactgcaacctccgcctcccaggttcaaatgattctcctgccttagcctcccaagtagctgtgattacaggcacacagcaccatgcccagctaatttttgtatttttagtagagacagggcttcaccctgttggccaggatggtctcaatttcttgaccttgtgatccacccgcctcagcttcccaaagtactcggattacaggcatgagccaccacgcctggcctttttttcttttttgaaacagggtctcactctattgcccaggttggagtgcagtgttgagatctcagctcactgcaacctctgtctcccctgctcaagagattctcccaactcaacgtcctgagtagctgggactacaggcacctaccaccacgcctggctaatttttgtgtttttttagagacagggtttcgccacattgcccaggctagttttgaactcttgagctcaagtgatctgcttgcctcggcctcccaaaatgctgggattataggtgtgagccaccgtgccctgctgaggagagtcttagtttgggatccatggattcctttgaggcctattcatgggcttcaaaggattaatcagtccttgaaatcatacgcaaaatttgtgtgtaggtagatagcttttatcagatttccaatgtggtttttaatcccctcttccaaagaaaaaacaatcactgtaatatctagtttctagtttcaaggagtgaactatcaaagtataaaacagtagagacatccagcaggatactgactgtttgtgtccatttaatatgacaattagaaggtcacttcttggaagagtcatttggctttgctccctcaatttcctttccacttcacctcacttcagtctggttttggaatgctaacactcactctacccaaactgctcttgttgtggagtctgtggtatccaccaatgggttctttctgcctgctgcacaaacaaaattaattgacagaaaccatggcattgcagtaaagaaagtttaattgacgcgaggctggccatgccacgtgggagacagagttgttactcaaatccatctcaccaaaggctcagaggttagggggtttttcagatagtttgacaggtacggggccagggaatggggagtgctgactggttgggtcagaggtgaaatcataagaagtagaagctgtcctcttgcactgagttggttcgtggatccccaggttgatgagtcagggtggggccatccacttgtcagaaatgcaaaaacctgaaaagacatctcaaaaggccaatcttaggttctacaacagtgatgttatctgcaggaatgattggggaagatgcgaatttgtgacctgtggaataatgggtggtaatcatttaactacaattacaacttagaagaattcaggaccctctcattctcctaacttggtggcctttcatttagttttaaaagggcagttttggggaagggttattatcatttaaactataaactaaatttctcccaaagttagtttgtcctgtgcccaggaatgagcaaagacagccagtctgtgaggctagaatcaagataggagtaaaccatgtcagatttctcttactgtcaaaattttgcaaaggcggtttcaacagaaattaacatgtctaggatagttgctttttctattattttttctatcactgcatttactttcattctgccttatgctttaactaggtaattttttttttttttttagttttggcggtatcaacactatattcttctctttgaccaccgcatgctgcctacgtggtagactctcaatacgcatggaactgaacctcttacaggatttgtaactcacttctgtggtatctagtaaactggaacacgcgctttccctgggctgctctgtcatcccaggtttcagcactcggaaatcgcttgggcccccgcccagaggcggggcttgggtgggctgaccactcctctggcctccaatactgtcgctgacattctcgtctatgctccagcagccgtacctcactccggtggaggcgggacttcctacagcacttccggccagagcctcaagcttcgctgctgggcagttggctggaggggctgctgctgggaacacctggagtctccgcgggcaggtgagcttcagaggttcggggagctttcggaacgagcattcctggccggtgcgtcaccctgcagtgctcttggccttttcttcctttcctggaatcttcccagattgccagagccgggcgttgcctgctccgtgcgctgggaggcggtccagccggctgggttggggccaccctgcgcctcctggaaggccttatttaggagtagccgcacgtgatctctagcattttaagcttctctcagagaattggcatgtcactttggaagaggtgaaaatggtacaggcgaccaacgacttttacaaggtgtcaccttagaggaacagcctcgtccttccgaatcagttaacattggtgatgacagagaaataacgttaaataggtggagagcacttaaagtaactgtttgttcttttgagacagtcttgctctgtcgcccaggctggactgcagtggcgcggatctctgatctcggcttactgcaacctccgcctcctgggttcaagcgattctgctgcctcagcctcccgagtagctgggattacaggcgcgtgccaccacgctcggctaatttttgtatttttagtagagacagggtttctccatgttggccaggctgctctcgaactcctgatctcagatgatccacccgcctcggcctcccaaactgctgggattacaggcgtgagccaccgcgcccggcctaaagtaactatttttacttggtgtttactaccaaatggggactgttctaagttgtgggtggatccaaatgatggtgtgacagccttatcctcagagaagcagtcctggcaggaagacggggttaacaaattgccaaactgttagagaaagttagtggaggtagagatgaagagagaagacttttcttttctctggcattaatttagccacggccgctgtgttttgatacttgcttcaaacgtttttcatattcttaagttttaacttttctgtatgctcatattttatatactgttgtaaacagcatatctctgggttttttttttaatctaagtggacagcctgctttttttttttttttttttttttgatatggagtcttgctctgtcgcccaaggctggtgtgcagtggcccaatctcagctcactgcaaccacgcctcccaggttcaagcatatctcccacctcagcctcccgagtagttgggatgacaggtgtgtgccaccatgcccagctaatttttttttttttgtatttgtagtagagatggggtttcgccatgttggccagactggttttgaaggcctgacttcaggtgatccacctgcttcagcctcccaaagtgctggggctacaggtgtgagccaccgtgcccagcccagtctgccttttgactagcaggtttattggatttacattcattgtcactactgaaatatttgtctagatgaaaatctttggtatcatccctgattaatctcttccatatatatcagcaaatcctatggactctccacctttaaaatctgtccacactcccaggctcttgttatcaccttcacttgttcaagttacgttgtctcgtacttgaattactgcagtagtttctgctctttcctcttttagtctgtttgcatcacagtatctcggttgatcctttaaaaaaaaatcagatttatgtctttcctctcaaaaatcctccaaggactacacatttcacctggagtgaaagccaaagtcggccgggcgtggtggctcatgcctgtaatcccagcactttgggaggccgaggtgggtggatcacgaggtcaagaggtcgagaccatcctggccaacatggtgaaaccccgtctctactaaaaatacaaaaattagccgggcgtggtggtgcgtgcctgtaatctcagctactcaggaggctgaggcagaagaatcgcttgaacccgggagacagaggatgcagtgagccgagatcgtgccactgcactccagcctggcgatagagcaagactctgtctcaaaaaaaacaacaaaaacaaaaaaaacaaaaactggctgggcgcagtggctcaagcctgtaatcctggcactttgggaggccaagactggtggatcacctgaggtcaagtgttcaagaccagcctggccaaagtggcgaaaccccgtctctactaaaaaaaaacacaaaaaattacccaggtgtggtggtgtgtgtctgcaatcccagctattagggaggctgaggcaggagaattgcttgaacctgggggcaggcgcggaggttgcagtgagccgagattgtgccattgcactccagtctgggcaacaagggcaaaactctgtctcaaaaaaaaaaaaaaagccgaagtcttcagagtggattattcatcgaaggtcctatgtgacctagccctgcttcactgctgatctcatgtcgttctcatctcctgtttgctctactgtatggtctcctcaagcgcatcctagcctcaggatatttgcacttgctattcctttccctcatatgtccacatggctcagttctttacctctctcatattttggggacctttaccttctcagtaaggccttctctgacaagccactgccatctttaacatttccattgcactcgttatccttgtgcttatcatcatatgacatgccatgtgatagagtcatttatctggtttattatgttttctctcactggcatagaaggtttatgagggcaggtatttttctgttttgtttactgctgtattctttttttttttttttttctgagacggattcttgctctgttgcccaggctggagtgcagtggtacgttctcggctcactgcaacctctgcctcctgggttcaagcaattctctgcctcagcctcccaactagctgtgattacaggcgcatgccaccatgcctggctaatttttgtatttttagtagagatggggtttcaccatcttggccaggttggtcttgaactgctgaccttgtgattcacccgcctcagcctcccaaagtgctgggattacaggcgtgagccactgcacccggcattttttttttttttttgggaagatctcttattgtacttccctgtaaaatccattactgttttattccaattgcctaaaatagtatctggcttttagcagacactccataatataattgttgattgaatgaatttggggtttttgcaccatcttctacacttcatatttttatgcttttttcctccttgtcttttcttttttttttttttgagatggagtcttgctctgtcgctcaggctggagtgcaattgtgtgatgtcggctcactgcaacctccgcctcccgggttcaagcgattctcctgcctcagtctcctgagtagctgggattacaggcgcacgccaccacgcccagctcttttttgtatttttagtagaaatggggtttcaccatgttggtcaggttggtcttgaactcctgacctcatgatccgcccgcctcagcttcccaaagtgctgggattacaggtgtgagctatcacgcctggcttttttttttttttttttttttttttttttttttgagacagagtggttgctcttgctgcccaggctagagtgcaattgcatgatcttggctcaccgcaacctccgcctcctggcttcaagcaattctgccacctcagcctcctcagtagctgggattacaggcatgcgccaccatacctgactaattttgtatttttagtagagatggggtttctccatgttggtcaggctggtcttgaacttctgacctcaaatgatccacctgcctcagcctctcaaactgctgggattacaggcgtgagccaccgcccccggccactcttgtctttttttttttccctttttttttttttttgagacagggtctccctctgtcacccaggctgtagtgcactgacacgatcttggctcactgcaagctctacctcccgggttcaagtgattctcccacctcagcctctgagtagctgggattatacgcgtgtgccaccatagcctggctaatttttgtatttttattagagatggggtttcatcatattggttaggcttgtctcaaactcccaacctcagttgatccacccacctctgcctcccaaagtgttaggattacaggcgtgagctacagcacccggccccacctttttttctgagacagagttttgctcttgtcacccaggctggagtgcaatggcacgatctcggctcactacaacctccacttcccggattcaagtgattctcctgcctcagcctcccaagtagctgggattacagggacccgccagcatacccagctaatttttgtttttttagtagaggtgggggtttcaccatgttggccgggctggtctcgaactcctgacctcaggtgatctgcctgccttggcctcccgaagtgctgggattacaggcatgagccactgtgcctgccctttttttcattttttcatttttttgtacaatagggtctccctctgttgcccaggctggagtacagtggtgtgatcagggctcactgcagcctcgaactcctgggctcaggtcatcctccaacctaagcctcccaaatacattggcctataggcgtgcaccaccacacccagctgatttttatattttaatttttaattttgctgtgcatatttagctgggattacagacgcactccacctcgccaggctaatttttgtatttttagttgcaacgggatttcaccatagtggcaaggctgctctggaactcctgacttcagatgatcctcctgccttggcctcccaaagtgttgggattacaggcgtgagccaccgctcctggctggctttgtagaaccttaaacatatttatctatcttaagaatttttcccaaggaaatacttcataaggtaatattttaaaaatcaaagctgtttttagctgttttctttggagttgtaaataaacagcattagagaaatgattggctgggtgcagtggttcacacctataatcctagcactttggaaggctgagacgggagaatctcttgaggccagcagtttgagaccaacctgggcagcatagagagatcccttctctaccaatagaaaagagagagagagagaggctgggcacggtggctcacgtctgtaattccagcactttgggaggccgaggcgggcggatctcgaggtcaggagatcgagaccatcctggctaacatggtgaaaccacgtctctactaaaaatacaaaaaattagccgggcgtggtggtgggtgcctgtagtcccagctactggggaggctgaggcaggagaatggcgtgaacccgggaggcggagcttgcagtgagctgagattgcaccactgcactccagcctgggcgacagagtgagactccgtctaaaaaaaaaaaaaaaaaaaaaaagagagaaattattaagtaaattgtggtatcatacttggatattgagatgattaatgtgttgactctgtggctgtatagaaaaatgtttatggacaaatgttaatatggccagttgaggtagctcaaacctgtaatcccagcactttgggaatcctcaggaggattgcttgagcccaggagttaaagaccagcctggataacatagtgaggccctactttattttaaaggaagttaataaaagaagtagaacaaattatatgtctcagtggtagtaaaattctgcttacatgttaatgaaaattttgaaagggcacttaaaactagtaaaaaactcatttttagggtaatacaattgtagtaaaatttaaacatttaaattttatgatcggaagatggtagtaaatcagaaatggctttggaatttctttcattgcaaccttaatagtaagcaacagtctttcccatgaaagggacagaaaaaaaagaatgtaacgtctacatttttttttttctttgagacgcagtctcactctgtggcccagtctggagtgcaatggcacgatcttggctcactgcaacctccgcctccagggttcaagcaattcttgtgcctcagtctcccaagtaggtgggattacaggcactcaccaccatgcccggctaatttttgtatttttatttttatttatttttatttttattttattttattttatttttgagacggagtctcgctctgtcgcccaggctgaagtgcggtggcgcgatctcggctcactgcaagctccgcctcccgggttcacgccattctcctgcctcagcctcccgagtagctgggactacaagcgcccgccaccacgcctggctaatttttttgtatttttagtagagacggtgtttcaccgtgttagccaggatggtctcgatctcctgacctcgtgatcctcccgcctcggcctcccaaagtgctgggattacagacgtgagccaccgcacccagacttgtatttttattttttaaattttaaaattttatttatttttttgagactgagtctttctttgttgcccaggctggaatgcaatggcataccttggctgactgcagcctccgcctcttgggttcaagcctccagagtagctgggattacgggtgcttgccaccatgcctggctaatttttgtatttttagtagagacaggtttcaccatgttggccaggctggcctcgaactcctgacctcagataatccaccctcctcggcctcccaaagtactgggattacaggcgtgagccactttgcctagcctacactgttaaatgaatgcttttcagaccattgtaccccacgtgcaggtcaggccacatctggaatgtggcgttcagttctagatatcgcaatttaagcatggaatcagtaaatcagttacagaggaaaactggaatgctataaggagggtttaaggagctggaaatgtttaccctggtagagaggtttgggagatgaagacaggaagcagggaaagcagaaatggtaacaaatggccttccatatttatttatttattttttgagactgaatctccctctgtcgcccaggctgaagtgcagtggtgcaatctgggctcactgcaacctccgcctcctggattcaagtgattctcctgcctcagcctccctaggagctgggattacaggtatccgccaccacacctggctaatttttgtatttttagtagagacggggtttcaccatgttggccaggctggtctcgaactcctgacctcaggtgagtcacccaccttgtcctcccgaagtgctgggattacaggtgtgagctactgtgcccagctggccttccacatttaaatgttgtctgggaaagggaatatattgattctctgtagctacatagggcagtagtagaaaattactaggtgaaaatgatagagatgtagatttctttttttttcttttttttttttttttttgagatggagtctcactctgttgcccaggctggagtgcagtggtgcgatctcggctcactgcaagctccgcctcctgggttcacaccattctcctgcctcagcctcccgagtagctgggactacaggcgcccaccaccacgcccggctaattttttgtatttttagtagagatggggttttgctgtgttagccaggatggtctcaatctcctgacctcatgatccgcctgccttgtcctcccaaagtgctgggattacaggcatgagccactgtgcctggcctagagatgtagatttcatctttttaaagaagaataacaagagtcactccaacatttaagtgggctatcttcattagttagcaagtgtgtgtattttaaaaagtcattccatctgaaccaagccttagtcagcacccagatagacctaactaagagcaacatgccactcacattcaggtgattaggagagggcccagtgcaggccattacagagaacttaactaggcagcagctgactgcaggtcattttgactggatactaaaatggggctgggggtgggggagtgatcaaagtggttgtcctagcaacaggcaataagggtgcagagtgggccagtaacagcatcaagtaggtctaacatcaggaaacagggacccactggttactagctagaagaagagggtaaaggctttggaactaaggcataggtcaccaagacatggatccagtttctaggtcttcacggaagatcatggtatcaagaaagacattattagaaacgttcagagactagacaggatcatcaaaaatactgacttgaggctgggcgcagaggttcacacctgtaatcccagcactttgggaggccgagatgggtgaatcacctgaggtcaggagttcgagaccagcctgaccaataaggtgaaaccccatctctattgaaaaaaaaaatacaaaattagccgggcttggtggcacatgcctataatcccagctactctggaggctgaggcaggagaatcgcttgaacccgggcggtggaggttgcagagctgagatcacgccattgcactccaacctgggtaacagagcgagactcttctcaaaacaaacaaacaaaaacacctgacttgacacagagactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctactaatgattttctgatcttatttcatatttatttttacagctcatcactgcatttcatgataagatttaaatattaaatagaaagaaactagctagcctaataaaatctgaacacagttaatatctgtcataagactagttttaatggaattctctattgaaactactattttaaagggttactagaaatgatttggttggtcattttgggaaatgtcccttaaacttggggagacatcctctactatgtataacaatatgctattatctgtcttctcagttgcactatttctaagagtacttaaattaatcacatgcttttccctacaattatacctaagctgagtatatcttcttctgtgataaccagctttgattgaaatgtactcatattaggtaaacattaggcaatgataggaggaaagcaaaactaattctttcaaaatgtcaacaaaatttagaaatatccttcccgatggcactaaaaccctgagaggtatttgcttttattcatactcacacaactttagcatttaaaaactatgagtactaaactgtgaccttcaggatttatgttagatggcagaaagaaaatttgggtattagtctaccatataaatgaacttctttaaaaccaaggttcagaactgagaatcatattggttcctcttcaagttagttcaagttgcccacttcagagatccacaaaatctgacattatttccagaaaccccaaactttggtataagtgaccactgctcaaatatgtgatcacatgatcacacagcattcctgtgagttcctttttgtctgataattatcctaattagctctacagagctatcctgcaatccaggttgaaattcaaactctcagttactactacagatttctgaactaggccaagttttaaccaaaaactataggtaatggtgaattactaattagccacaatgcatcaggatttagaaatattttttcttttataaaataacttggtatttttctgataatcttccaatagataaataaaaacttttcttatgctacagtacaagttgatttttaaggaaatttgtgcaaacattaagaaacaccgcattggttctgggtgaaagtgccagtctggaactctcttgaaagaccatacagtctactgctaaaccctgggactcctcagacttgcactcagattatcgtttgcctgccctgattttagactctgctaattcaagtccctgttatcttgcttgacatcgacaaggatcaccgcaccgttccttcagtttccacagttccgtcagttcccacggagaatactgaggagaagacagcattcctgtctcacaggtcttctcacacagccacagactgtcctgttgagaaacaaccaaagccgatctgagagtggtgaaactgttttaagagcatcagaaagtatgcacgtagacagcttttatgtattctaatgatgctgaaattatttcaaggataactccgtgtgtggaacaactggtgaggtttgggggtggcacctcctgatttgggaaagcaccaggtcccacagtcctgtggctgtggaatacagaaacaaggcggtgtgtggatgaagagttagtcaacaaatgccattccgtaatgaacgattttagaaaccacaagtgagtttcatgtttgctagtaaaggtgtgtctatggcagtattagtaacagctattattctgatggaatgcttacaatattgcagggactgtaccaagtgctttgtaaatatctcacttaaatctcacagtaatgctgtgaggtaggaactatttccctcttaacaattgaggaacaaacgaagagttaaaaaacttgttccaggtcacagggctggtaaatgaagaggagggattaaagactcccaagctcaagttcttaaccactagactatttcctagctacgtgaattggtttctatttccagcaatgtagcagaacacagagagaaactcattcaatgttttgacaacacaaaaatgttggataaaattaaaaacctttataaagcatggctcaactccgtgatcaaagaagaaacagggtaggagaaagcgctgagtcagcctgtgccttgaaggcagctgctgatccttgggtttggaaggccaagcccagggtcaggagactaatgggagactgacacagagctaggatctctgaggggccacagcctcaggggtgataaaacaaaacacactcagcttgtctgtctcagtcttgcccctcagtgggatggaaaggagtctctctcccctcagtgcctacccacagcttgcacttaggtaggtctggggctggtagtcagtctgtgtaagcccaacagttccaagccaaaaatctgaagtattcatagatggtagtattcctagatgcatggcagaaaaaaatgtaaatatgtaaatcctctctgtaggaatgcattttaaatagaggactcagtttccaaagacatgagatggtcacaaaaaaaaaaaaaaaaaaagaccgcatcagaaaacaagcgccatgaacaacagttgtagaaacaacaaactgcaaaatcagacccagcaaagactacagatcccagaattaccagatacaaaaaagaattatattcaaagatgagacaaagtacagcaaaggaatcagactatcaaagtggaccatgtagatgtgggttgatttcttgtcctggactgagagctgctctgggaccccagctctatgcagggcttctaactgacagacactgcatgtgccttctgtcccctgcaccttcgatggccaaagtggaagctgcaagaatccagaacagaaatctctgaagctaaagccagctttgtgcttgatttcttcccagggctctagtttccattttggtctctgcagattcatttttttttctggttcagcaatactgtgttttaaatgatgtcttatatttcatgcagtgtcttatttttatcggtcagaagggttgaaggatccttagactgccacactcaatcagtggattctgtcgttcagttttttttttgagacggagtctcgctctgtcgcccaggctggagtacagtggtgtgatcttggctcactgcaagctctgccccccgggttcatgccattctcctgcctcagccttctgagtagctgggaccacaggcgcccgccactatgcctggctaattttttttgtatttttagtagagatggggtttcaccgtgttagccaggatggtctccatctcctgacctcatgatctgcccgcctcggccttctgttgttaagttttaaagctgcaaataatttctgatcaaatctatggaaactgagtttttttgtaggcaggggaacgttgatttataaccttttgctttaaactcagaaaaatactgtatgagaaataacctagtggattattgtgaattaaagcaacagcataactattatggtagaagatcctcattctttctgcccatggtgtgataaacattacaggttgagcattccaaatctgaaaatttgaaatccaaaatgctccaaaatccaaaacttttttttttttttgagacagggtctctctcactctgttgcccaggtgggagtgcagtggtgcattcacagctccctgcaccctcgacctcccaggctcaagttgatcctcctaccttagcctcctgagtagctgggaccacaggcaggcgctgccatgcccagctaatttttttgtagtttttgtagagacggggggtttcaccatgttgcccaggctggtcttgaactcctgggctcaagtgatacacccaccttggcctcccaaagtgttgggattacaggcatgtgccactatgcccagcccaaaactttttgagagccaacatgacactcaaaggaaatgctcactgaagcatttcagattttcagatttggaatgtgcaacttctaagtataatgcaattattctaaaatccaaaaaaatctgaaatcctaaatacttctggtcccaggcattttggataaagaacactcaacctgtatatagaaatccacctcctcaactcttaagaaccctgaggccatccccaaagacttacctggtatcttttaggtcctatggcagccatccagatgcccatgcttacatcttcaccctatacatggcccataaagtttaaatgtaaaaattttaatgctattttatttgtaaagacaaaaccatagccactcccatcataaaccacctttctacttttttgctctgttattattctaatatgaaatagcaaaaatgggttcacatgaagtcaaagctagtggtctttaatatgaagcacccctgccacaaggtaataagatgaaaccgcgagcagacgacccatccttctcatgtaccttaagcttccaggaagcacttagggcttcctccttaggaataaaaatctttctattcctccagggactatactttttttttttttgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttctgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaaggcaagatttgagggatgtaggggtgcatccttaacctttgagaggtgattcctatacagagaataacgtgcttttccccaaggtaagtgggttctgctttccatgatgggatgccgagtgagatgaaacttggtgtgatgagtgtatacgtaggtgggaaatccttaattttttgtttttattttattttttattatagagatggggtcttgctatgttacccaggctggtcttgaattcctgggctcaagtgatctacccgccttagcctcccaaagtgttgtgattactggcaagagccaccacgccaagctaagaaattcttaattacctgataggtctttaacctccccgagttgcttgccagccacttgacgatgtccttggagatcacatatcctgacccacatgcaaaggcagggtaagcggggctcgggtactccaactcctgccactttccggttcggtcaactgcccaattcagtctgaaactgagatgaaaaataatgtggcctcttgtgttagtctgacacatatcctgccactattaaaacttgactcctttatcatcactacaaaggaataagcttgtagaagtgaggaaagaaaataagaaaatttctttttttttgagatggagttttgctcttgttgctcaggctggagtgtagtggtgccatctcggctcactgcaacctctgcctcctgggttcaagcaattctcctgcctcagcctcccgagtagctgggattacaggcgcacaccatcatgaccagctaattttttatatttttagtagagacagggttttgccatgttgtccaggctggtcttgaactcctgactttgggtgatccaccctcctcagcctcccaaagtgctgggattacaggcgtgagccactgcccttccagaaaaaaattttcttaatctaaggaaaggaattatcatttatccagtgttgttttagataaaagattggttatgttaaattttctcaaagttgcatttgtagagtttctgaatgaaaagcactagaagatcaccctgtgttttagtatatatgaaaacaaaaaaccaaatcactaatccatattgtattcctgaggaagcacagaaaatggtttcagagacgtgtcacaaacgtactctaacaaaatatacagtagcttctaatgtgaataccatttatttctttggcataagaataaaagccatattgttttccctcctttactacattagcctgaggcttttcatttaaaaaataatttcctccaattgtacagtaatataaaatttattattattattaagacagggtctccctctgttgcccaggctggagtgcagttgcaaaatcatagctcactgcagcctccaactcctgggctcaagcagtctccctgcctcagcctctcaagtagctaagggctacaggctcacatcacctttttaattttttgtagggacagggtcttgcaacgttgcccaggctagttttgaactcttggcctcaaaggatcctcccacctcagccttcccaaaactctgggatgacagatgtgagccagcatgactgacctagagtaatgaaatatatataaacccaggagtctagtacgaaattgtatatctcaaccacattttcaaaaaaaaaagatattttatgctttattaattacatttgatcaggtacacgaatgccaatgggctaagaatggttaacttactttccccaccaaaaattaggcccatccagattcttttggacaatcctattaaatacagcttcgaggtctatgtaacagtcatcatctgtcttcagcaacaaattgaagctcgttgtttccacagtcctgttgacacaaaagggataagaaagtcagtgcgaccaaacaaacaaacaccaatgcagtggcgtcactaacactttcattcaaaactgtacctgtcattatctaaatttcttattcctcaaatgttgagaacatttgctctaacaaaattttgctgctatcaactaaggccatcacttggtctttactaaatggcataacacagagaagtactaacctgattttaaaaggcaaagaaagagcatattgaaggaaaatatctggcttaaatggaacatatgttcaaacaaatgcttcttaggcatcattcaactcctgctgccaaatctattaaacgcctgaaccttgccccgtgtgttcttaataacaaaggcccagcataatgaattaggtgttacatctgggcctctcacacagaacgctattgtacaagatgcatccgatgctatttatattacactcaaaatattttatggcttaaaaaaacctgacttattacattgaaacatattttcccttggaaacaacttctagcaattaaaccattataaatgaccttctggaaggcaaaggatagtgacttcattatctagacgtaaaatatataatcatgactaaagacaaaattgactccttcatttcacattgacagtccctgtacatctgtttaaaaatgcagttttgctagggtgccagtcatatgtcagaaatctcaataaaataaatttagaatttcattaggtccaagaatggtgaatttaacaataatgggtccacaccaaatagcatcaccccatgtttctaaagtttatttccaattaacagcagaaggcatacataatatttgctaattagaaatttcatgataaagaatatttaggtcactgataactgaaataatgaggaagaaataatgaaactcatttgtagtgtggagatgggtgatgccagctatggggacgcaggtcccagatcagagtcctgttgaaggttactgcagcgatccagggagagaaggtggcagccaacaatagcggcagcggagactaagggagaggctaagatacttccacgcctaggaaatatcttgctctaaagagtatccggggctgactcttagccctgacttcccacccttgggacttccatgcccattcctcatctcagcctcacctacaattgcaactctcatttgcggccccaaattaaaaggaggttctttttcttactacagctgcctaaacttaacctagtattcgacacacccagatttccaaccctcatttacctctgctctctactcacaggatgagtcccaaattatattaatttgccccagcaggccaggtgtggtggctcacgcctataatcccagcactttgggaggccaaggcaggaagactgcttgagacctcatttctattaaaaaataaataaataaataaataaataatttgccccagctaagaaacattaccttccataaaccaattagaccatctacccctcaggaccagggaactgtatccgtaaagtactgttcttggtaacttcccactctgcctagggcaacagagaagaaaagaaagagacagaccctgggcctcacaccaaggaacagaagaaggtttttaaaaataaaagtgaaaaaaataaaaagtgaataccctttataggtttggcctaatcagagataggtttgaaagttttggctccatggtcaggacagacagtaccaggaaactcaacataaaattttgagatcctagagtaactaataattctaataactatacgttaagattatatagatatataatatgtatgttactattattatatattgttgctgttattcttgttataaaagtaggaattaaaagtaagttccaagaaacactggagggtctgggaaattataaatatgatagattctgggagttgtggaattttagtaagccagccacgtaagagttttagaatcagggaggtagtttttaaacggatggagtagagactggaagtataaagtggatattcagtagaagagaatgcctatcagtaacctaaatgtgagtgactataactggggaatctgggtaggtgggtataaatacaactaaaaatggaccattcccaaactcactgatttttatctaatgctggcttgagacaaccgaggcaagcagaaatgactcaaaatgaatcaactttttttttttttttctttttttttgagacggagtctcactctgctgcccaggctggagtgcagtggtgtgatcttggctcactgcaacctccgccttctgggttcaagtgattttcatgcctcagcccccctgagtggctggcattataggcgctcgccaccacacttggctaatttttgtatttttagtagaaacagggtttcaccatgttggccaggctggtctcagactccagatctcaagtgatctgcctgccttggcttcccaaagtgctgccggcaggcataagccaccagccaatttttgccgtgtttttgataggttaatatcacattgtggatctttatcaaaataaagtggcagcatcttagaagctcagttttcgcaaggaactgggatacaataggtcatatcccaggtgctcagtgtccttaggtttgtttttatttgctgaaatctcagtggtttgaagttgataaattgtctcgatagcaaaagaacaataaggcacagtgtcatgtgcctgtaatcttacctactcaggaggctaaggcaggaggtttgcctgcactcaggagttcaagaccagcctaggaaacccctagtaaggggtttccttacagcctagtaagaccccatctcaaaaaaaaaaaaactaacaataaaacaagttctagctacccaacatttttacaacctaccatctatagaagttcaataattttgcaggaacattacgataagtgtcgacaacatccacaaaaacaatatcatcatagatgctgctttcctccttcagtaaggcatcttcctcatggagattccttatatgatcaataagtctttgagggcgagaatgaaggttgtgtaagagagcatcaccttctataaaggaaaagttgagagttggagaaaaatgctgttgtaaagttaccattcagaactgatgatgtacactaaagttcttttcccaaggtaacccagcagaaacacatgcagttgtttggaactttaggtagaaaaatgggaactctcatacactgccagtaggattaagtggatgctcccactctggaaagcaatttggcaatatctatttaggctgaaaatgtgtacaccttatggttcagttgaggccacttgtagatatatccctactaacattatttcacatgaggatattaattacagcattgtttgtaattgtggaagaaaaatgggaccaacctaaatgtccactgagagaaaaaaaaaaaacagccaagttgtggtatattcacataatgaaatatagcagttaaaaaaattaccctgatcttgcatgttaaaaggattgggatgaaaaaataaagttgagtgaaaattgccaagtgataaatacaatatgacaccacagatatcaattataaaacactcaaaactatgttatttaaagacatggtcaggcgtggtggcttatgcctgtaatcccagcactccgtgaagccgagggaggagaatcgcttaagcccaggagtttgagatcactctaggttatatagggagaccccatctctaaataaaatttaaaaattagccaggcatagtggtgcatgcctctggtcccagcttcttgggaggccaaggcaggaggatccctggagcccaggagttcaaggctgcagtgagctatgattacaccactgaactccatccagcctaggcaacacagcgagaccctgtctcaaataaataaataaataaagagacgtaaatatgttcaaagtagaaaaataagaatgggaagggtacacatgaattttagggaagtggcaccccctttgaggagagggaagaggaatacatctagggagaaccacaaggaaaaggtttcaactgtacctacaatgttttcttttttttctttttttgagacagagtctcactctgttgcccaggctggagtgcaatggcatgatcttggctcactgcaacctccacctcccagattcaagtgattctcctgcctcagcctcccgagtagctgggattacaggtgttagctaccacgcccggctaatttttgtatttttagtagagacggagtttcaccatgttggccagctggtctcgaactcctgacctcaaatgatccacctgcctcagcctcccaaagtgctgggattacaggcgtgagccactgcaccaggcatataatgttttctttctttcctctctttttcttttttgtttttgagacacagtctcactctgttgcacagactggagtacaatggcacgatctcagctcactgtaatctccacctcccgggttcaagcattctcctgtctcagcctccctcatgagtagctgggattacaggcgcctgccactgtgcccagctaattgtttgtatttttacaaacaattgtaaaaattgtttgtaacaagaggcagggttttgccatgttggccaggctggtctcgaactcctaacctcaggtgatccacctgcctcagcctcccaaagtgctaagattacaggcatgagcgactgtgcctggccatgttttatttaaaaaaaaaaaaaaaaaattagaaatgaataagaaaaaatgtaaataaaaaattgttaattctgagcactgggtacctggctgtttctgtactatttctggtgtatttatgattatttcctttgtttttttttttttgagacagggtcttgttctatcacccgggctagaatgcagtggtgtaattatagcttactgcagcctcaacttcctgggctcaagtgatcctcccacctcagcttcccaagtagctggtactcccggcacctgtcaccatacccaggaaattttcaagttttttgtagagatggggtctcgctatgttgtccaggctggtctctaaatcctgggctcaagagatcctcttgcctcccaagtttctgggagcctcccaaagttctgggactacaggcgagagccactatgcctggccatgatatttcataataaaaatgattactaatgtgcttaaaagacaatttatttgccacttcacaagttaatgagtcacttgtcacgtgtgcagggactgtccccagatcctactgatttaaggcaattctttcgctgtggcaggagacgtcaggatttcctaaaaatgtctcaatcaaattaaagaaaaattttgaaaaatacaaagaaaatgagctgctgagggtggcaaaggaaatgaaatacaatttagcactgcactctttgtcactgcaaatggaaaggatgaggtgggaagctgaaggcctatatctgacttctgcctctcatgacttgtgagatactggacaagttctgttgtctctagaccacagcagtctcacctgtagaaaatggtgctggattcaatcagtgattcttgggaatgcttgctgaaatgcagattcctgggccccaagcctaaagattcagtaggtctggggtggagcccaggaatctattttttttccttctgcacctgctcccaggaatctatatttttaatggccactgctgcgaccctgatgcaggtaggcagaacacagaccagcctttgagaaacacaggggtagatgacctcctgtttttttttttttttttttttttttttttgagatggagtctcactctgtcacccaggctggagtgcagtagcgctatctcggctcactgcaacctctgcctcccaggttcaagcgattctcctacctgagcctctcgagtagctaggattacaggcgtgcgccaccatgcctagctaatttttgtatttttagtatagatggggtttcaccatgttggtctggctggtctcgaactcctgacctcgtgatccacctgccttggcctcccaaagtgctgggattacaggcattgagctactgcacctggcctgacctcctgtttagacttacaatttttggactttacgataatgtaaaaacaatatgtgttcaccagaaaccatgctttgagtacatatgcaaccattctgtttctcatgtgactacagtcttgtgagatgttcaacctttattatggaataggctttgtgttagattattttgcccaactgtgggctaatgtaagtgtcctgagcaagtttaaggtaggtgaggctaagctataacattcggcaggctaagtgtatgaaatgcattttcaacatacatttttaacttaacatgggttcaacaggatgtaacattgtaagtcaaggagcatctgtataatttaacacttgatggaaagtgaaagtgttataaaattgtaacaggaaaatggcttgtaacaacaggagtgcagaaattaaatacaagccttttagactagtaacacattttgtttcactgcatgtatctgaaaaatatgagcataaattaatatgtcaggaaaatgaaaggatgtctgcttttgccacttctattcaacatacatgttctagccaggacaatcagataagaaaaaaggcatccagattgaaaaggaagaagcaaaactctctcttcttacagatgaaatgaccttgcatgtagaaaatcataaggtctaactttaaaatgattaagtaataaatacatggatctgttcagcaatgttgcagcacacagatcaatcacaaaaacaatctgtatgtctatatactcgcaatgaacaatcttaaaattaaattagaaaaacaattccacttacaacagcatcaaaaagataacataagtatttaataatttaacaaaagaagtgcaagacttttatactgaaaaatcaaacatcattgaaggaaatttaataagacatggatgttcaaagacttaatactgttaacacggcaatactccccaggttgatccacagatagaatgcaatccctgatgggaatgtgaactagtacaaccactatggaaaacagtgtggagattccttgaagaactaaaggtagatctaccatttgatccagcgatcccattaggaaagtaagtcattatatgaaaaagatacttgcacatgcatgtttatagcagcacaatttgcaactgcaaaaatatggaaccagcccaaatgcccatcaatcaatgagtaaagaaaatgtggtatatatatatataccatggagtactactcagccataaaaagaaacaaaataatggcattcacagcacctgcgtgcagctggaggccattattctaagtaaagtaactcaggaatggaaatccaaacatcgtatgttctcactcataagtgggagctaagctatgaggatgcaaaggcataagaatgatacaatggactttggggacttggtggggacagggtgggagggggtaggaataagactacacactggttacagtgtacactgcttgggtgatgggtgcaccaaaatctcagaaatcaccgctaaagaacttattcatgtaatcaaacaccacctgctcccccaaaaccgattgaaattatatatttattcatatatatgcatatatatatatgcaatcccttaaaacattccagctaggttttcttttttttttttgcacaaattaacaagctgatcataaaattcatatggaagtgcaagagacccagaatagccaatcaagcttgaaaaagaacaaggttggaggattcacatttcctaatttcttttttttttttttttttttttgagacggagtcttgctgtcacccaggatgaaatgcagtggcaatctcagctcaatgcaacctctgcctcccaggttcaagcgattcttctgcctcagcctctggagtagctgggattacaggcgcccgacaccatgcctggctaatttttttgtatttttagtagagacagggtttcaccatgttggtcaggctggtctcgaactcctgacctcgtgatccacctgcctcgggctcccaaagtgctgggattacaggagtgagccaccgtgcccagcctcccaatttcaaatcttactaaaaagctacataatcaagacagtgtagtactggttaaagacgcagacacatagatcaatggaatagaattgagagtcctcaagtaaatccttacatctacagtcactgattttcaacaaatgggtgctgggacaactggatatccacatgcaaaagaatgaagttaaacctctatttcatgccatatatgaaaatgaacatggatccaagacctacgtataagtgctaaaactataaaactcttggaactgtaaaacaaaggcacaaatctttgtgacctcacattagacaatagttccttacatatgacagcaaaaacatgtgacaaaattggacttcatcaaaatttacaacttttgtgtgttaaagggcaccatttgcaaagcatgtatctgataagggacttgtatccagcatatataaagaactcttacaattcaacaataacaaaataattttataaatgggcaaaggatctgaatagatatttctctaaagatatacaaatgactctctctcccctcctttcctcccttcttccctccacccctccctccctcaccaccttctccctctctccaccccttcctccctcacttcctccccctcctccctccctcacttcccacatctagctcatataccataataattcaccctgttaacagtgtgcagcctcagcaatatgacaaaaccctgtctctacaaaacatttaataattagctgggcatggtggcatgcacttgtagtcccagctattcgggaggctgaaatgggaagttcacttgagcccggggaggtcaaggctacagtgagctgtgatcatgccactgcactccagcctgggcaacagagtgaggcctcgtctcagaaaaaaagaaaaacaacgaaacaaaaaaggaagatatacaaatggccaataagcacatgaagaaaatgctcaacatcattagttattatggaaatacgaataaaaatcacaatgaaataacaatttacacccactaggattggtatattttaaaagacagacaatttattaagtgttgacaagaatatggagaaactagaatcctcatatactgactatggaaatgtaaagtgggctgctgctttagaaaacaacctggcagtgcctcaagtgattaaacacacaattatatgacccaggtcttctactcctagacatttaagagaaatggaaatatatgaccacacaaaaacttgtacctacatgtttactacagaattattcatattcaaaaagtagaagcaatctaaatgtccatccattaatgaatgaataaaatagggcatatcgatgcaatagaatattatatgatcataaaaaagaagtactgatacatacaaaatggacagacctggaacacatgttacagcaaagaaactgacacacagagtacgtactgtgcatttccatttatgtgaaatgttcaaaacaggcaaatccatagagaaagaaagtgcatcagtagttgttagggggtggggggttggggaggtaagaatgaggagtaactgctaatgggtgtggggtttccttttgggaggtggagccggttgtagaactctaagaatacactaaaaccactgaaccactttaaaagggtgaattttatctgaataaagttttttaaaagacaaaaaagaaaaaatccttttctctcaagtataaagattaagtgtaagacattcagtgtacttttcaagtttcaactagcaaacttaccctgaatagtatatataaaaccacctgcaactccctccacaccttccaagaattcatgaggcaatgcaccctccccagcctgaaaggaataagaatgtactcagtgattcattactaaaaatacactgatcatattttaaaatcgatttgacaaaaatcataatatgactccacttgcagcagataaatgcatgtaagatgctggtgcactggaggcttataatatcaggatgacatacggtattctactatttttgttatctaattacaatactaaagataagatatacccaacattccataaggtgttcagaattgcaacttacatagaatcatgtttatgtacttgctactctagtagtacaaaaagcaattgattttacatcccaaccccaccacttaaaaaaatatgtattacgacctttgattttttggaaactaaaaattctcatgagttcaaatacatcttggcatgctttaaagttaagagaccatgcagagaaaggctcaaaattaacagtctgttccaaatattcaaattgaactctactgtatattgattaaaaaaaaatttttttttaatttttaatttttcttttttttttttttcaaataagagacagtgtttcaccatattggtcaggctggtctcgaactcctgacctcaggtgatccgcctgcctcagcctcccacagtgctgggattacaggcgtgagccaccacacccggcctaatttcattttacagacagggtttcactctgatgctcaggctgagtgcagtggtgcaatgatatctcattctagccttgaacatacaatcttcccatctcagccttacaagcagctggcactacaggtgtgcaccaccatgcccagctaatatttataaattttttgtagagaagaggtctcactgtgctgcccaggctggtcttgaactcctgggctcaagtgatcctcccgcctcggtctcccaaagtgctgggattacaggtgtgggccactgtgcccagcctgttgatgttgttgaaggtgcttaagcctattgtgccagcagccaatgacagtcctttctacttcttagaatggagaatcttttattattaaagagttatctctcttcaaaagttacccaatggccttactcagagtgaactgttttacttctgtatacagtaaaccactatggtacatctaccagagtattgtctggctgttgtgggctagatcagacagttaagagtccatactcagtgtatttacagtattttttctacaccttcatttaatcaagagagctactgcttggctattcttaaacagatcttttcagagttgtactgtacaaagcaatgttttaaggccagtagaagaagtaatctgaggtcactgtagtaacttgtcatttaatttaaaatatgtttgtaggccaggcgcagtggctcacacctgtaatcccagcactttgggaggcggaggcgggcggatcacgaggacaagacatcaagaccatcctagctaatacggtgaaaccctgtctctactaaaaatacagaaaaattagctaggcatggtggtgtgtgcctataatcccagctactctggaggctgaggcaggagtatcacttgaacctgggagaaggagattgcagtgagccaagactgtgccactgtactccagcctgggtgacagagtgagactccatctcaaaaaaataaataaaataaaataaaataaaagttcgtagccaaatgtgaaaattactaaaggggcaggctatagattccaacgttgtagttccataaaagactgtatatgctttatttgttatttacttatttactttttttttttttttttgagacgaagtcttgctcttgtcccccaggctggagtgcgatggcgtgatttcggctcactgcaacatctgcctcgggggttcaagcgattctcttgcctcagcctctcaagtagctgacagtcgcctgccagcacacctggctaatttttgtatttttagtagagacggggtttcaccatgttggccaggctggtctcgaactcctgacctcaggtgatccgcctgtctcggcctcctaaagtgctgggattacaggtgtgagccaccgcgcccggcctacttatttagttttttgagatggagtttcactcttgtcgcccaggctggagtgcaatggcgtgatcttggctcactgcaacctctgcctcccgggttcaagtgattctcctttctcagcctcttgagtagctgggattacgggcattagccatcacgcctggctaatttttatatttttagtagagacggggtttcaccatgttggtcaggctggtctcgaactcctgacttcaggtgatctgcccaactcagcctcccaaaatgctgggattacaggcgtgagccacagcacccagcctatgctttattttttattgtatatttctatattgttttggctttagaactcaatagtaatttctgtttattaacttctctctaaaaggtcacaacttggctttttgcctttaaaatttttctgacatcacttgctggcaagggaataaagcttagtgaaaactctcagctgtacgcatttgtgatgaaaatcttaatttgtacctggggtttcttagcgtaggctttaaaaagttacctggttttgtttttgtttttttaggttaactgtatgtttaagctatctttagccctctataataatttttactcccaaaggcagatcatttgagtctttacatttgaacctagttctcaactcagaaacctaccttttttttttttttttttttgcgacggagtctcgcactgtagccaggctggagtgcagtggcgcgatcttggctcactgcaacctccacctcctgggttcaagcaattctcctgcctcagccttccgagtagctgggactacaggcacccgccaccacagccagctaatttttgtatttttagtagagacggggtttcaccatgttggccaggctggtcttgatctcttgacctcgtgatcctcccacctcagcctcccgaagtgctgggattacggcgtgagccaccgcgcccggccaatttatttcttttagtgtaaccaatattatagaattttggcatatgctgggtattttaaagtttcataaatagaaaaggaggcaagataataaggaaagatataattccataaaactttctattttcagtaaaaaatttttcataagacttaaaatgaactttagtaaacaagtggtgtgtgtgtttactaaagtaaacaccatctttattgtcctccatttactttatgaaatttacctgtcataataaatcctaaatcctaaacatgaatgaaatcctaaacatggcctacaaatctaaatgtataactacatatgaatctatgggtctatttgtttaatgtctttcttcctcactggactgtaagttccacggtgggccactagtatgtctattttaccctgccattgtttctgccttaccacaggtatgcaggaaatgttttttgaatgagtaataacgtagcatatattcatttcaactcagaaattaatccatgtaaatgaggttaatattcattcactaagcttgtgaatttaaatgccaagtacattcctaatcattggacaggagatcgaggagaataaaagattgtctatgattccaccgtacagaccgtttgtttactaaagttcattttaagtcttcatatacctgctttattgacctatatttactttgagaaattcacctgtcaaactgttttaaatttaaagcaaagccgaatgagaaatatgagagtcagaaatcccagagttgcttcagcaaaataaatgaaagtactcaatcttattttctatttttttttgttttgttttgagatggagtctcgctctgttgcccaggttggagtgcagtggcatgatcctggctcactgcaacctccacctctggggttcaagcaatcctcccacctcagcctcccaagtagctaggattacaggcatgcaccaccaggcccagctaattttttttttttttggatttttagtagaaacggggtttcaccatgttggccaggctggtcttgacctcctgacctccagtggtccacccaccttagcctcccaaagtgctcggattacaggcataagccagcacaccccgccttattttccaatatttttatctatagtagttttttttgtttgtttgttttttttgagacagagtctcactctgccacccaggctggagtgcagtggtgtgatctcagctcactggaacttctgcctcctaggttcaagcaattctcatgcctcagccacctgagtagctgggattccaggcatgcgccaccatgcctggctaagtttttgtatttttagtacagatggggtcttgctatgttgcccaggctggtgttaaactcctggcctcaagtgatccacctgcctcagcctcctaaagttctgggattattggcatgagccaccgcacctggctaattatagtattttaactgaggttttattttcaaggtgagatagtaaatactctgaatactactgagcaagtattcttaaagaatgctaacttaaaaattactgagaaataggccaggtgcagtggctcatgcctgtaatacagcactttgggaagcgtaggtgggcggatcacttgagcccagaagtttgcaaccagcctaggcaacatggtgaaaccccatctctacaaaaaacacaaaaagttagctgggtgtagtggtgcgcacctgtagccccagctacatgggaggattgtttaagccaggaggtggaggctgcagtgagctgtgatcgtgctagtgcaccccagcctgtgcaacaaagtgagaccctctcaaaaaaaaaaaaaaaaaagagaaataaaatattgcattttaaaaatgcatcaatcttaaagcaaaactgtaaactcactaatgctggagttacaggatcatatttgagtttttgcctttactatgaagacaacaacatttgctactatatatgttgtaaaacacacaagaatcattgctccatgctgcctgggctctaaggtaaattttagaacaattttatatattaaaaagaagctaaaatatgcaattaaaccttaaaaaaaaacgacttactgtaatgactctgagaactccccctccatcattcactgtcactttgtggagatttcttgacacaaggccgtggaggtcttggctctcccacacgattgtaccttcaaagctcttttgtagaaagatgaatagtgagtcaatttccttattgctgtcatttaggttttaagtatgctttcaggcaagatttttagagaaaatttttcccaaaacgtatcatttaaaattttcaccccataactctgacataccactgttagcgtttggtgtgtatccttgaccgttttttccatgcacatataaaaaaccaattacaaagagtatatacacaattttgcatactgctgtttgccatttcccattgtatcaaaagcatttccttatgttgttgcagctgtcacagccattcttcctcatgtgtgtataacatcccaatgagcagatacaccctgatttactcattttcccctactattagacatttggttgctactaaatgtctactaaaatatctactaagtatctactaaaataatgtaggcatgttttggtgtacatgtttatttactcctaacaatttgttttgtacttacattcccagagtgaaattactgggacaagaaagagatatttttatggattttggtatacaccgccaactgctttttgaaagcaacttttactaatttatagggttatcagcaatgtatgagaatgacaactgcactgtattctccctggtatgggatactagtaaacaaaagtttaacctaatatactagatttttacaaaatgattccttatttagttggatttatttttcagtttttgacacagagcctcgctctgccacccaggctggagtgcaatggtgcgatcatggctcactgcaaccttcactctccaggtttaagcgattctcttgcttcagcctcccgcgtagctgggattacaggcgctcactatcacgcccggttaatttttggatatttagtagagacagggtttcgccatgttggccaggctggtctggaactcctgacctcaagtgatctgcccaccctggcctcccaaagtgctgggattacaggcatgagccacggcgccctgcctgaatttaaaaaaaaaaaaaaaagattggcttagttggatttctgattcctagtgatgtttatgaattgcatgttctcttctgaggactgccttatcatgctgctttgccatctgccctctgagttttctatttttcttgttcatctatgcaagcttttaataaagtaattatcttaatcctgtgcacattttatatgctaaaatagtttttcatttgctacttaatgctatttttgaaattcagaagtccataaatttcaccttggcaaatctgacaaacttttcctttgtgattattactattaaattctgagctgagagagctatgcccccctgtcccaaggtctgatatatattgaaatcttaatgtcttctaatttctccatgatcccatttttaattctgtgcacagctggctccttagtcctgctcaggtctcagctccactaccttctcctccgagaggctttctccagatgtcctccagaaggctccaactcccaacttctatcacatcaacctgttttatcttattaataccatttatcactctgatatttcttattttattttattattaaactaactgcctctactagaagacaaacaccttgagaacaggaaggagcttgcctgatcaaccactgcatccccagcatcgagcctggcctgacatgactgacaactcaaaatgtttgctgaataaataatgttgaactaaaaatcaaccagaattgactatagtatagaggattaaatgaaagatatacctctaatactctaaaaactttcatgttaaaatgaagggataaagtactttacaataatgtctcattttagccagcagtatagggaaaccatacaaaattcaatttgataagctaggtcagtggtttataaacatttttttccctctgcacagagtgatataaactttttctttttttttatttttatttttttgagacggagtctcactctgtagcccaggctggagtgcagtggcatgatctctgctcactgcaaaccccacctcccaggtcctggttcaagtgattctcctgcctcagcctcccaagtagctgggattacaggaatgtgccaccatgcctagctaatttttgtattttcagtagagatggggtttcaccatgttggccaggctggtcttgaactcctgacctagtgatctgcctgcctcagcctcccaaagtgctaggattacgggcgtgagccaccgcccaacctttcccttcctttctttccttttttaaaataaataatatttttttcctcctccaaaacagataaaaatattccaagagtccggattcctcaggcagtttatcgctctgtattcagctaatgtattttcttctaaaactttaatagtgatagagtttggaaggattgatagcatatatacttaggataaggaactgataggacttggtgagtacctggacatgagagtgacgataactctcatgattctggtttaggtgacttgaggaaaaggagatggttacccaagattaaaaatacaggcgatgagaacagatgggatggagacaatgttaccattagaatgcccatgggacattcaagtggagaagttcaggaggcaactcaaagcatgtctggagttcacaagagatgctggggctgtaattatagatttaacagccttcagcatacaggcagtaatgaatgaaattgcctgggaagaatgagtaaaataaaacagaaggctaggtagcaaatcctaatgattaatatttaagaggaaagcaaaaaggaaataatgaatcataccaaaagtaaaaactatagtgaccagataaaaatcctcaccttgaaactacaaatctagaaaagatgatgataaaacgagtaattctctgtactgtccattcaattgacatgacatgtgacatgctatttcacagtgggtccttcctggcacccaactccattttgtctgtgactaggctatgatacaacaaacaaattcaatgaataattgaatgtgttaccagaaaaattccctagtcctcccaaatcatcttgacttactcatggaacttaaataacccatcagctgttttgttactaagcaaggaagaagctttatcttccacctgtctcctaaacctgtttctgctccacaacacagtttaatttctattcctcacctctgctctcatacacctactttttattctgatgtaaggcaattatgaagccaggtatctcttaagatccaaaacaacttgtttatggcaattcccttactaagatcataaaaaccaaaataaaagttgggaaaaaatagcatgatacaggttggaaaaatgagatatcatatctatctctcccataacataagcaagctgtctgtaactcctttcacgcatcaactcttttccataaagcttctaatttctcatccaaacaacagagtagcttaaatatatacagtacttctgtgcctataaacattaacaacttcttgtggattggagaaatgactatatataaagaatttcaaccttcacaaaaaataaggatataggctgggcacggtggctcacacctgtaatcccagcactttgggaggccgaggtgggtggatcacctgaggtcaggagttcaaaaccagcctggccaacatggtgaaaccctgtctctattaaaaataaaaaaaattagccaggtgtggtggcaggcactcgtaatcccagctattcaggaggctgaggcaggagaatcatttgaacctgggaggtggaggttgcagtgagccaagattgagccattgcactccagcctgggcaacaggagtgaaattctgtctaaggatgtaagcgtccataatgctaacaataacgtcgctagtgacttaggtgaacaaaaatagtctgctttttactgaaattagttacaggttccaactgtaccattaaggacaacataaaattagagacatatatatatatatatatatatatatatatatatatatatatttttttttttttttttttttgagacggagtctcgctctgtctctgtcactcaggctggagtgcagtggtatgatcttggctcactacaacctctgcctcccaggttcaagtgattctcctgcctcagccttctggtagctgggactacaggcatgcgccaccacacctggctaattttttgtatttttagtagagatggggtttcaccatgttagccaggatggtctggatttcctgacctcatgatccacccgcctcggcctcccaaagtgctgggattacagatgtgagccaccacgcccagccaaaacataaatattttaagagaaacacacagtagtcttcacttgtgaagaatcacttgtgatgcccactgagatttatgcttcagtgagctacacaatgaaaaccttacaggcgacctgcttactggacaagctatactgccgacgtgtgactccaggcaatcaccaagtgtggagggaatacgatgatgaacttcctctcgcaaatggaatacactacctacttctcttctgttactctttgctgatgatatgccagcaaacaatcactatcattcttccgagcaaacaaacccaatcagccttgatgcagtaaaaaaaaggatttaaaattaaacatattttcaacacaaatagaattttgtacaacaggagagaatttttttaattgctaaaagtttattttttctttctattatataaagctaatatatgtttattatggaacatttagaagatagatatacaaaaagaagaaaattaaaatcatccataatcttagctccccaccaggtatagccactattaaataattgcttgctttttgtgtgtgtggttatttttgttgtttgaatagggactgggtttcatcaagttgcccaggctggtcgtctcaaactcatgggctcaatgatctgcccgcctcggcctcccaaagtgctgggaggataagcctgagacaccacacgtggcctgcttgttttttaaaagaaaaaatattatacaaaattaataaaggtaataaaatcaagtctatttagcctaaagcctgaagggagataaaaagcacaaggctatagtcattaaaactcttaataactagacctggtggccaggcgcagtggctcatgcctgtaatcccagcactttgggaggccaaggcaggcgggcggatcatgagatcaggagatcaagaccatcctggctaacacggtgaaaccccgtctgtactaaaaatacaaaaaattagccaggcgtgatggcacacgcctatagtaccagctactcaggaggctgaggcaggagaattgcttgaacccaagaggcagaggttgcagtgagcggagatcatgccactgcactcccgcctgggtgacagagcgagactccgtttctaaacaaacaaacaaacaaacaaactagacctggtgtggtggctcaagcctgtaatcctagacctttgggaggtgagaggattgcttgaggccagaagttcaagaccagcctgccaacatagcgacacacccatctgtacaagaaataaaaaatttaggccaggcgtggtggctcatgtctgtaatctcagcactttgggaggccaaggtaggtggatcacctggggtcaggagttcgagaccagcctggccaacatggtaaaatcttgtctctactaaaaaatacaaaaattagccggtgtggtggcatgtgcctgtaatcccagctacttgagaggctggggcaggagaatcacttgaacgtgggaggcagaggttgcagtgagccagaatcatgccagtgcactccagcctgggtgacagagcaaaatgctgtctcaaaaaaaaaaaaaagatataaaaaatttagttgggtctggtggcaggtgcctgtagtcccagctactcatgaggttgaggtaggagaatcatttgagcccatatggttgaggctgcgatgagctatgatcatgccactggactcctgcctgggcagcagagccagagcctgtctcaaaaaaaaaaaaaataagtaaataaaaattaggggaaaaaaaagtcttaataactacaaaggtaactcactattttggctgagtacttcccatcattagtacccactgccagatataccatcctgaacacaagcaaggaaggttaacccctctcccccaacccaatttttattttgaaaagcttcaaacctatagaaaagttcaaatcaccattcaaatcacctagactcaccaactgttcacattttgccacatttgcctttttgctctctctccacacacacttttctgttgttggatcacttaaaaatacagatatcatgaatttttaactttaagtatttcagcatgtatttcctaagaacaaggacattctaagcgaaaataatattttttatgaactaatcaaaatttgcaattctttctataaggctgaccaagataatggaacagactccataaaactgcgattagcttgaagcattaaagttcattttcttcctctttgctgcaccccatgtgactttcttttggaatacagtttctcaacctcagcaccaatgacattttgggccagataattatttgctggggcgggggtggggtggtgtcctgtggctgcaggatgtttagcagaatccctgtccctttacccactagatgccagtatcaccctacatccagttttaacaactgaaagtgtctctatacactgctctgtgcgcggagggcaaattgcccctggtgaagaaacactgctcttaaagaataggaccccctcaatccagatgaggagtataatgataatgacaacatctattgatctactgaatgcgtggcatatggcagcatgttctaagcagtctacgtgtgttaaatcatttagcccccagaataaccatctgaaatgggtggtgtagcaccttcatcttagaggaggaaatagacacagtgagattaagcacctcatgtgaatgaacaaaccaaagaatggcttcctgcaaaaactgagatccaacactatgtatctgaaccactattcttttttttgagatggcgtctctctgtggcccaggctggagtgcagtgttgcaatcttggctcactgcaacctgtcccccgggttcaagcgatactcctgcctcagcctcccgagtaactgggattacaggagcctaccaccgcacccagctaatttttgtatttttagtagagacggggttttgccatcttggccaggctggtcttgaactcctcaccttgtgatccacccgccttggcctcccaaagtgctgagattacaggtgtgagccactgagcccgacctgaaccaccattcctgaagtaaaaggtaactttgatggtacatactgcacttaaaaaggaaaaaagttcatatgtgaagttaataaaaggatgtaggaaaacaggcactctcatatattgctaatgattgttcacactgatacaaattgctaaactcccctccaggaaggaatcatctgacttaaaaatgtgtatacccttcgacccaacaattcatcctaagaaaataaccagttatacacataaaacagaggtgcagtgatatttactacagtcttttccataacaccgaaaaattgaaactctatcaacacccaaatacagagttaaatgacaatactttcatacaatgtaattctatatagccattacaaataatagagcacatcaaaagatgttcgtgatatgttaaagtaagtaaattataaagtagaatgaacggcataatcctagcaactataacacatagaagcaaaaatgttaaatgtgattatctccaaatatgagattctagtagtgttgttttcctttagcatatctgcattttcctttttttccacccctgttttagtttggcttttatttaaaagtcgttttgttttttttaatttattttttgactgcttttgcggagcaggctatcctataagcagtatgctgagagtagcgtattcagaagtttttaaaatggaagttcagatacaaatgaaaaggagatccctttgacactgacagaattaacatatagtttcaactacttgtactcaattccaaagacccatagtatgttacaaaaatgtgtggttcctattgctgaacacattgtgaatggcacaccacagaatgggtaggaaaaagtttcttggttagtcaccagggccggtcagttgtctagcctccacaccttaacccagctgagatgctgcgggatgaactctacaggtgatctaaagtgaatcccagagatgtctaggaaactgaccccgattgtggttccagagcactgagttcaggaatgtactcggcctagactaaaacagcctagaaaggctgaagctgatgaatgaataatttgttatgtctgatcctgattctgtcacactctgcgaccatactgtgtggcttaactccaggactaatgagggcacctggcaggcgaggcattctttagtgcatatctagttatgactggacctagagggacccagaaggtgacaggtacattttcaggctatcatccacaactgttcaccctttggagaaattttatttaacttggaaacatggcccatctctatcattaacctgtctgcactgacttttttttcttttcattctttagataagcaaattatttaatttttacccaaatggtatctctgtctggtctttccatcaatccacacccaacatcatcctttgtcattaaaacagttgtgtagttctctactccactaaataaactacggaaacatgcaatgtttttcaaaaagtggttttggaacctctgaggcctcatgaagtcctcaggaggtttgaatacagagtgctatgttttagcccatccacagttggtaccttcatctatcactctggagtgctgccctggtacaagaaaatatcaagtgcctgcccctgaaagcacacgcccactcctatgaaggactgcattggtactacagtcttttcctgccatcctgtacctctggtaagatgaattgttccacgggcttgtaccacagcttgttcacctgcacaccacagcttggaggactgaagcgagcaatgaagagggcctcctacaaattgggagaaaaagacaagaaaaaatacttcatgttatacattgcatatgcaaaaagttttcaaacaccttacttcttggtcagctaaatccacaatggccctaaccacggtcactaacatggttctactgtggttttggcatcactgggttttctagtgcagtcatggttattaaataacgatatttaaggtaatcaaagttgtcacgaaattctcaaatgctaaacataatccacataaccttaaaaaaaaaacccaccttgaaagaaaaaatattcagggaagtgagcagtgttgttaaattaagccaacacattatagtgtcaacactcccccaaagggttaaaactaaactgaaagacacagatttttactgggaacaaaagcactcaggaaactccgttcaaaaagaatcttcagaagaaaatataaacaaaacaaaaaagggaatataaaagaggactggagccaggtgcagtggctcacgcttgtaatcccaccactttgggaggctgaggcaggcagatcacttgaggtcaggagttccagaccagcctggccaacatgtgaaactccaaatttctactaaaaatacaaaaattagctgggtgtggtggcaggcacctgtagtcccagctacttaggaggctgaagcaggagaatcgcttgaacccaggaggtggaggctgcagtgagccaagactgcaccactgcactcccgcctggaccgcagagccagactctgtctcaaaaaaaaaaaaaaaaaaaaaaaaaaaaaaaaaaaaaaaaccggactgattttcactatgtctatcgttttcttgggtcctcccatttcttccaggcaacatttcctcattctcatgcctattcttatataccaacttaaccataggggaaacttctgttaagctcttaaaaccatgcaggggttcaaaattaagcacatttcaatggattatgtctatttctttcatgaacaccagttcttagcaatgcagtataagaatagtttttgcatcgtgactacccatgaacccattagcatccatcttagactagtccttccttgaggacaaagattaactcctccctggttaaaaatatggcaactagaagttatatcgacatgatcaaaatattgtatgtctgaaccaaactacttgattgataactcgcacactataaatagttttgttttttgagacagtctcactctgtcacctaggctggagtgagtggtgcaatcacggctcactgtaatgcagcctcgacctcctgggctcaagtgatcctcccacctcaacctaccaagtagctgggactgtaagcaaatgctaccatgcctgcctattttcttaattttttgtagagatggggtctcactgtattgcctaggctggtctctaactcctgggctgaagcaatccatctgccttgccctcccaaaatgctgggattacaggcgtgagccattgcgcctggctgatagttttttttttaaactatatatactaagataaacaagtgtatcaaaaaaattcaagattaattctaatttctagataacagtgatactcagagtactgctatttcaattacctatttgatcttcagtatcaatgaaactgttaactacaatcatatatggactcctatagttgagtatacaaagctcttctcactaatcattatagctggcatcatcagtagaaatcctactcttccctctgtcttatatttatgtctataaacacatcaacaaacgagacagattatttagaggaagaacagggcaaattccaaaaaagaaatttaatctcaaatttatttgtgtatttattgatgagtctctaacattatattcattgctaataatcaacattaataatacaaacacattttaaaaaactgaacagagttctgctgccagtaatatcagaccaattctcctatagatagtaactatgaactctggatgaaacataaaaaacaatgatttgaaggcactggaattcaaacaaacaggcagaaactagagaagaatcagtacttggaagaaggaaaaggctccaaatatgcatctcctccctaccccacttcttgactctttgtctgaggatacaactctagggtaactagaaatttgaatgaaaatctgtagtctttctgcttgaaaattaagaggacagagttggggcaaacacatcaattaataaaaggcattagggggaacctcccagaaaggaaaggatcacagagagagagaaccacaaattcttcatataaactctacccaaatctgtggctgactcatgaaatacacatacaaggcagaacccaagtagcccatccaaggccagagaaactgaatagagattttagctgtttctcactgcaagtgagacaatgtttagtctgtgtccagccaatttagctgcctgctaaaacaaaaaaaaaaaatcaatactctgaggaatataataggatccagagttcctacaatgaattatttacaatatctaggatacaatgcatgagtagcatgtagtcccagctactcaagaggctgagatgggcggatagcttgagcccaggagtttaaggctgcagtgaaccacgactgtgccactgcactccagctcaggtaaaagagcgagaccctgtcaaacaacaacaaaaaaaccaaaacccaaaccaaaaaaccccccaaaatactagacataaaacagaaaaatgttacccatattttagaggaaagataataatcaataaagacagacgctgagatgactcagaataagcgtacacagattttaaagctgctgttataactatggtcaaagctgtagagaaaaatattctcaaacaatgaacacataggaaattttagagaaatagaaacagtaaaaaagaactaaatggaaactgaagcactaaaaagtataatatttaaaataaatctaaaataaaaaattcattggataggcttaacttcagatttgagatgacagaagagtcactaaacttgaatacagatgaacagaagttatctacattagaaaagagaaaaaacactgaaaaaaatgaacagtcttgtgatctgcaggacaataccaaaagatctaacatacatgtaattggaatcccaggaggaatagagagagcgagcgaagtcagaaaaggttctgaagacattaatagttgaaaatcccccaaatttggtaaaatacatacatttacagattgaagaaacatgtagcacgccctgaataaaacagacaaagaaaaagcacaccaggcctggtgcggtgcctcacgcctgtaatcccagcactttgggaggctacttgggaggctgaggcagcactctgggaggccgagaagggcagatcacttgaggtcaggagtttgacaccagcctagcccacatggcaaaatcccatctttactaaaaatacaaaaattagccaggtgtggtggcatgcacctagaatcccagctacttaggagtaataaaccaaatacaggaaaacgttaattgttgtagaatgtagttagtggctatagggtttaccgaataattccttcaagttttcttcatgtttaaaactaaaaaacagatccttcaaatacatttccatgctgctacttcacatgcactctgtgaacaaatcagatttccctacatatcgggaatagagaaacctcactggttttctgttttctgtaaaagaataacttttattccctctatatccttattacaaaaaagatttgaagcagttattagccttgtattacagacttctacagttggaagtaagaggcaataatactcacttatcctaagaatcctaaactttttttatatccattaccaacttttgaaattccctaggttttagggaattttaggttggagatttctaatctagtcaactccttctcttctagatatagcacatttattcacagataatctatccccaaaccagtcttatatcacactacagtgtatttagtcaataggggaagaaaggtgaaagtctctcaaccagagagaattatatagtcttccaatctacttactgtatgtcacaaggaaaagttgatgtttttgaaaaagaaaaaagagaaaaaacctgtacagagcagggcatacctcttgttctgcctgataaagtttgacagtgatgttcctctggaaacccacatcattggcatcgtagaacactccaagactggtaataacgatggggtagagaactcggaaactcacgctgacaactcgatcctcaggcagccccgatgaagtgtcttcggacagactgaacgcttcaatttcctgattcaaaactaagtaatgagaacaggtttatataactgaacaaatgtaatcctttgttttactagtaagaagtagtgaagtgggcttaatgccaaaacctaggtaatcatttgctatataattcacaaatggcaggaatttttaaaaaatgcttgagaaaaatggctgcttctatataaacatttttgaaatttaagaatacagttttcagccacatctaagtaagttaattatcagaactgctttaatagctttttgcataaatgtgtgcatatatatgtataaacgccacaggagatattaaatttaagtcaactggaaggcatctatttggaagggttggataaatagaaataagaaaaacagtactgactgtagtcataaataatcagtaaatttggtcttactgtgcaaattccaaaaatcctacttcttgttaggcaatttaaaatacttgtgatacatcaggcaattattacggtataaataagcaactgaagtcacttcaaataacactgaaaaactcttgctgtacagcactgataaaagataagcatatcaaacacagttttgaaccatcttctatgtaccatttcccatcacatttatatcttcactactacccttgtggttgtggcattatctccagtttacatattaagaaactgaggcccaaaattaagcaattcacctaaggtcatagaaagtggcagatccaggaatcaagtcccatttagtgattccaaagtcagtcccctttccactccctcacagctgtctaatcagtgccaaaacagttcaaataatttttcttttatttcttcttttgagacagtcacccagtcacccaggctgcagtgcagtggcatgaacatggcttattgcagtctcaacctcctttgctcaagggatcctcctgcctcagcctcctgagtagctgggaccgcaggcacacaccaccaggccttgctaattttttgtagagatgggggtctcatcatgttacccaggctggtcttgaactgcaatcctcccgcctcagcctcccaaagtgctgggattacaggcatgagccactgtgcccagccttcaaataaattttctaattaccataaatgaatcagaatacattaaataaagcagttcataggcagggaatatcagtgctactttaataatataaaaccctattttaaaagattatatcaaagttctttgtatcttttagagctgtggttttcaaattttgctgactacacaacaccatcagttaaaaatatttgtacacacacctatttacttacaaaatatatgcatatattgtggtgagtctatatattcagtattaataaagattgtattttcttattttcagataaatagaaattctaagcctgggcaacatggtgaaactctgtctctacgatacaaaaattagctgggcgtggtggcacacacctgtaatcccacctacttgggaggctgaggcacgagaattgcttgagcctgggaggaagaggctgcagtgacctgagattgtgccactgcagtgcagcctgggcaacagagcaagaccctgtctcaaaaaaaagaaattacattttcttcctatactctaggtcatttggttgcccacgtcagacttcctagaagctctttacactcagtagatattcaataaaatgggattaaagggaagtgatgactcctacctaattatagacatgaacaggagggaaaaaagggagaatacagttttttgtcatgggctgggcaagcactaactggagagtctagactacaacataatggacaacaatacaattttttctctttaagatattcagtaaataatagatatccatagtagaaacctctttattaaaagcaataagtcaattataatatagcatttttagatattttcttatctaaaagaattgtgccttgagcttcaagttacgtggacacaggaaatcccgttgcattacagtgctattaaaccttctaccacagccacagtatcacgatgattaatgcttaccatgaccttcaggtactgaaataaccataactgcctttggatcatcgaaaagataagattaggttcaatattaacttagttatatacacatttaaaaattcataacctaggtattacatatatgaaaatgttcttttaacataaagttctacttctttacttttaataaataacagcacttaagataataaaaatatggttaatttaaaagtgaagggcttctttttgttttggtttggttttcaattgtaatttgttggaggatacatcagtggataccacatcagtgacataacattctatggggtttatgatccctttaagactccagtgaggccaggcgtggtggctcacgcctataatcccagcactttgggaggctgaggggggtggatcacgtgaggtcaggagtttgagactagcctggccaatgtggtgaaaccccatctctactaaaaataagtcaggcgtggtggcgggcacctgtaattctagctactcgggagactaaggcaggagaatcgcttgaacctgggaggtggaggttacagtgagccgagatcgcgccattgcactccagtctgggtgacaagagcgaaactctgtctccaaaaaaaaaaaaaagacaagactccagtgaaagccaaaggactttctccccagcacacaattcatacataaaatttgcttacaatgttaactgaattcacagacatcctaagtaagaaacctctattttgtaatacagacctgaatatattgtccaatttatttaaaaagctgtttgaaacccagctttataaaatagcaggctctttaaaataatgttcagtaccttccaccttctaggaactattattctaaatacatcatatgtatcaacttatttcatccttatgtcaatccccatgagggagattcttttatcccaagtttacagatgataaaactgaggcagaggaggtcacacagctagaaaatggcaaagcttggattgagagccatggagactgcttataaaagtgaggtgttacttaattatacagttttaacaaaccttaaaataccagaagtcctaatcagcatatttaagacttggaagtataacctcccttagaaacacagctgaacataatgggaattgctaataaacacagacagttaaaaacttatcaacttcctaaaattggttccctggtgacacagagaacctagttaggatcagctttctttcgttgtctttgtttttgagacagggtctcgctctgtcacccaggctggagtgcagtagcggaagcagatcatagcttactgcagcctcgaactgctggacccaagcagtcctcctacctcagcctcccaagcagctggaactacaggcatgagccacaatacttggctaatgttttttttttcagacatgggagctcactatgttgcccaggctggttttgtgctcctcctcccaccgtggtgtcccaaagtgctggagcagctttctttatcctcaccagaatttttacaaacttttaattttaaggcataaataatgttacttgtgtcttacattttttactattttttcttttacagaaataaattagacaataattctaagagaaagttgattcataatatttgtttcttcaagattattataaattaactggtaaaatcagcagttttccaaaacttcaaaatttggtaattcaggatttatctaagcataaggaacttccaaacgcgtatgaatcacactgaaaaataaagtctcctggatcctaaagttccaattctgtaaagaatctctacagataccccaaggcaatctgtcaaaaatgatgaaataggctgggtatggtggctcatgcctgtaatctcagcactttgggaggctgaggcaggtggatcacaaggtcaggagttcgaggccagcctgaccaacacagtgaaaccccatctctactaaaaatacacaaattagccaggcgcagtggtggtagcctgtaatcccatctacttaagagaggctgaggcaggagaatttcttgaacctaggaggcggaggttgcagtgagctgagatagcaccactgcactccagcctggacaacagagcaagactccatctccaaaaaaaaaaaaaaaaaaaaaaaaaaagatgagacataaatttggatgacagacattttagtctattaaaaacagactccagggcatggtggctcatgcctgcaatcccagtgctttgggatgctgaggctggtggatcccttgagggtaagaattcaagatcagcccagacaagacagcgagacctcaactctacaaaaaatttaaaaaattagccagttttcgtggcatgtgcctgtagtcctagcagggtggtgaggtaggaggatcgcttgagccccggagtttgaggttatagtgagccatgactatgccactgcacgccagcctaggcgacagagcaagaccctgtctctaaaacacataataaaataaaataataaaaaataaaaacagactccatactattaagcttagcaacttttactcaacatcaagcttgtgtatggcagtcaagggaaaagatgacttacctggatttgtgatgttgagtagtttacaggaataaggatcttccctgtcttccacaggcacttcacagccatgagcacctattatgaacttcacaagcacactgagagatgtgttggcattaacatcagttactgatcttcacctcgcacatgcacgtttcctcatgcccatttcagagcttttactttgagacacaagtgtttatgaggattaattctctacctttattcttctagtcagacaaaatgggggaacaagtaaactgaaagttgctaactaccaagttacttatgcatgagtcctttattgcaatgctatattaaagcaagtatgaatatgtctggcctcgctacaagcaaatgttcatatcatttaaaagcaaactatagtaaagtcagttctcatgcccatacctaaaaacatatctatatctaaaattttcctttgctgccttcttctatttcagaaagtgttccttttgctcaagattaggtctttccatccaagaggaaatccccttctctcctagaccttgcttcactggttacccccgtaactagtgactccttccctccacattacaaacatgataaagtcctgactctaattattctcttcaccttccatccttccttgccaccacactttacactgaggtcctacaaagaaattaaaactgcagcctgtttcttacttcccactcattttataaaacaagagttttagctttaatatcaccacctccactgagattccactaatgtaaccaatgagctgctgctaaatcaatagacactcttgaactcttaccttcctggtttctctacggcttaatactgcccagctccctaaaatgctctcttcccttccttctgtggcctgctcagtcatcttcactgcctcttgttccccagcttgtccactgagagtggtattagtctagggctctgcctttgggtcttttctcaatctactcattttttttacttcctctccctaaacaatattatttattctcatggcttcaaatagcatgggaatgattcctgaattagtaactccagttgttttctttttttttgagacagagtctcgctctgtcacccaggctggaatgcaacagtgtaatcttggctctttgcagtctccacctttcaggttcaagtgattctcctgcctcagcctcctaagtggctgggattacaggcgtgtgccaccacgcctggctaatttttgtatttttagtagagacgggatttcaccatgttggccaggctggtctcgaactcttggcgtcaagtgatctgcctgccttggcctcccaaagtgctgggattacaggtgtgagccactgtgtccggacctgaattagtaactctagtttagacccatgtaaaggacctgtaaattcactggacatcttcacccagataacccacagacagctgtgtgctaaagcctgctactactggcttctgggagccaactgtcaacttttcagaaattttgtgagacggttattaaacatagcctttatttaaaattaaattatataatcttataatatatattaaaatcaaaggaaatactcaaattaatcacttaatgttttactacattttactattatgttcttgagatcatttatatttattacatctacatggtggaaatagtatatatggcatgctactgcttatctttcccccactctgtgttcagtgatgtcacattagtcacttgaattggccatagtggaaatattcacaccctagaaactggcaaataatacaaataagggtttggtttattgttttgttgactgtctagacttaagaaagtatagagaaaatgttgataatgcaaattaagcttaatgtgatgtgtctatctatagccactacagagtgaatagttaaaaaaaaaaaaaaaaagtcaaggaagatacgattccagtgttccaaaactattacctgatacagcatagaagtcactgactttattaagtgtaaagctgacatatcttagttgtcactttagtcctcacctcactgtttaacttaaaagaaagacttttgtcacaactacactcttttgttaactgcaaccataagttggtcatagataggagagtctgacaaacaacaaaagcgttctatgagaatcaactggtttcatggaatttacgataaacagtattgtataggttattatctgtcaattacaggctgtatatactttatgtcaataaaatttataataaacatgtatgtacatataagcatcatttttcccagagagccagttagtaaacctttatcagtacactactgcctgtaggaacctcaaggtcaacatatacacaactgagtttctttcccatgaaacctgctcttctcttttagtatttttgttttgattgatgattccactattctccaagtcagaacactagcaatcttcctagcctcctcctccattttctacattcaatgaccttattctctcacaaggtcacccctctgatctctgtagatcagcccctcagcagtccttgccacaacaggtctcgtccttccactcaaccctccacatgcctgttacatgtgatctgctcactgtctgcctctcacagtcatatgcttcccccctcttttctttatatacacctctctactctcctacctctcctggctgtttctctcacactgtgccacaacccttcccccaccaccacaagccctgtgctcaagttatatagaagtgttaggagtttctcaaacaccccgggctattttatatctatttatatcacagcacatacaacattttattatacgattacacctatttccttctactaaatgtcaagcccctcctaacactctatttatctctgtattctaccacacatactacattatttgcttacagaagtacttagtgttgagtttgggtcctttggtgaaatgcaagaatggaaaatatgccataaccacagaaatgcagtttctgttactaattaccaattaaggcagaatacctttcatagataactagcatttggaataaaagtataaacagaaatgaataaatgtgctaactaaattattgcaagtatgtaccaaatttggttttttagccatcttactaggtactcttactagatccacaaaattactgtgtcccaggaaggtgtttctgcctaatatctatttttatacagatagctgatcattctcataacacaaatcaagcacgctaaatttaaagcaagactgttatgatggcaaataaattagtggtgaaatgtctgaatataaactatattcattacatttggttctgagtcattcattcaatagttgttgagtgccttagtctgcaccaagctaggttttaggtattgggaatacaccagtgaaaaaacctgaagccccaatgctcatgaaacctacattcaagtggagaaagacaaacaattttacaactaaatacaatacagatgccagctggtgataagtgttaccaaaaaaaaattaaagccaactaagggaagacacaaacaagataggggtgggctgctatttactatggggctgtctgctagagtgacatctaatcagagacctgaaggaagtgagtcctgaggacattagtgagagaggacgtaggaaatgcaaaggccctgaggtaggggcacttttagtgtatgaaagtacagtaaggcagccagtgtaggggaagtagatgtagataaggtcaaataccacaacaaagacttggagtttcactctgagcaagaaaggaggtcaatggaggggtatgaatagagaattgacataatttgactaattttaaaaggatcactctggctgctgtatggaaaataaaatgtagggggtcaaaggtagaagcagtaagttcagagaaggggacttctgcaataatccaggtgagacataatggcagcctagatcagatggcagtggtaaaggtggtgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctaatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttgggaggctgaggcaggagaatcgcttgaacccaggaattggaggttgcagtgagccaagatcgtgccactgcactttagcttgagcgacagcaaaactccatctcaaaaaaaaaaaaaattcacaactgcaatttgcttgtatagctactcagtcacaaatgtgccagtgcaattcaatcctgaaagggccttctctgcttatcacctgagtcttcacatacatagaagtcaacttctatgcgtttcttcccctagtccctcactacacaatcttcagaggttgatctcattgagaacagactaaggctttgggcccctaactaataactgagagctatctaatgtcagcatgaaatggattaccaaagctcagttccagaagggtagtcaggaaaaagagcatggcatattacacatactgcagattacacaactaaaaaatactacaaaactgaaaaaaattaaatttatctctgtgaagttagtgaaaagtatatttagacatgcacatgtgtctaaggagagaactgctctagaacagaaccttttaagaattgctattctaaatcaaagcaaaaaacaaacaaaccacactgggtatctaaatactacacatgttaaccagtgaatatactctcttccaattatcatttggcttaaaatgttggttaaatttactttttggcccaaactatatggaagaaaagcaaatgaaacagccatttctcccaggaagagcccacatatctgaatgaacatttctattcaaagtaaggtttttcagaacttttttttttttttaaattaggcagggactcattcccatcatgcaggctagaatgcagtggtgcaatcatggctcactgcagcctcaattttccaagctcaagcaatccttccacctcagcctccccggtagctgggacgacgggcacacaccaccacgcctggctaggtttttcagaactcttatttcaataaaccaggcaaggcaacaactcagaaaacctaccgttgacttaatgtgggatgctgtagcaaatgtctcatccaggtgcttcttatcacgtttcgaagttcatggttattgcgagctgacaacacgccaactaccacatcatagtgagtagatttccactgaggaaataaggccaactgatctagaaataagaacaatacatgagaaataagtcatgtatcaattactatgaagttcaatatgtatcataagtttattacaaaataagcttatgtttgtaggaaattcagataaacacaaagaaaagaatttttaaatcacatatgaacccactatccagagacaaccactaataacattttggtttagagtatttttgtctttcacgtatatatgtatgtattcatgctcacgtaagtatactaattcttcaaaacaaacaagatgtggtaagaatctgtttcaaaaggcaacgtagcataaaaaaatagtaggcattaagagtcaattaggccacagttagaatccaggctctatcatatattaactataagttatttagcttcttgagcctcagtttcctcaactacaaaatgggtataataatacttctcataaagctgttgtaaaaattaaatgagataacatgtataaagctcttggtttggtattaggcatatatgaggcattcaatggcaactaaaaaaaatgtgctttgaaaagtgaggtcctacattaatgttagttattaagtttggcggatgacgctgaaggacttccataccggaaagtaatgcaacccttatttatatcaatgaattctatagccagtaaacctttcactacctacaaaatattctgaagaatgacgggaaagcaacacttttagtaaaaaaaaaaaataataataataaagtaagtcattctgaacggctcattttttactgtcagaaggtctaatgggcagggttacatttccatgtaaaacttgtccttagaagacagaagagaaagatatactttgtccttgtttttcatcaccagttttaaggcttgagagctacaagcttatatatagctctgatgaggtatccatttcatctctttctccagtggtgggaactgatccaaaacgtttccaaaaataaattattgaagcccagactctttactatattaaatgcaatgtttttatataccatgggatctaggtattcagtctaaaagacaacaaaaccaggttgatattttcttcaaaggcccaattaaaataataaaaacagatctttctactaggatagttttaaggatataatacagaaatttttgtgtagataccttattttccacaatagatatatttcttaaaatgtttcattctgggccaggcacggtggctcatgcctgtaatcccagcactttggaaggccgaggtgggcggatcacctgaggtcgggagttcaagaccagcctgaccaacatggagaaaccctgtctctactaaaaatacaaaattagccgggtgtggtggtgcttgcctgttatcccagctacttgggaggctgaggcaggagaatctcttgaacccgggaggtggaggttggggtgagccgagaccgcgccattgcactccagcctgggcaacaagagtgagactccacctgaaaaaaaaaaaaaagttccattccaaatggaatagaggtatttattatttcactctacaatgagtcatgtactaaaacgaattcttttataaagacaatttatttttaaataaattcaaattttcatggattaagcttattaataggccatatttattgaacagttaatctgtgaaaagcactacatatagagtatcatttaatgttcacaaccctatgaggtaggtacttgtttctttttttttttttttttgacggagtcccactctgtggcccagtctggagtgcagtggcggcgctctcggctcactgcaacctctgccgcccgggttcaagtgattctcctgcctcagcctcctgagtagctgggattataggcgcctgtcactgtgcctggctaatttttgtagttttagtagagatggagtttcaccatcttggccaggctggtgttgaactcttgaccttgtgatccaccgcctcggcctcccaaagtgctgggattacaggcgtgatccaccgtgcctggcccagtacttgttgaacaaatgaaacacccaaagaattcagtaacttaagtcaaacagcttggaaatggctgggctaagatttaatcccaggcaatctaacaccattctttatcactgttctattctaaagctatacagcttaatatagcttatctgagtctaaattctgatcttttaatccacaataccagttcaactgaattagcaataagcggatcattgaatacgctgggtaacacatcaattttttttaactcatagctcagaacattttttctcagatacataactatatgatggaagttgtacctagtgctggaactcactctaaatgagtgtctgaattcagagactaatttaaatgactatgtaaaactgacaatatgcctccccacctttttcacagagaaatatgtacattctagtgtcaggaaggaggcaaaacaaaggtagtgaccagccagttctgacattgattccacagccaagattttgcattacgttagtaagaaattatttaaatccctgtgcttcaacttcttaattagagaaaactgatacaaaaaaaattttggatattctatttcatttgtttcaaagtctcatctcaaaagattaaaagctgtagggcaaaaatcacatttaatctaaatgcctcatttatctgacatcatcagaaaataaggatgctgcacaaaagcaaactttcaaaatatttgaaacatcacttttaattccaataatttactaccttatttttgatggctaatcaaagcaaatcttttagaaatagattacatagaacataatttaatcttttcttgatgtctcaaaatcttcatgaaaatttctcaaatctatccctttcttgtcattaattctagctgctgctcagttcggtctgttttttcacctggaccagtacgagggcatcctaactggtttttacctgacttctccatataattgtcaaacaagatttttctaaaaataataaagaaatacaaagataaccatgtgacatgtgaaaatcccatggattatggatggaaacctctttttgatcttattccacctctctgccactctcaatcccccctgcttctaatccatgtctaagctgcttctgttcaactgctttactttacatgcatttctctttttcttgcagagggaaagtaacacggcatatcgtggtcttttagagaactacttcaagatatattgaagtcaaatgtcagaaaaataggttttttaaccacataccattaatgtaaattagtccaatagactcctgagtactgtgttacacagtacaaaacccaaagcagatgcataataaaatacctatgtaagaatgttgctcaaatttctagctccctttaccaatctagctctaaactcttatcaccttttatgttacaagaacagggtacctagttgactccagtgtctagaaacagagggaaaaaaagaaagtggtaagaagtaaacatgatacagaaggacataaagataattcagaaaagaaaaaaggcaaatagcaagcctatgaaaacatgttcaacttcaataagaatcaagtttgaattagagcaatgagacaccagttttctcctacattcaaactgacaaatgtcttcttaaatgattgtaactaaatgatggtacttcaaggaaatgttgttagtgatttcaacaaagtggctactctccgccgggcacggtggctcatgcctataatcccagcttcaattttgggaggccgaggagggcagatcacaaggtcagaagttcgagaccagcctggccaatatggtgaaacctcatctctattaaaaatacaacaaaaattagctaggtgtggtggtgcatgcctgtaatcccagctactcgggaggctgagtcaggagacttgcttgaacctgggaggcagaggttgcagtcagccaagatcccgccactgctctccagtctgggtgacagagctagactccttctcaaaaaaaaaaaaaaaaaaaaaaggctactctttttcattgcgggaaggaatgtaatttggtacagtcttctgcagggcaatttggcaatgtgtcaaataatttagaatggtgtaactttgtccagcaattctaagaactcattctaaagaaataatcagtgatacactcagaagatctttattaatcatagtgtcacctattaatagcgaaaaactgcaagctacataaacacataaaggactcattaaataaattatggtgtagctatatgacagaatactatgcagccattaaaattacatgttaatcatatcattaaacattattctattaatacatcatattaagataaacaggcgataggaactatgtagatactagacggttctgtttatataaagtacaaaagtagccaaatttctgccactggttactatccctggtagtgacaaaacagagcatgaagggaacttctgaagcactgatagttttctttttttaaatctgggtggtgattagttgggtgtgttcaatttgtgaaaatacatcaaactgcgccagttttattctcttgatttattcactcaaatgacagagcatctcctatgctcattgttctagatggcacagatacagcagtaaacaaaatcttcataatgtcaggactaaatcacaatcccaagcaagctccctgagggcaacgtaagggccaagggaaagttttccctctgaaggttcggtgaaaatcactgacaagagatggacaggagaaaaggcatataaatttatttgatcagtaaagatacaggagaaagtgcccatttctgtgcttaggtttaacaaagtatagatagctatgtggaattaagattggacagaaagggtaggatctaatgttaacagatggagttggaaaacccagcaaggcctgtctagattcttcttgtcctctctgagtatacattctttcctactgggtatgggataggaccctctctggtatgaggttcttatgacctgtaataaaagaaggtaagttaggtaatttttatatagaaaggtggtggtgggggctagttagagtaatatgtttaggttttatggctggctttggggaagagggattttagtttctacagctagcctcaggtgagaatgcaaggccagagagaggacagcagcagcaggtcagagacagctgcttctgaggccttattttggggtattgttttcttctgagaccctacagtaagaactatttcttttcttaatatgtaatatatcctgagagtctggcaacctgctcaaccctgcactgtgagtggacatccaaaggtatattaaagtctaagggagggcctggcgcagtggctcatgcctgtaatcctagcactttgggaggccgaggtgaatgaatcgcttgaggtcaggagttcgagaccagcctggccaacatggcaaaacgcagtctctactaataatacaaaaattagctgggcgtggtggcacacacatgtaacagaggctgaggcaggagaatggcttcaacccggaggcagaggttgcagttagtcaagatggtgccactgcactccagcctgggcgacagagtgaaactgtgcctcaaaataataatcaaaaaagtctaaagaaggttgacatcaaaattgattgctcaaaataagcccaagagtcttaaaaatcagaccaaaattccactctgatatgcatgctcttggaagagtcacaaatagatacaaatcttgaaaatgaagaaaacatgtgagcctgtcacagatctaatgataaagacaatcatcatacacactaccaaagacacctcccaaaacaccacactagcacaggcatcagcggccaccagactaccactcctctctcaaactcatggagtgtttactatgaaacaggcactgttgcgggtgtttcattaattgaatcttcacaataagtctatgagatcatcatcttataaataaggaaactgaagcacagagacacaattagcatatagggataattttggaagaactcaccccaggcaaaattacaaagcaagctcaatttgttttctgaccttctacttgctctacatctgtttccattagatactgtgagcaccttgggagaagggactaggcatccagcacagaatctaacactcaagtacttgttgagtgaatatgctcctttgttttggtttctttctttccagataccctagaaagcgaagccttcttttgtcacatcatttttctaaattaaccgttaaataattcctacttaaggcattacccaaaacgagcattttgtaatcaagatatcctatgtttagattccttagtccgatggttatctccacctgcattttcctctgtcaccctcaggtgtactggatttcacttcctctttaccagttgctttccctgactggtttaagggaacctatcacattaaaaaagttgctgattctggtactaaggtgactcacttacttcattctggtccctgctcaactgttacctcttcagaatggaatggacttccctgacctatttaaaaccatctctttaatctcttaacactgctttatcttttttccctatacttatcactaccgctgtgatatttataattatttcctgatgctctgtcttcccttctaaattgtaaactacatgagggcaggaagtttagcttgattactgctgtaattccacacctacgataggagctggcacagagtaggctctcaaatatttgctgaatcaactgcgagccaaagaaccttttttaatattcagggaaggtaaatcgctctttcaaaaaaaacaaagaaactgccattacttaatgagactgaagacagacaaagcagcagaagaggaaaaaaaatacatttaaaaatgttaattcaagaaaagaatacttagcaaaatcttgggtttttttttctcctgttaggcttaaagtacaagggttaaaatgtaaaaacacccaactattttagtttcaacatggtgacagcacaatggtaaaggaattatgggaaattttagcatttaagatgcttccactgcttttagctttgaaagtaccaaaaggaaaaaaggaaaggtaggagtcagtcttgtttaattaattaattaattattttgagatggactttcgctcttgtcacccaggctggagtgcagtggcgcaatctcgtctcactgcaacctccgcctccgaggttcaagtgattctcctgcctcagcctccttagtagctgggattacaggcatgcaccactatgcccggctaatttttgtatttttagtagagacggggtttcgccatgttggccaggctggtcttgaactcctgacctcaggtgatccacccaccacggcctcccaaagtgttgggattacaggcgtgaggcaccgcgccgggccagtcatgtttaacttagattattaaaatatcgatggttgacagctgcagcaaaccaccatggcacacgtttacctatgtaacaaacttgcacgtcctgcacacgtatcccggaacttaaaaaaaaatcccatttattatctgaccagatatacagtactcattcaaagccaaagttaattaacataactagtattgatcttcttacctacgttattaccctgttcctttctatggtctacttcttcatttccttaatctagcctggtctaactactggatggcagataaaggcatcatccttcaagtgcagtaagggagtaggaaaaacttgtctcaaactagaaaactgcctagcaagtctactaagatttcagtttgaagtctactaacatttcagtttttgtttgttttactgaaccctaaacaaccattaaggccataaacagacttaatgacgctctacaaggagattccagcagggctcactcataacaaaagagagaaacctgtaacacacaagcagctgttacaaagcattttttataaatggcgttctcttcttagttcacttcacaaaaacctaaaaaacactgagcaaaaccctgaccccatcaactggttaagtgcatagcaacactgtactttcattaaatcacttaaatagtgtttaattctattcaggtcacacaaatccttttcaaagagctagtgatctaataggaaaagagattgttaccaaaataacctcaacataatttcatataactgagactgttttgaggattgccgaatactttctacttataaggcatagagtgctgaactgcaaacactcaattctaattttaagaacttttggattagaaaacagctgttttggggagagatggtaagggaaaaaagtgccagtatagttacaaaattaagtattacataatatttaaaagagctttctaggtttctttcatgttctagggcaagcccttaaagaagaagacaagagatacagggaaagctaaagtagtgttcagggtggtggaacccactaacaaaacaatccgctgggcaccgtaagtaaagcattctattaggctgtgacgcgaaacaagaacaaaggtttcattcctacgagagattaagttttagagcaaatggacacgatcgttaaagaatttgatatttccatgtaaactgcattagcaggttatgcgatccaaactcacaggaacaactccaactctcggccatgccctatttcatgtctagatttgtttaaccgacttacatcataatccaagaatacgaactacagtatattcttacagcaaagttattccttaaaagcaaaaccgagccacctttgaaaacacgcacacacattatccacggcactaaaaccccagtcttgaccgagaaagaccaacaacttgggggggaagaaaacaacttcagagccagagctcccaaagcagaaagcgctggcggctgaagggcacacgaggttccgctcccgggcgaacgggcggcgtcggacatcactaaccaggcctggggacgggcgaaggacttgcagctgcgggcgccggctctgcgggcgttaaggcaaacggggaagtgagaagcggcggggacacgaaaagagaaaagctccctcaagtttgcccgatgttaacgctccaaggatgaaaagagccgtttgtttcgtctggggaccgtcgcgtttggcccttcccccgcctccaacaattcccggcgaagccccgcggcaccaagccgggcctcccacccccccggcggccgccaacccgcccggccccaggacctcacctgcagggccggccccggaggcgcaggcgggcggcggggagcgcagccgcagccagaggtgcagcgcggccccgagcacacacgggcacagcagcaccagccagtttcgcattggccgcccccgccgcgagccgggctctcccgcgtcccggcggagagggaggggacctgcaagtgcggagactgaggggcggcggctgacgagcgaccactccgagcacgcccgccctcgcgctcggcgacgtctggagggctcctcgcagctcccggccccgctcctccggtccctcagaccgcgggtggccgcggcttagccggccgaagccccgccccctccgcctggccttcccaccggctccgcccaccttttctcccactcgccccgccctctcctcccgcgtttccacacgcgccagccagccggccgggagctgaagtcccgctctgggcccaggcagggggcgcccgcggtttagaaaccacatttcccatgagcctaagcacgcgcttccgtcactcggcggccgcgggggcgaagcgcgaggccccacacagagcatgcgcatcccccttgacgtttgctgccaccccacggcccaggggaggtagtgccggagacccggtgctcggaggctgcccggagccgcgaagggaaatgcgctttgcctcagatttgaaggaaatccgagtggctcttgtgtgaaatcacgcagagctcctctgttccgcgtgctctcttgctcgactgctgtgggaggtgggatcctgctgacgtctccttggcccgtagagtggggcgaggaagcccgagtgtccgcgcctggagcggtgactcatcagggattagctctggtgccgtgggttcccggctctttgcccggttctgtgctctgggaacgcagggtgacagacagcgagctggggactaggctgtggaacacgatgatgacgagccaatcagggtagaactgcacgtgctccgggttcatactggagctgggagcgaaacgggagccgggcgagctgggagaacgtgggctccggggacctggggaagggtggccgcagcgcgccttccagggagaacgccggccccgcgtcttgaggctttgccccgggtgggagccctcctggcccaccaggcccgcgccgaggcagccggaaagcggggacggggcggtgaaggcactggggtgaggatgggagagaaggatgagaacgagcggctgggctatggggcggtttttgtttctgcttttgtttttgagacggagtctcactctgtcacccaagctgtagtgcaatggcgcgatctcggctcgctgcaacctccgcctcctgggttcaagcgattctcctgcctcagcctcctgagtggctgggattacaggcgcccgccactgcgcccagctaatttttgtattttttttgtagagacgaggtttcgccatgttggccaggctggtctccagctcctgacctcaggtgatccgcccgcctcggcctcccaaaatgcttggattacaggcgtgagccaccgcgctcggccgcggttttttttttttttttttttttaagtttccacaagtgtggaaacagaaggtgactgtattattgaaaaaaagtcttggatgacagaagacccaactcaaacaggcttaagggaaaaaagtactttggctcgccgtggctcatgcgtgtaatcccagcactttgggaggccgaggtgggcggatcacttgagggcaggagttcgagactagcctgggtaacatggtgaaaccctgtctctactaaaaatacaaaaattagtctggcgtagtggtgggcacctgtagtcccagctactcaggaggctgaggcaggaggatcgcttgaacccaggaggcggaggttgcagtgagccgagatcgcgccattgcactccagcctgggtgacagaacgagactctgtctcaaaaacaaacaaacaaacaaaaaaaaaataaaaagaaaaggcaagaaagtaataattggttgccagaaaaagtatactatttttatcctcaggaaaggtagtaaatggcctctgttgatattgtaaaattttcattttgtgaattagaatgagttatcctaaaaagaggactaatccctcatttcagcagagctagtcattcgacaaatacttattgagtgtctattatgtaccagacacttttgtaggtactttagatacaccagtgaacaaaataaagatccctatcctgtgttgatggggagtagggcgcagactatagacataataaagaaatatactcaaccagcatgttagaaggttattcctgctctggaaaatataacaattagggccgggtaggggaattgtgagtgtgggattgaaatgacacagattgcagtatcaactagcagtatttaaacaactgttcaaagttacaatgagcactaaagggaagaataaacataagtcatccgaatatattaaataatcaaggtgttgtttcacttaacaacctagaggggaagtttttcactggctctctgacaggcttgtaacaaaaatagttttgaataactttgtaacatccttcaaatcacatcagagtgggagctgtctatagtacttgttcataggaccagtgacctttccacttacctgttttctactgtcccctaataatctcatgactaaagtgagtgaagattgcaagacagtaattcctgtaatcccagcactttaggaggctgaggtgggaggatcacttgagtccaggagttcaagaccagcctgggcaacatagcaagacctcgtctctacaaaaaattaacaattagctgggcatggtggtatacgcctatagttccagctactcgggaggctgaggcaggatgatcacttaagccccagagttcaaggttagagtgagctatgatcacaccacaggactcagtctgggtgacagagtgggaccttgtttctaaaaaaaaaaaaaaaaggtaaaagtgacagtatgtgtaatggaaagaataaaaaaactcagtagtgatataaacagtctgtgcactcaaggggctcatagggtaagtaggaacaagttaacagaattagaattagggagagacaaactagggtggttggtaaccatgatggcaattcaatgtgataagtgctctgagaaaggaatgcacaggatgttagagcagcacaaagcagggggtacagctgtctctactcatgggggattggttctggaccttctatggataccaaaattcatggatgctcaagtcccttatataaaatggtataatatttgcatataacatacacacatcctctcatatacgcgaaatcatctctaaattacttataacacctaatatgatgtctacgcatcacttcattcacgtggattcaatggcatgcgcaaattcaagtttgcttttttcctgaatttgaggttggttgaattcatagatgcagtacccagggatatggagggccaactatatttaactctactcaagggtccccagaggaggctatctcttgaaaatacagggccggggcttgaagtcaaagtggccagttaacagggccagaaagtaggaaggacattcaagagcactgtaggcaaaaaaataaaaaataaaataaataaacctgagctagtgatgacacggcaattagggaaatgtaagcaattggtatgaccttagtgcaagttaggaacacggcaatgatgagaaggtgaacagaaggcagaggccaggttgtaatcataaactttgctaaggaatttggactttattgtgaaggctctaaagaagaatttttttttctgattaccaatgtaatacatgattatgaaaaggatcttggaaaacagaagaatataagaaatcatactacatacaattcatacattttttaaaagttttttcattaaaaaaatttgccattcatactgtaagttagaatttatatccaactattttcacctaacctataagccttcccatatttaattagtagtctcagaaaatataacttaatcatttgtccacactataatttcttatctggtcccgtattattggacatacaggttgtttccattattccactataataagtaatactggcacttctgtgcacaaaactttttccacatttcagataatttccttttctgatattatttttaagccgctttattcatactgctattgtttcaatgtgtatgtctgccttcaatatgtttctcttatctcaccctcatattttaaaaaagttctttattaattcaaaggacaaaacttttcatcaatgagattgaatattcttatgttcgttagctgtttctatttcttttgttaattagtcatgtatcttccttttatccatttgtataagccctttatttttcctcagttttcttgccttctaattttataacttttaggacacaaaaacactttaaatttttataaattcaaatgatcaatatttaatttttttccatattttaggatgattctgatcatgagatctggtcaatattcttgtttgttttatttaatgttttaatccatttggaatttatttaggaatatggtgtaatgcaaggatctcaaaattaattaatttttttcatatagctaactattgtcctggcccattatttccctattagtttatgacatcacctcaatttattaaaaatttttaacataatagtatttgtttccaagccacagttttgcattcatctgtcctttcatcagtaccgtaatactctaatgatcctagttgtataatattttgtaatccagagggcaattctccctctcaatactctttatttctcacatatatatatatttttttttttttttttgagacagaatttcgctctgtcatccaggtctgggctcactgcaacctctgcctcccagtttcaggcaattgtcttggctcagcttttcgagtagctgggactacaggagcgcaccaccacagcaggctaatttttgtatttttgtagagacagggttttgccatgttggccaggctggtcttgaactcctgacctcaggtgatccacccgcgttggcatcccaaagtgctgggattactggcgtgagcccggcctatttctaatgaattttataataatttgtatagttattcgactttcccctaaaccttatgtttaataaaaaactaatgcatggttatcataacaaacacaagtaatgtaatacaagtgtaaacaaaatatataatgttagaatccttcagcccaccccaatctttctttccagacttagccactatagcccagatatttcttcttgtatatatattctgaatttttccaaatttctttacttttccagtgatggaaagggaggaatcaccctccttttcaatccccatgtatgcaatctgtccccttaacctgtataactccagaaattctagtcccctctctcaatatttctaagtaccaaggcgtgttctcttttccacgaggtcatcatcagtctcgttgccacctcttgttccagactgctctagtgttctctatcaaccacctcaactcataaccacttctcgaggccacagccccagattcttctgctttgacccgaaacacagacatagtgcctccgtttatcccccagtcacagctaagacatggctggcatgtttaacagacttgtaaaaggattggccgggcgcggtggcttacccctgtaatcctagtgctttgggaggctgaggcgggcggatcccctgaggtctgggttccagaacagcccgaccaacagggagaaaacccatctctactaaaaatccaaaattagccgggagtggtggcatatgcctgtaatcccagctactcgggaggctgaggcaggagaattgcttgaacccaggaggcggaggttgcagtgagccgagatggcaccattgcactccagcctgggcaacaagagtgaaactccgtctcaaaaaaataaataaatacaagaatttagcctgagaagatacagacagaaaacttttaacttgatatgagataaacttgctcctatggtcccccaatagaggtccctactggctatctcttgccttaagccttaccccagccctttaatgacacttccaagcgccttctcatcccttccatatgagggtcacttcttgctggttctcttttctctagtacagggcccaattcgatcagccagtgaaataaaaattgcccttgaacatctcttagtttaaaatatatagtatgtatgtttttgtatatgtaattctgtaaaagtatttttttattcctctaattcttatttacttatttggtagggatgagctctcactatgctgcccaggctggtctcgaactcctgacctcaagcggtccttctacctcagcctcccaaagtgctgggattacaggcataagccactgtgcctggccctctaattctttatcattaaagtttctcgtcaggctttagttgttcactttcttcctcaaggaaaccatcttgcctggtcacttaatcaacaaatttcactttttttttttttttggtgaatagttgggaaaccttaaaatcattcagatattcttttcaggactcctggcactctgcctcgggtgggtacacgctgccctagtaatgcgtgctatttaaatgattgcttctctttcttttttaagccaatggttgaattcttttaaattaaatgcctgtgatatgacgaccagataatctttgcagaagacaacctttacactagcagacagaatcattaacatttcagtctgaaagcatcttgactcgggcttctccaagaagagtaggaaaatagacactgccaaactgtccttcaaaaatgtgctcaaggagggaggctggtgtaacaggaacagagtgagtggtgaggagaataatcggggatgatgtagtccctagcaagaatatgatataaatcatgataaggatttgggcttttactccgaaatgaaaggggagtagttacatggtggggttttgttttttttgtttttttgtttttttgttttttttttgagacagagtcttgctctgtcacctgggctggagtgcagtggcgcgatctcagctcactgcaacctctgcctcctgggttcaagcaattctcctgtctcagcctccagagtagctaggattacaggcgtgcaccaccatggccagccattttgtatttttaatagaaatggggttctaccatgttggccaggctggtcttgaactcctgacctcaagtgatccgccggcccagctcccaaagttctgggattacaagtatgagccaccgcacccagcctacatggtgggttttaagcaaaggagtgacatgatctgacttatgtgttagcaggaacactcacattgctgtgtggtgaatagactgactgggggtggggaaaaatctaccgtgtggagtagcggaggagatgatgagtatcattcaagtcttgagaaaagctgcagtagcaagagccaaccagaagatggaagagggatcctgggtgcttctatatggagttgatctatctgagggtgcagaggccgactctaagatgctgtggtgcatctccccaattcaggatggaaaatgttgactgcaaaggagtctcagttgaatctctctctctgggaactgcccttggctgaaggtggctgcctcacccaagggtacagctccctcctgagagacaacctgcatccagtgactactcaaggaacggtgtaaagatgtgggtaactctgaagagccatcccgtggcctctcttgcaactgcgtcacagtccaacttctccctccgcccaattctgctttcctcactcccttaccggcattcccaagagcagtccccagtaaacctgtatacaacccgtgtttcagagtatgtttccatgggaacctgacctaagacagcgattctgttaaatgacatgaaagatgatgtcatttctctacctaaaaccctgcaaatggctctccagttctgttctctcacagggaaaccagagtcccttacagtggcctgcaggccgttgtcatctgtaggccgttgtcatctgcaggccgttgtcatctgtaggccattgtcatctgcaggccgttgtcatctgcaggcctgaacccctctaacctcatcctctattcccctccttctcattcagtttgctccagaaccatcctggcctcctttccatcccgagaataggacaggtacattctttcctcgggatctttgcactttgtttcttctgctcttcttccagatattttcatagcttattccttcttcttcttcaagtcaactaaaatgttgccttttccatgaggccttccctgtcccttctattaaaaaaccctgctccaccatccccaatctctattactctattctgtatcacttatcactctttttttgttttgttttgttttgagacagtctcactctgttgcccaggctggagtgcagtggtgtgatttcggctcactgcaacctccacttcccgggttcaagcgattctcctgcctcaccctcctgagtagttgggattacaggtgcatactaccatgcccagctaatttttgtatttttagtagaggtggggtttcaccatgttggtcaggctggtctcaaactcctgaccttgtgatccgcctgcctcggcctcccaaagtgctgggattaatggcgtgagccactgcgacctgccatgtgtcacttatcactcttaaacatactgttcaatttacttatttattttgtttgcggtttattgtcttactgtctacacagggcagaaattttccctcccgttttgttccctgatatatcccagaacctggagaagtcactggcattttgtaggtgctccataaatatttattgaacaaacagtgaatgaatgagtgaatcaatgaatttgggaatctttagcaagttgattgcagtagaactcacaaggtgagattacccaggcatagtctgtagagcgatgatgaagggagacaccaacatttaggtgtgagcagaggaagttaaaattataaaggacattgacaagaatccagactataggaggaaaacaggaggatgtgtcacccaagacaagatgtaagatggcagagggagtgcagacgacagcgtacaacctgaccaacatggtgaaacactgtctctaaaaaaaacaaaaacaaaaattagccgggcgtggtggctcatgcctgttgacaacatatgaagcaagatcaaggcagaaatgtgtctgctgatttgagagtggccaggtaactagcagtttcgaggaataggtagagcagaagggagagtactgtgagttgaggagtgaatgagaagtaatgaagtggaaatggtgtgtgcattactattttgagaagtttggtcatgaagatcagaacgagaaagaatgggagctgggaagagggctctgattgaagaagtgtgtgtgtgcatttagatgggagagataagcctgacttgagtattttaagtgatgtatggaaacagccagtaacaaccatataatttgtaatctaaatcaaggttttgagagaaaaagggggcaggacaaatgctaaaatggataaatgtcaagacaacaggaactatctgcaaaccagaccatatggtctccctgtccacgcctcaagttttccatgcaagtcatttatccttacacttagtgggctatttttttctgacggtaggtggcagtaaagagcttgcctctttttgcctcgtttggtttggtttggtttggtttttgagaaaaatttaattagagattttggatggcaactaagattggtaaaggttagctccacaggcttaaactcaaaataggagatttcaacttagattttactttgggaaaattcatacacgtttttgtgaaaaagaatatctcttggttctcaaagaaaaaataatttttgggtaattataaaatatgttgcattttcacactgagccattttatctttaaaatgatgaacttccatcttcttcctaatacagaataatttccattagttttatcacttctttttttttgagacagagtatcgctctgttgcccagcctggagtgcaatggcacaatctcggctcactgcaacctccgcctcctaggttcaagagattctcctgcctcagcctcccgagtgggattacaggtgcctaccaccacgcctggctaatttttgtatttttttttggtagagatggggtttcaccatgttagccaggctggtcttgaactcctgacctcaaatgatctgcccacctcggcctcccaaagtgcttggattacaggtgtgagccactgtgtctggcctatcccttcagttttagcacacgcattgctatatgcacacatttcttatttgtgtatataaattttcagtcaagtctagcttcagtagactttgggggaccttgctattgaagattataaacattttaaaaaactataggccaggcgccatggctcacgcctgtaatcccagcacttcaggaggctgaggcgggcgaatcacttgaggtcaggagttcgagaccagcctggccaacatggtgaaatgccatctctaaaaaaaataacaaaaattagcctggcgtggtggcgtgcacctgtaatcccagctactcaggaggctgaggcaggagaatcacttgaacctcaggaggcagaggttgcagtgaatcgagatcacatcactacactccagcctgctgggcaacagagtgggactctgtctcaaaaaaagaaacaaaacaaacaaaccaaaaacctatgacacataacagcaaatttcttgttatcaaagataggactagagatgtctaaagataagaagttttaggagttcggaatggtaaagtgaatgagcacaccttattcagggaatcttggcagaatctaatgtcataaaatttaaaattcagaaatctttgtcagagaaaaaacagaatcaaaatattatctgcagatccagcaaacaaatttgagttcaaaactcagatttgcatttattagctgtgtggccttgagcatggcaagcactttacctctaggtctcagattcctaatctgtgaaatgagactcacaggatatacttcagtggattgttttgaatattaaatgagaaaacatattggtaaaatttatacatgttattttcattcttttccctaaacatgaatatgaagacatccagattaaaatgtggcatatgcaacctcaacctttggaaaatatatctcaaatgattaaggaaaaatattaattttaagaattgctttaaaacaacaaaaccaaaaaagccttggtcataccttaattcagtaattcttcaactttacgtctcagatccaatattctaggcactgcttgacacagagagcagttttcttacaaggaaatttggggaccagagggggttctttgcatgtttggataagtgctagaattcaaattccttctcctgagagtcctctgcctttttcgtttaatgaactcggttgctttctttatttcctctttctatcctcattagcgtaaagcaaactctaaaagcaatccacaatatcaatcacatcaaatatcatggaatgtggcctcagtcctggaagatgtctactccatataggtgacttggtacattacagtagattatagtagctgaaaagtatcctttggccagccattgtcaaaactagagtcactaatgagatcacaaatgagaagcattcattgtctctataagacttcctaaaatgcccttattattaagggaagtcctggctttctgccagtatcacagactaatttgttcattagctggttgacttcttggttcttgcatatttcaatggctaaagtttgtagtaagtttgagaaatataaagagaggagtatggggaggagagctggcgggaggtgggtgctggaaatgattaagaccactggaagggaaaaaaatggggtatgatatcaccatggaaacgaagtttacgtattgcaaaaatttgcccaagttggatagcattcattcattcattcattcattcattcattcaacaaacatttactcggtgtctttgcatgcctagaaccatcaaagttacaaatgagaacaaaacaagcttggttcttgtcttcacggagcttccattctagtgggggaaggtacacaaagaacaaacacaagtaggtttccccctggaaagaataactggcaggtttgcaggcattaccacctaatttctttttaaaaagaaacctaaagacttctttgggtgtccaaaggtctaaaattttagaagttcaaaatggcaaagtgaaagagcacacattattcaggcaatcttggcagtatctaatgtcataacatttaaaaatcagaaatctctgtaagaggaaaaatagaatcaaattactctctgtaggtccagcagacaaatttgagttcaaaacccagatttgcatttttataattatttactttagtaaattacttacaatttactaaaattataaataattatagtaaaacaaaaaaattaacaatgagccagcctcccagtgtcgctcaggagacctcacggctaaataagtaatcactgctatcccttcctctccagcagtctccatcaacttgttctgcattcagagactgttcttgggccttcccatacgcagctcacatttgaaactcctgcccctggtgccttaatgcatctgactggcagccacacagcccctccatgtggctcagtttcagtgggtaggtagggaaatgccgatttgtttgcattgttccccacaggctgattacagtaaaggctgtcacacagagctcttgcatacctaacaggagacttggtgacagtgaaaccaagaatgaccaatgactgtgtgtaaaatgaatcaaggtgaggtgtattgaaagcaaagaggtcaattcaaaggcttagaaataatccagacagtaatcaaggaagaaagcagccatgtcactgggaagaaaaacctcttgggacactcagtatattcaacacgatgaagtaattcgccctgtgacatggacaaaaggagctttccatgctctaatgggcagtaggattccataaagtgaatcacgtttaaaagagacactcttaaaaaatgaaatacgtggccataatcccagcaccttgggaggccgaggaaagtggatcacgaggtcaggagttcgagaccagcctggccaacatagtgaatccctgtctgtactaaaaatacaaaaaattagctgggcatggtggtgggcgcctgtaatcccagctactcaggaggctgaggcaggagaatcacttgaatcagggaggcagaggttgcagtgagccgagatcgcgccattacactctagcccaggcaacagtgggagactccgtctcaatgaaaaataaataaataaatgaataaataaatattgttctaatgagcaaatttaaaaaatcctaagtaaaatttggtctctttctcattagtgcttaatggtcttcaatcaccccagtcctactttgagtatatactaaatccctttcaaggacagattctagacttttcccactttggctcatctgaaaggtttctaaaaggattggtccttaatatttcttttcacaacttaatagcgtgatttgagtttatgcacacagaaagagatttgttcgtaccctcctctcctctgatttttaaaccttgttccccttgttcattctgtatgttgagatgtgatcttgcttttaggagatcaaagaaaaagaaaaacaagtttctctcacatgtttgtcttctctttaacaatccacattgtttttatatcggcccaagatacaccattaaaagttctgcaaagcttttaaactttgcagagtagttttagactgtgtgcagagaagtcttgtgccaaattgcagagcctgttttttttttttttttttttgagacggagtctcgctcccttgcccaggctggagtgcagtggcacgatctcggctcactgcaagctccgcctcctgggttcacgccattctcctgcctcaacctcccaagtagctgggactacaggcgcccaccaccacgcccggctaattttttgtatttttagtagagacggggtttcactgtggtagccaggatggtctcgatctcctgacctcgtgatccgcccgcctcggcctcccaaagtgctgggattacaggcgtgagccactgcgcccggcccagagcctgttgtataagaaattaatttcaaatgctagcagagaggatggcattatgttttcaaaatgatgctacattaattcagcaagaaaagtttagagccattctgagtcagaggacaggatattttaatcttaaaagataaaagggcaattccaaatagctgattatgcatagggttcatcattcatattgatgtaagtattatggggcatttcctctgtgatgacagggctagattctactcacacacactaataaacagtttttcctcctggtttatacacaacgaggtgaatgtctctttcccctgatgaactagtgtttggaaacaaaaactataattatcttcagtggagatggcaattggataccccagagaatttgtctgatctttataaggtattcagcagtgaaaatggggttttgcaaaaagccagaagacttgctttggaatcctaactgtgtcacttactaaaattttgactttagataagctatctaatttccctgagccttagcttccttgtctgcagaatgtgaaaaataatgaccaccccataggatgaaaaaaaaaaattaaatctaacgccatatgtgaaagtactcagcattagtcagtccttagaaaatgttagtctcagcctggcacggtggctcatgcctgtaatcccagcaatttgggaggccgaggcagacagatcacgagtcaggagtttgagaccaacctggccaacatggtgaaaccccatctctactaaaaatacaaaaaaattagccaggcatggtggcatgcgcctgtaatcccagctactcgggaggctgaggcaggagaatcgcttgaacctgggaggcggaggttgcagtgaaccgagatcgcgccattgcactctagcctgggtgacagagcaagactccatctcgagacaatgttagtctcccctttcctctgtgagcaggaggaatgaagaacataaagacggttattagctactgctgtgtcacaaaccacatgaaaactcaggaccaactctcagcactgattttttttttttttttgagacagtctcactgtgctgcccaggttggagcgtggagttcagtggtatgattagagctcactgcacacttgaacttctggatttaagtgatcctccccattcagcctcctgattagctaagactacgggcacgccaccatgccaggctagtgtttttgtttgtttgttttagagatgaggtttcctatgttgcccaggctggtctggaactcctggcctcaaacaatcctcccacttcggcctctcaaagcactgggattataggtgtggtgcacctccagcaggaggtatctggacccattcactatcatgaaaacggcatgggaaagacctgcccccatgattcaatcatctcccactgggcccctcccacaccacgtgggaattatgggagctacaaggtgagatttgggtggggacatagagccaaaccatatcattgacctgctggcaccatcaaatatttctgcatgatgaaatttcagctcagttttaagtgtctatgcctacaatcatcatgggactctttctaactatacactgtacatcacatacaacacctgcatccttctctgccacacagatctgctgagatttgcattatggctgaattagccgaaatttacatgccaaaggggcatcgatatttttcatctgctgctttctacgtgtaggacaaggcttatattactggtcctacactttcctagaaaccagaaacatcggtattatgttactatttatagtaatagcaactacatttataggttgtgtcctaccatgaggacaagtatctttttgaggggcaacagtaattacaaatctattgtcagctgttccatacattggcaccagcctggtacaataaacttaggaggcttttcagttgacaaagccacctcacaccattcttcaccttccacttcatcttacctttcattatcatggacctagtagccatctaccctctatttcttccagagacaggatccaacaacctgtcaggagtttcatcagattctggcaaaattccattccatccctactacacaatcaaagacattttgggtctaattctccttctactattactacttatattagttctatttcacctgacctactaggagacccagataatgacactgtggcaaaccccctcaacacaccacctgacattaaaccagaatgagactttttatttgcctatgcaattctatgctctattcccaataaactaggaggggtactagccctagtcttctctattgttatcctagctattgttccaatatctaaacagcaaagcataatattctggccgtcaagccaatacttattctcagcatcatgcactctacccatgtaacagacctgcatatgtacccctgaatctaaaaagttgaaattataaaaagtaaaaacatatacatacatatatgtatacatgtacctacacctatgcaaaaaatatgtagtgttggctgggcatggtggtttgcatggtggtttgcacctgtaatcccagcactctgggacgccaaggcaggtggatcacttgaggtgaggacttcaagactggcctggccaacatggcgaaaccctgtctctactaaaaatacaaaaattggcgggtcatggtggtgggagcttgtagtcccagctacttgggaggctgaggcaggataatcacttaacccgggaggtggaggttgcagtgagccaagatcatgccactgcactccagcctgggcaacagagtgagactctgtctcaaaaaaaaaaaaaaaaaaaaaaaaaaaaaaatatatatatatatatatatatatatatatatatagagagagagagagagagagagagagagagagagtattattattttgtttttttaaattcacctgaatagcatactttatatatattgttctacatacttggtcttcttgctcaacattgtatttttgatacttgtcctatttggtatatgtagacctaatgggttccttttaactaccgtctaatgtgagattgcaccattggatgaatgggccacagtcgatttttgcatttttctactgatgaacatgtatataatattttttatcctctaggctcaatttaagtgctttgcaaattctcattcatgtatctttataacaggtagtagttttgccttccttattttacagatgaggaaactgagacacagagaagctaagttacccactcaaggtcacaaggctagtaagctagtaagtgacctagacaggtcacacacctgtcacatcagaatctgtgtcctaaacctgggcttgttgcctctttgaggtatttccattgctcactgtaacagtcctgtttacttattctcatgtccactgccatgtgtacacgaaagtttctttccagttatacctagaaacaggattgctgggttcacataatatctttcatcatggtgagttttttttttttgttttgctttgtttttttgagcactgttacccaggctggagtgcagtggcacgatctcggctcactgcaacctccacctccctggttcaagcgattctcctgcctcagcctcccgagtagctgggactacagctgtgcaccaccacgcccagctaattttttgtatttttagtagagacggggtttcaccatgttggccaggctgacctcgaactcctgacttcgggcgatctgtccgcctcggcctcccaaagtgctgggattacaggcgtgagccaccgcgcccggcctgcatacttatttgtatgcccaccgccatgtgcaaatgaaggtttctttccagttatacctagaagcaggattgctgggttcacatactatctttcatcatggtgagtttttgcagtgtgaactagagtggggaataaagtgtcataggaacaattctgcggctttgaaggacttcagagccgttaaatagttacttcaatgttttatccagctcttaactttaggctcttttctgtcgtggtaatcatctgagatgaggttaatagaatatgaaactactttgagagaagacagaagacagaatggccatgtcacataagtaactcttctgaatggttcatctcaatgtactacatttatttattttttgtttcgcttttttttttttttttctgaggtggagtctcgctctgttgcccaggctggagtgcagtggcgccatctcagctcactgcaagctccgcctcccgggttcacgccattctcctgcctcagcctcccgagtagctgggactataggcgcccgccaccacgcccggctaattttttgtatttttagtagagaccgggtttcaccgtgttagccaggatggtctcgatcttctgacctcgtgatccgcccgcctcggcctcccaaagtgctgggattacaggcgtgagccaccacgcccggctgttttgctttttgagacagtctcactctgttgcccaggctggagtgcagtggcgtgatttcagctcactgcaacctctgcttcctgggttcaagtgcttctcctgcctcagcctcctgggtaactgaattacagatgtgggccaccaggcctggggctaatttttgtatttttagtggagacaggggtttcaccatgttagccaggctggtctcgagatcctgaactcaagtgatctgccccctttggcctcccaaagtgctgggattatgggcgtgaaccgtcatgcctggccacaaatgtactttaatacagctgcatgttgctgtgtgatctattctagaattgaacattttctctgtataatttctatatatctaactctctatatataatttctatatatctagcctatatatctagatatataatttctatatatctagcctatatatctaactcagtctgctaaaccactgagcatcatgaaaaatgaaaagcagattctgtatgatggcctaactcaacaattccaaacacatttttgcactattacgagcttttggttttataaacttgcagtatatttgatgtaggtctttatatgtttgtgtaagttggctgtaaatgccaagatacacttaatctcttaccatcatgccattctcattcagatataaactatagcaacctcacttggaaaagaatcaacacacttgttgccgtagtaatcaaggccactcattaaaaaagctatcttacagatgagatatccccaatgcccttacccatcaaatggaaatagaattgaagggcttttggttaatccttcctgaagacctttttgctttgacttagtctaaaatagcaaacacataaactataacacacctctcagaattggtaagatccatactgctctttccccaacattggtccatttctggggattcttcagggacacacaaaagaaagaacctgtttgtgtgtctggtttaaaggaatcctgtctgcatgggcttgcgtttgaaggctggttctcagctcaccagttgaacagttctaatcacatctctgtgagccattgtttcctcattgtaaaatggggatagcacccacctcattgactaactcgttcatatacgttggttcaacatctattgagtacctcaagtccctattctcaagttgttcacagtccagtaggggaaatagatatatttaatgatatggaagaaatcataatttttagcaggttgcaagaggcagttttgttggatgagtgctttgatattccctttccgaagctagggctccatgacttgttaagtaattggtgcattgtgctgaaagaaaccaactgtgctgccctgtgtgaattactaaaaggaatgcatctgttcctgggaggcggggagggagggcagaagggatctggccctgcagtggggtggggtggaggagcaccctcagttggtgggggcagacatgtccaagggaacttataaaactgtgggtgacataaaaccctcttccatcacccctgtaaagtctccagcaaaatctacattggccactagtgctttaggtgtaaataagattctggagaattcaaaggcagccagacatcataatcatacattatgcaaaagtggtttccaaactgcaggtcaggatttttcggtgcatgtgaaagcaatttggtgcaccatgcccagcattcaacaagggaaatagaacagtatagaaaacttcagggcaccttgcaaatagtagaggtaatgatgctttctgaaacttttttatgtaggtcctcagctgtggaataaaatgtttttctttttgtaggtcatggtcaaaaagagagaatctcggtattataatacattgtgctgattacaatagcaattttttttttttttttttgagacagagtctctctcctgtcgcccaggctggagtgcattggcgcgatctcggctcactacaacctctgcctcctgggttcaagcgattctcctgtctcagcatcccgagtagctgggacttcaagcgccggccaccatgcccaattaatttttgtatttttagtagagatggggtttcaccatgttggccaggctggtctcaaactcctgacctcaggtgatccgcccacctgggcctcccaaagtgctgggattacaagcgtaagccaccacgcccaggctacaatagtaatcttgatggctcactctgctctcactggtccctagaatccttataaaaggggtcttggttcaacagttccctgggttgaagactagcttctacctcctgttttctccaattctctgttttaaagtcctttggatcttccttttgcatccttgcagagcctctttgggctcctgtctcggcccagctcgccttgctctgagggttgcctttgatctggtcagaactccactccacttctgccagctcgactcccacgttggaggcaggaaatagcactctcttgttcttgcatgtatcaagtcctttgcctgctctctgctcctacagctctttggcctggctaattcctacttattttcaggtcttagcagaaatggagcatttacaatgaagctaatgaagcttaagcttcagggtctgtgccaaaccctgacacccaattttgtaatctggtattcattttcttagggttggatttcatgaggcctcatgaaacctgaatccacttctgggtctcagtttagaaaacctcacctcctaactccttgcagtgtgggtgctgatctcctatacatgcccttgggtcccctgcacccactcccaggacagccctgaccacactcccccataggcttgccagtcttcaccccgaaactcacataaaggaactatgccagtccttgctggtgagtgccaaggtgccctcatagtagacaataaataaaaatgtggtaaatgtctgaacttcataagttgatttggggaaacaatgctttttatgcttcccaaagtattccataaaactgctgacaggggccgggcatggtggctcatgcccgtaatcccagcattttgggaggccgaggcaggcggatcacttgaggtcagaagttcaagaccagcctggccaacatggcgaaaccccatctctactgaaaatacaaaaattagctgggtgtggtggtgcacgcctgtaatcccaggtactcaggaagctgaggcaggaaaattgcttgaaccccagaggtggaggctgcagtgagccgagatcatgtcactgcactccagcctgggcaacagagcgagaccctgtctcacaacaaaacaaaaaaaacaccaaaccaaaacaaaaaatcctgctgatagcaatgaagaggaatgaggattagccaagaagaaagtttcagaacactgacctcccctgccctggcccgtgtttgtggagtgctgctgttcctgattgtgctccatttctgagaggttaaaggaatttgtgtcaattccaccaagtaaagatagcttaattgtctgccccaccacctaaggatctctctggagcagatatttttattagaaaatcagaaacaggccaggcgcggtggctcatgtctataatcccagcactttgggaggccaaggcaggtggatcacttttggtaaggagttcaagaccagtctggccaacatggtgaaaccccatctccactaaaaatacaaaaattagctgggggtggtggtgcgtgcctgtaatcccagctactcgagaggctgaggcaggagaatcgcttgaactcaggaggtggaggttgcagtgagccaagattgcaccactgcactccagcctgggcgacacagtgagactccatctcaaaaaacaaacaaacaagcaaacaaaaaaccagaaacaaaagatatagcatctcctcaaaccgaagagctgtcaaatttgtcaatttttcttttgcttagagttcatgatattaaatgatttgtcttttcctttccttttcttactgaagccttcagttaaagcagtctgactctaatctagccctgacccagttactcttgctcaggtgcagccctgggagctctggggtctcctttctgttctttttcccctcgtggattattcttcctaaaagcggatgacagtggttgagaacacaggctctgaatcaggctttctgggttcacatcacagtttcctccatttacggattgtgtgactgggaacttgagcaagtgagttgattggctagcgaatcaagtcaacatcaggaatgttgcaagcctgcaaatgttaccatggtagcttgaaagtggctttggttgggagtatttactgattagcttgaaatttactttgattggcagtatttactaattgtgtgactaggaacttgagcaagtgacttgtttggctagggaatcagaccaacatcaggaatgtcgcaagcctgttgatgttacgttggtagcttgaaattggctttgattggaagtattcacaccatggaaattggcaaatgctgcaaatcagtgcctgcccctttccccaacctgggcattactatttaccagaacatcaagctcagtttcctcatctataaaatgggagcaataatagtacctaccttgtggagaattttgtgacagtttcatcgtgcatggtaaatacttcgtgcttgtgagctgctcttagtatttccctcattttacaaggtccagtgcctttttgtttcatgtgccccattctgacacagcttcaaacacaggaccagccagatctagcacatgccttggcaataaacttattttttattttttgataggtagtcttgctctgttgcccaggctggagtgcagtggcacaatctcagctcactgcaacctccgcctcccaggttcaagtgattctcctgcctcagcctcccaagtagctgggattacaggcgcctgccatgaggcccagctaatttttgtatttttagtagagatggggtttcaccatgttggccaggctgttctcaaactcctgacctcaggtgatctgcccgcctcggcctcccaaagtactgggattacaggcatgagccagtaacaaacttaaaaaaaaattacttagctagattatttagtcttcaaacagccagctcataactgataggaaatgtgtggtcttaggttgtttataaggcataccctggtgacacatatgttataaaattagaattcttctaaatctagcgctgattacttatgttatatatatttcatttggctgggtgttagaaagaatttcttctttgagatttctattattttttctcccaattaaggcaaagactgtaaggatagtttattacagcatttggtggttcagtaaacaaacatgctctaaaaaacctaaatagctgtgttgaagtaaaacatgtgtcccaaattcacatgaattatatgcaagttaatactttggtgagcaaataaactcttggtaatatattgctgtcacctgagggctaaaaatataatatatattataaatatctgactcaatctgatcatgaatgaattgatcacttatgtgtatttaaatataatggcaaagcttaagctcagtattctcttaaatgagttcatttactctcaataggtttgggggcctttatttactgaaaaaacagattcacgattattggaatatgtgttttttttttaatttttagttttttgagacaaggtctttgaattaatcacgtgtgtatttaaatataatggcaaagcttaagctcagtattctcttaaatgagttcatttactctcaataggtttgggggcctttatttactgaaaaaatagattcacgattattggaatatgtgtttttttttaatttttagttttttgagacaaggtctttgaattaatcacttatgtgtatttaaatataatggcaaagcttaagctcagtattctcttaaatgagttcatttactctcaataggtttgggggtctttatttactaataaagtagattcatgattattggaatatgtgtttttttttaatttttagttttttgagacagggtcttgctctcgcgcccaggctggagtgtagtggcccaatcatggctcattgcagcctcagactcctgggctcaagtaatcctcccacctcagcctcccaagtagctgggactataagcacatgccatcatgcccggttattttttccttttctgagatggagtctaactcagtcactggggctggagtgcagtggcacaatctcagctcactgcaactttcacctcctgggttcaagtgagtctcctgccttagcctcccaactagctgggattacaggtgggtgccaccatgcctggctgatttttgtgtttttagtagagatggagtttcaccatgttggccaggctggtcttgaactcctgacctcaagtgatccacccacctccgcttcccaaactgctggggttataggtgtgagctagcgcgccgggcctgtggctattaaaaaaattttttgtgtgtgaagatggtgtctccttttgttgcccaggctgttcttgaactcttgggcttaagtgatcctcccattttggcttcccaaagtgctggagttacaggtatgagccactgcacctggtcagaatatgtatatcttaatctaactttatcagcatttaaatgacaggaagtgaaaatgttattaatgcacaattgatcacaaaaccatcacaggttctgcaaccaggatgagtttatatgagaattcttcatccaagatgcttggaagttcatctcttcaaaggattgccctcttcggaaacaagtaatagcctgctttgatgatgtttacaaaataccacatgtcaacatttaagaagacaatggttttcaaaggaactggaaactcctttcctggattgagaaggcagactctatggccactgagactccttctccttcaagatgctctgaggtcaacaagtaccttgtttgcctctgggaattctttcccttgcagtagtaaaccttttccaggcctttttctatcactggaattgcgtctggtctcagcaacaagtttcaggaaaattaatatacataggtcccccttctttctcaggcagagggacatccccagaggatgcaggactaccatcatgagagtggactggtggctttttttttttttttttgagacagagtctcactccgttgcccaggctggagtgcagtggcgtgatcttggctcactgcaacctccgcctcctgggttcaaccgattctcctgcctcagcctcccaagtagctgggattacaggcacacgtcacaacacccggctaatttttgtatttttgtattttagatggggtttcgccatgttggccaagctggtctcaaactcctgacctcaggtaatctgtccacctcagcctcccaaagtgctgggattacaggcatgagccaccgcgcccggccggactagtgactttataagaagagcttctcccactcttccctgctcctgatccttcagcatgccagagttgggcttccggagtctcatgtggtcagtaacgttattactaatccaacttgtgctcaagcaaccttggccccactggaaaggtttgtctccaccactgctgacgagttcaatctaggtgggaggcagtggccgtcaccctggctaagcatctgcaatgtccttctgaccacagcccaccacctctcctgctcataaggctcctgccctggacctcccaggcctgagctctgctgcccattgtgtgttctggtttgcagaattaggcttctgctatggtctctgctatgatttgcatatttgtctccttaagaactcatgttgaaacttgatccccagtgtgggattattgagagacggggccttttcaaggtgattgggtcatgagggctctacccttgagaatagattaatccattaattaattaataattaataaattaatggattaatgggttatgagagtgggactggtggctttataagaagggaagagagacctgagctagcacactcagacactcgccatatgatgccctgagctgtctcaggactctggagagagtccccaccagcaagaaggccctcaccagatgcagcccctcaaccttggacttcccagcttctggaacagtaaggaataaatgtaatttcttataagtaacctagttccagatattctgttataagcaatagaaaatgtactaaaaccactattaataaaacagtctctactgcaaattcttttctggaaagtgctagttctccagactcaatataggaacccagattttgctctagccagcaggcccatcatggggctggggcctggccctgtgagccttcccagtggctttgtcccagctacgtgaatgtgtgttttcatgctctcccatctctatgtctcctgtccccaggatgactgccaacctgccagcattctccagcatcacccaccaaggtgccctcaaactcctctgtcgtcctccccagctgctcactgttttcatgtgaaccttgagtatcaactattttcccacctcctccaaggggagagcatagcaaagtggttaagagcctgtgctctggcactggatagcctggttccagcttcacctgttacgacttatgtgactttggcaagtcacttaatctctcatgcctcactttgccatctttaaaaatgggtttaatcctagtgctcacaggtttgtcatgagcatatataaagtgatatttgcaaagtacgtagaagacggattggcacctggtaagctctgtataaggatttgatcattgtgttagtttgctagggctgccataacaaagtactatagactggatggtttaaacaacagaaatggatttccttacagttctggaggctggaagtctgagatcaaggtgaccacagggttggttgcttttgaagcctctctctccttggcttgcagacagctgtcttttcttcatgtcctcaaatggtcttccctctgtgtgtgtctgtgtcctcatctcctcttcttataatgataccagtcatattggattaaagtccaccctaatgacctcatttttgctttattatccctttaaaggccctattttcaaacacagtagcctctctttttctgtggggatacattccgagacccccagtgaatgcgtgaaaccattgatagtaccaaaccatatatatatatataccatgtttttttctatacatacgtacctatgataagtaagagattaacgacagtagctaataataaaatagaacaattttaacaatatgccagcatcactactcttgtgctttgggtcccttatgaagtaaaataagaattatttggatacaagcaccataatatcacaacagtgataaccaagacagctcctaaatgactaacagcatggggtatctacagggtggctatatggattaagggatgattcacatcctgggtgggaccgagtgggatggcatgagatttaatcatgctactcagaatggaatgcaatttaaaatgtatgaattatttctggaactttccatttaatatttttggactgcagtagaccatgggtaatggaaactatagaatgtgaaactgcagataagggggaactactatatggttatattatgaggtattagggtttaggatttcaacatacgaatttggaaaggaggtacaattcagcccaaaacaataactaaatgaataatttgtgcctggacactgccaagctcctgcagccattgctatagactgaatgtttgtgtctccctgaaactcatctcttgaaaccccaccccctaaaattcaatggggcctttgggagtgattaggattagatgaggtcaggaaggcaggattagtgcccttgtaagagtcctgaggcagtttgctcccctctgctctgggtcacatgagaacacagtgagaagagggccatctgcagcccaggagaggcctcacgagaagctatgctggtgccctcatctcagacttccagcttccagaactgggagaaatacatttctgctgtgtataagctactcagttggccgggtgcggtggttcatgcctgtaatcacagcactttgggaggccaaggcaggaggatcacaaggtcaggagtccgagaccaacttgaccaatgtggtgaaaccccgtctctactaaaaatacaaaaattagctgggcatggtggcttgcacctgtaattccacctactcgggaggctgaggcaggagaatcacttgaacctgggaggcagaggttgcagtgagccaagaccatgccactgcactccatcctgggcgacagagtgagaatctatctcaaaaaaaaaaaaaatctactccgtctatggcatttgttttttatagcagtgtatactggctaagaccatgcccttttgactatctctggctggccccgcgatggctgtctagagtgatttctccccagcgttagcctgggacagcagctggacatccttcaccagctccatcagagtgacagcagccggctctccccctctttcccttctaggtccctgcatgacctggccttgtagaggaggggcccagcctttggtatcttggtccactgcttactcattcaaaattggcagaggtgaaaactggaatataacagagaaatcagctcaccacaaaaagacagcactacttgttagtatagttgaggcttgaacaacaggggcttaaactgcgtgggtccacttatatgtggattttcttccacctctgccgcccggagacagcaaagccaactcctcctcttcctcttcctcctcagcctactcaatgtgaagatgaagatgaggatgaagacttttatgatgatccactttcacttaatgaatagtaaatatactttatcttctttatgaccttccttccttcccttcccttccctttcctttcccttcccttcctttcccttctctctttctttccttccttccttcctccctccttccttccctccctccctccctccctccctccctccctccctccctccctccctctctctctctctctttctttctttctctttcttttctttccttctttcgtcctttcctctgtcacccagactggagtgcagtggcacaacctagctcactgcagcctccaactcctgagctcaagctatcctcccatctcagcctcccaaagtcctaggattacaggcataagccaccatgcctggctctctttcttacagttttcttaataaaatttattttctctggcttattttattgtaagaatacagtatatgatacacatgacataaaaaatgtattaattgactgtttatattcttggtgagacttctggtcaacactaggctatcagtagttaagtttttggagagtcaaaagttgtgtgtggctgggcgcggtggctcacgcctgtaatcccaggactgggaggctgaggcgggtggatcatctgaggtcaggagtttgagaccagcctgaccaacatggcaaaactctgtctctactaaaaatacaaaaattagctgggcgtggtggcgtgtgcctgtcatcccagctactcgggatgctgagacaggagaattgcttgaacccaggaggcggaggttgcagtgagccgagatcgagccactgcactccagcctgggtgacagagcaagactccatcttgaaaagaaaaaaaaagttataagtgaatttttgactgctaggaggagggaaaggggttggtgctcctaatccctgcattgttcaagggtcaattgtggttagaaacaaagtcaagtcccagccaccagagagatatttaatggttaatattgggttaatactgtggccccttcctagaccctgaatgttttcccaaataagtacttcgacctccaaaatgacttttgcccaggctggagtgcagtagcacattcttggctcactgcaacctctgcctcctggttcaagagattctcctgcctcagcctcccgagtagctgggattacaggtgtgcaccaccaggtccagctaatttttgtatttttagtagagacggggtttcgccatgttggccaggctggtcttgaactcctgacctcctcctgcctcaacctcccaaagtgctgggattacaggtgtgcgtcattgtgccccgtccttcgaaaggcttttatcatcacctcttgaaatagcaattttgaagtttgagagctttcattacagacttgacctccccttctggtgctgattatgggaaagtgctatctttccggcatatcatgagttattttcttcataattcagttcctggagtgagggggtcttagcttgtactcctgtataaacagactgtgatgttgatgtgttatgaaactggagcgcgatgggcacccagttactagctggtaagtgttactgtctctccttccctccatgcatcttcggcaaatgaccaactcttatctgaaattctgagtctttgtgtggactcgttaccacaataattatggatagggtaaatacagttaatgcctatttactgagcatgtgttatgtcccaggcatgtgttaaatacttatgtgatttcatgaatcatcaagagctgcctgtgaaataggtgttattatcctcattttactagatgaagaaatgagagctttggacagtggcaaagccagtagatgtcagagccaggatttcaacccgagcatctctgattccaaagcccaggctctttgccattctgatttttggtttttggcctcctaaatacctcctggctcaatttttatttatctatcaagcaaggtgtcttctttcctcttggattttcttcttcctatgtaatttttttgttttgtttttttgagacagagtctcactctgtattttaggctggagtgcagtggcacgatcttggcttactgcaacctccgcctccaaggttcaagtgattctcctacctcagcctcccaagtagctgggactacagatgcgcaccaccatgcacagctaatttttgtattcttaggagagacagggtttcaccgtgttgtccaggctggtctcgaactccagacctcaggtgatctgcccgcctcggcctcccaaagtgctgggactacaggtgtgagccactgctcccggccgtaatttttaactaaaggaagctgtgccaatgtggatctgcacttccaaatgttacacaccagtaagggctaagatgaaacaactaattatttgatcaggagaaaggtattagaaaagtagcatcaaaggccaggcacagtggttcatgtctgtaatcttagcactttgggaggccaaggcgggaggatcgcttgagcccaggagtttgagaccagcctgggcaacatcgcgggacctcgtctctataaaaaatagaaaacttaggcatggtggcgtgtgcctgtagtcccagctattcaggaaactgaggtgggaggattgcctgagaccaggaggtacaggctgcagtgagccacgatcgtgccactgcattgaagcctgggtgacacagcgagaccccatctcaaaaacacaaaacaaagcaaaaagaaataaataaagaagagtggcatcagctgcatagcactggatttgtccaaaccaatgaattcctttattttgccccagggattggtttatatgtaaaatcaaattgaatgaagtctaatataactgaaaaagaaaagatgagataaaatgtactaaataatgagaattttaccaaatgatttggaaagaacagccagagaatgcatacttgtgcgcacacctggccatggtaataataggtctcttttctcacggaaacacttcagatactccctactcctaataacaggccttatgtgtgaactaaacggaccatgttaccttcgtgtttcatgggacaatgtttctttcctcttcaagctgttctttcacttcttagcagcagtggccctccccggccttaattaccacaatgaaaccagtacacagctacactgtgtgaaggtgcatttatagaatgcaggtgctttttgatttttaaatggcaagaaagtataacaatactatgaagtcaatagtgtgcacactccagcctgggagacagagcaagaccctatctcaaaaaaaaaaaaagtgtgctttcatggttaattagtagctgcttttttttttttcttttcttgagacagagtctcactctgttgcccaggctggagtgcacactatgagtaattagtgagtaactaataatttttattagcgagtgtgttttgcggatattgaccattagtgttcttctagttgaagttcaacaatgatttttcatgtcattagtcatagttatagtccatgtgggaacaatggcatattttatatctttattaagtgtccttttggttatagggtttgtaggtttctccttgaaaccttctcctatttatgggggcctagagctaattattagtggtgctgtaggttgtggtattgtgttgatttttggtgtggcttttgtggggttgacagtctttttggttcacttgggtggcatgatggttgtttttggctataccatggcaatggctgctgaggaatatcctgaaacatgagggtcaaatattgacatctgaggggctttactattatgagtattaaaggggttgctgtcggtttggtgaatagttgagcatgatggggtggggatcatgattgattttaacagcatagagagttggatgatttttgagggggagggggaggggttgttgcatgaggatcctgtgggtgcggctgccttgtatagttatgggtgttgaatagtggtagttgctggttgatcattatttgttactatttacgttgcgattgaaattactcggggtaatagattagataattaggagtagggttaaaagggatgggataaaaaaagagagaaagtagagtttaattaggcctttttgagtagacacagtaatggaggctgaaatttgggtttgtgaaatggtctttggtatagacttttctagtcaaattaggtctagtagtagtgaagccagattttggcttgtggataggtttgagttgggggttgtatggtgaattgtgactgaatagaatcctagtattttggagaagttgaatgtctgtagtgggtattttagtttaaggttattagttatgagattaaactccattgctagtaagaagcctaaggtggtcacacctagggctgtgagcttcaggtggagtggtatggttgtttggggggatgacgcaggaataatactgttggtgaggaggaatccggcgaagatgctgctgattgttaggtgtttaattaggaaggggttattttcgttaataataaccagagtcatgaagtaaggttgccctattagagcgaagaaaataatatgggtactgtagacagctgtcaaggaggtggcaataagcgtaatagaaagggctcaggcattggtgtatgatgtgtttgcaggttcaataatgaggtctttggagtaaaagcctgtgaggaaggcatacctgtaagttgtgaggctgctgataaaatgggaggaggaagtgaggggtagagtcttgaatagccctcctatttttcggatgtcttgttcttcactgaggttatggatgagggacgctgaacatataaataatatagttttgaaaaaggcatgggtgcagatgtgaaggaatgctagatgcagctgattaatgccaattgtgactattataaggcctaactggcttgaggtggagaatgctatgatatttttgatatcattttgtgttacagcacaggtggctgtgaataaggtagtaatagcccccagacataatgtaaaggtttggattgataggttattttctattaaagggtagaagcagatgagcaggaacactcctgctacaactatagtgctggagtggagtagggctgagactggggctgggccttctatggcagatgggagtcagggatggaggccgaattgagctgactttcctgctgctgctaagagaaggctaattaatgggagggagttgggggtagggtctagaatttattttttgctgatattctcatgtgttggaggacaggaggaatcatgctatagctgaaataaagccaatattgccgatgcggttgtacagaactgcttggctgctgtattagcatctgctcggccgtaccatcagccgattagtaagaaagacatgattcctacgccttctcatccaatgaagagctgaaagaggttgttggcggtaaccagaattaatattgtgatgaggaaaataagtatttgaacaattgattaatgttagggtctgagtttatatatcatatt
